United States Patent 10,724,096 (METHODS AND COMPOSITIONS FOR INHIBITING AND TREATING NEUROLOGICAL CONDITIONS) - sequence listing, part 37

SEQ ID NO: 684 - DNA, 49830 bp, Homo sapiens
cttagcccaggggccggcgcctccccgcctcgcgcggactgtctcgtgcgggcagctgcgggcgcacctggaccctcgcaaggcccgggcggcgccgatccccgcgggacgcgctgcgctcggggcctcccgcctccccccctgccccagccgccccccggccgcgcggcgccccgcaccctgcagggacggctgccgcatcgctgggacaaactcggcagcggaggcaaagttatttcccctcccaggcagcgggattccgactggcaagatggtgcccagctctccgcgcgcgctcttccttctgctcctgatcctcgcctgccccgagccgcgggcttcccaggtcagtgtccctcccgcctctctccaggccagtgtccctcccgcctctctccaggccagtgtccctcccgcctctctccaggccagcgtccctcccgcctctctcccctgtccctcccgcctctctcccctgtccctcccgcctctctccaggtcagtgtccctcccgcctctgtcccctgtcccgcgcgcctctctccacgccagtgtccctcccgcctctctccaggccagcgtccctcccgcctctctccaggccagcgtccctcccgcctctctccaggtcagcgtccctcccgcctctctccaggccagcgtccctcccgcctctctccaggtcagcgtccctcccgcctctctccaggccagtgtccctcccgcctctctccaggccagccagtgtccctcccgcctctctccacgccagtgtccctcccgcctctctccaggccagtgtccctcccgcctctctccaggccagtgtccttcacgcctctctccaggtcagtgtccctcccgcctctctccaggccagcgtccctcccgcctctctccaggtcagcgtccctcccgcctctctccaggccagcgtccctcccgcctctctccacgccagtgtccctcccgcctctctccaggtcagtgtccctcccgcctctctccaggccagtgtccctcccgcctctctccaggccagtgtccctcacgcctctctccaggtcagtgtccctcccgcctctctccaggctagtgtccctcccgcctctctccaggccagcgtccctcccgcctctctccaggtcagcgtccctcccgcctctctccaggccagcgtccctcccgcctctctccacgccagtgtccctcccgcctctctccaggctagtgtccctcccgcctctctccaggccagcgtccctcccgcctctctccaggtcagcgtccctcccgcctctctccaggccagcgtccctcccgcctctctccacgccagtgtccctcccgcctctctccaggtcagtgtccctcccgcctctctccacgccagtgtccctcccgcctctctccaggccagtgtccctcccgcctctctccaggccagtgtccctcccgcctctctccacgccagtgtccctcccgcctctctccaggccagtgtccctcccgcctctctcccctgtcccgcgcgcctctctccatgccagtgtccctcccgcctctctccacgccagtgtccctcccgcctctctccaggccagcgtccctcccgcctctctccaggtcagcgtccctcccgcctctctccaggccagcgtccctcccgcctctctccacgccagcgtccctcccgcctctctccacgccagcgtccctcccgcctctctccacgccagtgtccctcccgcctctctccacgccagtgtccctcccgcctctctccaggccagcgtccctcccgcctctctccaggccagtgtccctcccgcctctctcccctgtcccgcgcgcctctctccacgccagtgtccctcccgcctctctccaggtcagtgtccctcccgcctctctccaggtcagtgtccctcctgcctctctccaggccagcatccctccttcctctctcccctgtcccgcgcgcaggggaggcagcaccaaggctgggggacccgggcttgccactttccactcggatgcctgggttgagagctcggagcgatgcctgggctggggttcagttttcagagagaggtgcagggtcccccacctgtcacctcagatgcatcgctggccgggcccctgggaggacccgggctgggctgcgaaagcgtcggtccattgtgggcgaggactccacgtgagcaccgccgggaggaagaagatttctcagggagctatgagacattggtctttcctgggtctccatgagagctccaggtcacctaattagcttagagaacgtccccgccctccaaactccgacatttaaatttccaaccgaagtatcagaacactcacgggactttctcagcagtttgtggcatttcccaggcagaggtggcccgggaggtttccgaagcggtcccttcccgagccggcgaggccctggatgtgcgactacattttcttaaacacatatacaggcggcttgctgtttaatttttctgttcttgccgttggcatttgttcgaatctcaccggatttatttgtttaatacttgaccagattcgcttttatgttaaccattagcaactgatttttaaaattaaggcgagaacttgaattgccgagtccgggacccacatccagcagagtagccctggcaagccagggtgaggggcccggccatggactgccgaccccgctacctgcacaataccaacagcggtgggcagcggagagcctgcacacggagtgcctggtgcgcctcaggctccctgcagggcatcttccagtcacttcattcccggagctaccctgtgaagtggggactgttacccccattttgcagatgatgaaagtgaggcccagggaggatgagatgtattcaaggtcacacaaccagaaatgagcggaataaacccagtctctcttgttgggctccaagatttcttccttgcctgcagacacttgcccatactccctggccagagactgacttcctgggccaggcaggcatgcccatggccacctagaggcccctacggtgcaggaagggattccaggcaggcagaatttggctcagacgagacgtggtgatgttagtgcagaaggtagtgagggggcaccacagggagatactcagtgaccaggcagcagaggcccagtttggggccacgctaaacccacccaacagagcaatggggtctcctatcaactttgcaggttacagaacaaagtaaaaccccacctcagaccttgagcccaatgccagaagcataggtgggtacatccctaaggcggctccccagcctaggctccaaggaggcagcgtggacaggatgtgtgatgagatgcgtgagaaccaggccctgccattgtgtgacttttgctgctcggggaatgaggtaaacacctgtctcctgaggttacctagaaaccaggtgagaccgaagcacttgtcatatgtttgcagctgctgcagaggcaaagtgagctcacccagactctgtacccggaacttctgggtccaatccctgtcccgccacatccagtctttctcaagtttcttatcctctaaaccttactgtcttgagctgcaaaacacctgtcttaggtgctttgtgaggggaaagggaacaaaagagattgcccatagatggtcatttaaaaattctagtgagactctctttcacccacagtcctatgtggccaggggtctccccttctccaccctcaaccctgtccgggcaagcgtaaagggtgaattgtaaaggaggccccagggcctggtgcatgctggaacaagcattacctgactccttccacgttttgggtctctgctcaaataagtaatcctctgcagaggccttccagaactctctctactctaaacaagtcctctctctgcccctgtatttcctgtttgggtcccctgaagggctctggcgtagtaccgatcatcatttgtaatgatatattttggtaggtttcaagtttattgtctgtattcccactatagggctccaggggcagggacccacctggccttaaagcagtgtgagccctgggactcctgaacccaccagtaagagccattggttggtggagactcagcaagtttggagaatgagctgtgcccacaggatcatatcttgccatggaggagatgagatgggtcaggtgggaggcactgaggacaggcttcctcgaccaaggcccattgacacagcaactccaaggagctctagatggagactgcggtgctcctcatgggggtgggccacaaccctgtctggggttcccgtttgctggcaaatgtgcttgctttgcgttttaggagacagcgcaagagtaatatcatgagcgtatgtgtgtgtttgtgtgtgtgtgtgtcaatagatgtatgtgtctctgtgtgtggttgtgtgtacacaccttttttgcattggtacctgtggttgtgtgtgcatctgtctgcgtgagtgattgtatgtgtgatggtaagtgtatgtgtgtgtgcatatctgtgctgtgtgtgtgattgggtatgcacatgtctttgtgtgttggtgattgtgtctctgtgattgtgtatgtgttacaggggaggggaggctgtgtgctgcagggtccagagcagtggtcctgcggggatggagtctcatctctctcctgctctcctctgtggctatccactgtgtccctcttgtcagcgcatctgtcccaagtcactttgcaggtttttgtcactggctgatgaagagcaggtggtcatggggaaggaagggaggctgagaagtatggggtgtgcagagagcaggagccctttctggacactgtgcccaccctgtggccttcccactggaagagaaacacctcattggggagatcagaacaaatatctaaccatcatctcgcacttcaccttcagcccacagtggctctgggcgggcaggggatgcgggctcccggccacctcctcgcctgtgtggggagctgctatggtgtttaagcaggcttccctccctgaccctctccctgtgatcagatgtcacaggtctccaaattccaccatgagaggttcattcttttagttgcctcctcccatttgatacattgctttttataattaaataaaaataaatgttgttcatgtataatttcatgattttaaccatggaactatattctatgtgtggcaaccaccaccacaatcagggtacagaacagttccaccgcccccaaaactacatcatgctgctctttgaagtcacacctactacccaccccagccttggcagcccttatctattctttatcgttacaattttgtcttctccatcatgtcatacaattttttattttattttgttttagagacagggttttgccatgttgcctaggctggtctcgaactcctgggctcaagcaatcctcccatctcagcctcgtaaagtgctgggattatagctgtgagtcactgcacccggcctccacaatgtcatataaatggaaaagagtacatggccttttgggtttagtttctttaatctcatttgctctgagaatatgtgttgggcagtgcttgtggctgcagcatttaccccgagataactttgtcacaaaatatcttttattattttcacattgcttagtatatcaactttggaaataacagacatcattctatttatagcattctgttcttagtagtggtatttccatttacaaaatatagtaattcttgatcgctgaaaatgtcaaatcctagaaatatagctctcctacgcgtgatattaacatcgctctggaacagttgttggccgaagattcaattgatgcatccgatttttcccaaatagacgattttaatgattcagacaattctgatgttagttctgctttgaaataactacaagaacagtttttatattttattttcacattgaaaatcattcagatttgcttcagcttcaaaaagcatgtttctgtaaaattaaatgagcactggcagcaagctgcacttttttgattctaaataagaaaattaacttcgtataatgcatctaagaatcacccaagctacaggttcctttttgtttttgcttttgtttttgtttttgttttcttttctttttttttttttttttttgagacggagtcttgctctgtcactcaggctggagtgcagtggcgtgatcttggctcactgccacctccgcctcccgggttcaagcgattctcctgcctcagccttccgtgagtagctgggattacaggctcccgccaccacgcccagctaatttttgtatttttagtagagacggggtttcaccttgttagccaggatggtctctatctcttgaccttgtgatccacccgcctcggcctcccaaagtgttgggattacaggcgtgagccaccgtgcctggcctctactgtttatcggttcacccactgaacaacaaccaccgtggtgtcattccagttttgggcaattgtgaatacagctggtataagcattcaaaatatgcttttcatgtgaatgtattttcatttcttatgggcaaatacctgggagtgggattgttgggtcatatggtaaatgtgtgtttaacttcgtaagaaactgcccaactatattctgtattagttttaccgctttacatttatgaaagacctcactacactgcatccttaccagaacttagagttctcgggttgatttgtttttctccaagtcattctagtaagcatgcagtggtatctcattgcggttttaatttccatttccctaatgactaatgacattggacatctcttcatgtgattatttgccaaatagtctattgggcaaaacgtctgttcgagccttctgcccatttaaaaaattgattgtttgtttctttttctttctttttatttttttgagatggggtctttctatgttgcccaggccagccatggaattactgggctcgagtgaccctcctgcctcagcctctggagtatttgggattacaggcaaatcctgattgtttttaataaattttgagcgctctttatatattctaaatacaaagccttttttggatatgtgagttataaatattttctctcagtttgtagcttaacaatgacttttgcagatcaaaattttaaattttaatgaactttagtttatcaattttttattttaatggattgtgttttgggtgtcaagtctaagcactcttggcctaacctcaggtcatgaaaattttcttctaaaatttttatagttttacatttttattatgacccatgttgagttactttttaaaaatgaggtgtgagattcatcttgagggccaatttttcatgtggatatccaattgttccaataccatttgttgttgaaagactgctgattcacacacttgccttagcaactttgtcaaaaatcgttcatcatacatgtatggagaaatttctgccaataacacacttatcttgattaccgtagctttacagtaagtgttaaaattgagtaaagtgggtcctccaactttattattccttttcaaaatccctttggctattctagtttctttgccttttcattaacatttcagaatcagttgtctatgcctataagaaattctactgggccgggcactgtggctcacgcctgtaatcccagcactttgggagggcaaggtgggcagaccacctgaggtcaggagtccgagaccagcctggcaaacatggtgaaaccccgtctgtactaaaaatgcataattaaccaggcgtggtggcacatgcctgtaatcccagctactcaggaggctgaggcaggagaattgcttgaacccgggaggcagagattgcagtgagccacaagctgagatcacaccatggcactccagcctgggcaacaagagcaaaactctgtctcaaaaacaacaacagcaaccagaaactactggaatttgtattgggattgcattaaatctatagatcaattagaggagaattggcatcttaaatgtactgagtcttccaatctgtgaacacaaaatgtctttctacttatttagatattctttggtttctttcatcagtatatatatatttttagttttcaacacaaacatgctgtgtgttagacttatacctaattatttcatttttgaagcttttttttttttttttttaaattcatttccaagtggatatccctagtatggagaaatccaatgggcttttctgcgttgaccttgtatcttgtgaccctgtggaactcgatcattatttatagggaattttaaaaaatacatttccaggggtttttttacatggacaatcatgtcatctatgtattagagcagttttacttcttcctttttaatgtatgtgtcatttatttatgtatttagccttattacatggactaaaatttcaagtacagtttttaacaggagagcgaacattcttgccttgttctagaacttaggaagaaaggattcgttttttcaacattgagtatggttctggctgtaggttttttgtaggtgttatttgtctggctaagatttccttcttgtcctagtttgatacaatacttattatgaatggacattgaattttttcacatgctttttttctacttcacttgatatggtcctgtgttttttctttagtctgttaataaggtggattttctgtcttctggaagagatggtgtagaattggtgccagttcctgaaatgtctggtagaatttaccaatgaaaccatgtgggcctggagacttctggaaagttttaactatgaattcaatttcttagatacagagctatttaggttggcaatttttcttccctggggtgagttttggtagtttgtatctttcaagaaattggtccatagcacctctctcttgaggcacctacttctaaatactctggggaccactccgcatttctacacaattgatctcctataatgacagataagtgctttgttccataatccactacagagccaagtagtcccctatgattaatttcctttcttgtgtaactttttaattttcctagagtttattcccttttgcctcagtctgccgtctacacaagcacaattgtttccaggatctccttcccagtcagtgttctgccagggctgcttgtccctggagcccagactcccccggcctctctgcatttggctcccgccttgctgctgccctccctgggctcgtggccctgcggctacacaggggctttgggagagagtctctctgctatcctgagctggagtctacattttcgagatcacatgtcttcctctttctttggcttactcccttatttttttgaacccatccttaggaaaatgatttttaactcattattgctggacttgtcaaatcacttgcctacagtagatatcacactttttctacacggaaacttttaagcagccaacagtagcatcatgatcccgggtcgtaggtggggggtctgctgtggccaaaaagagtggtggctgaatcctacagttgggagcaaggccagaggaggaagtgagaggaggaaagctgacccgcgctctctccgactcactgcccgccagctctcctccccactgacttcccagcgaaaatcaagacctcgcgctggagcaggacttgagacttatttcttggtctgagaaaaaaaaaatgagctgaagggtggaaaaatgaaaacaaaagcttgctcctttccggcctagtatggcctgggaagtcagcccatcagtgtcaatttagctgccgattcggattgattgcctgggactgcctagagtccaggttgagatggctcctcagtcactctagagcttggcatgaaaggacaccatgattgacaggggtatctgccctcatcctagcaccaggagtgttcactaaccctgaagtagagattttaatactaatgcatgaagatgagctgaaacagcaggggcttgtgaatcattcagatctattgatctgagataaataccgctatctaaaatgaggtatttcataaaacagatatttggtgcctacaatggcccaggcactgggaacaaaacagacagtgatcttgctttgattttaagagagaagctctggatctgaagttggcaggccagggtagcaatttgagccaagctcagctggtctgctgtgctagtcagggccagactcagctcatctggactggccttgctcgtttgtctgtagtcagctgccaagctagctggggctggttggtctagggcagttcatctggtgcatgcaggctctgctccgtgaggcctctcatcctccaggaggctagctggggcttttctcatggtggttgtggtggtggtgatggtggttgtagagcaccaagactgagcagaagctcacagacttcttgagacccaggcttggaactggagcatgacttccactgcatcctgttggccaaagcaagccacaagtccagcccagatatgaaaggtgggaaaacagacttcctttttgatgaaaagagagcagagtctccttgcatatggcgttggcacagggaggaagacctggggtgatttttgcaaatcctccatcatagtgacgcaaagacttactcccacaggcacctgtgtttagacaaatgggtggaatcagggcagggtggtgatggggaggttctcctggcatcttctgctttctctagcagcctccacttctccctggcacattcaagaatgagatctacatcctgtcaagggcagccctgattgcagaggagaatggaagtccccttgctcccttggggtcatttctggccctgggggcattgggcagtgagtgtaaagggcctgatccacaccatggcccgctgggaaaggagacgtggccagccagttcagtggtttcttgggctagcctggagtctttcaatcaggaacggatgtcctcccaggtctgctcaccctggggaatcctatttggcactagacttgattgcaggcagatcgagccagatgcctttgaagctgctccccttccctttgggtaccagccctccctccatatgctggctcagacctgcctctcagccagcggtgccaggatcagggtccattgtttgggcacagctgttgacaaaggcctgactgtgctggccactctcccctgacccataggggcaagggtttgtgcagccctggggctccagagaagactcccagggtgggttgaactttctttatcctttcaaactccctgccaggactttccatgctcttcagtaactgcctgaaacctaaaataaggacacgacacacatttttgttaaagaaaaaataagcacccataatttgactggacccaaacccatccatttgcacaagtctcaagtacaatttgtaactcaagtaagtaaaatgtgtatctcaaggaagtaatcatctctcctcctgtatataggaaaatgtgttcctctctggacaccagaatctctcaaaggaggcagcctcgatgggaagtgagacccaaggaactcagcgtggggctgggtgcctaagtactaagattgagacatgacagttgttcacatcaaagaccagaggcatgggggatattggtggtgactgggagggaactggaaagtccccgagccacccttggccccgttcttgccatctggttggccactatctgagacgtttccccgtctgctggagattagttccctctggaccttagatggaaggggagggggttatgagctctggagcagccctttcccatgctcaccccatctctgaaggaggggctggggtcagagagcaagaccagcaactggttgcattgtccagaaagcctcaactgcccctggggagctgagagcatcagatgactcccgggctgatttgaacaaaaacagaggaccactgagctccaagacaggggtctctgctgtaccagaagaaaaaaaaaatgcatccagagaagcatcagactgtagtgtaaaaacatacaaacatgttagtatctcctgaacgggtcagtatcacctcagtcctcctgcaatttaggccttttctctgattgcatgacaaaaagaatctaactagtaagataatgtgctcattccacaactatgtcctgagaggctagcacaggaaaaatgctgttctgggaggcctgaggcagcgtagcacgtggtgaagactcccaggcctggcttgatcttggctcggatccttcctggttgactgatctggggcaagttcctgccccttgtgaatcagtttcttcctctgaacagtggagataatagacattcccatctcatggggtcatagttgaagaaaatgaataatattcaaagaccaggtccataacaaatgctaaatacgtgacaggagagagaaagatgcagctgacacagtccccactgccacttagctcaccaagcaggaagagaaaaaccagacaaattagaaaagtatcagagggccaacgattgcctaagcggggtgctgcattggagggtggccacgagctactccaggttaagcaagcaggtagggaactctctaaggaggggacttctaagtcgaagtggaaagacaactctagaggactccactctagaggacctgggggcagattctccaggcagagggcccagccggtgcaaaggccccaaggtgggtgtagcctggggaggttcatggtaagagggcctggattccactggcagaacggattccgctggattccgtgggcaaacgggaagggaagggtcaaatgatggcggtgtgcctgagtacattgtcagggtccggggtcttggagtctttattcttggaataactaacatgaatggtgatgatggctaaataaaaagtggggtgtgttttctgattttcctactctctctaggggaaaatcccaagtgtttctgagtgggttggcagtggtgcaacagaaattatcctctcctgtaccacggcagtcctgtcacatctcccctccctgcatcctcacttgctttcgtaaaatctgtatttcccaaagacagaggtcagaggccaggctgcatcacgcccctgcctacatcccacaagtctcctcgccgctgagaataaagggaaactcctcaccatggagctgacagaatgtattagtttttcattgctgccttctttgattcctttttatctactaaactttctctcccttctatattcatattgtgttaaatcccaaaaggaaatagacaaaatgtgctgccatttttgctggtaggaggctctcaggttgtgagatgtgaggagaaggctcatatacccggcttgtgtacctaggaggggattgcagctgctggatgccatgtgtgtggaccccaagctccttgcttggcttgggcattggggacctcagagacttgctgaagataataccgaggctgtgaaaggcacaacccaatccacaggtgcagatggcctctggacaaaggttagctgggcagcaagcaggtgaaatggggaaagtgagtttggtggtaagatgagcaagagattgtctttggctcatactgacgccattccttcactcctcattcactcgttcactcgtttgttcattcaaatgggcatctagtgtactttcaaggggatgctgtgaagtgagaggatgaatgaggcaggactcacgaaggttctctgtgcacccctctctaaggtgagtccggccatcttgtcacaccagcggctggagaaggcacactgggttttaaatcctggataggccaccgtggctcagagacctatgcggcttccgcccctgccaagtgggtgttgtaatggtgccacgtcctgcgctgtcatgggttcctgtgtgaagtgtggccgcagtgccggctctgggcacccgctgtttttgtcatcgctcctgtggctgttttaaaaaccagactggaattgcgcatggagtgtaaatgtagagttacaggcagccagcagggttcaaactcaaagtaccctgagcatcctggggtgcagagccccaaagggaggctccagctggagggctggggtggttaattttatgtgtcaatttagttaagacatggtttccagatatttgctcaaacaccagtccagatgttgctgagaagcgattgtttagatacgactagcatttaaatcagcagcctttgagaaaagccgattcgcctcctagtgtgggtggccctcatgcaaaagactgaggtcccctgaggagggagttgggcctccacactgccttctgcctttgaccttgagctgcagcatcacctgcaactggccctgggtctccagcctgctcctgccctgcggaggttggacttgccagcccccataactgctcgacagttccttaaaattccttaaaattggacttgccagcccccacaactgcgtgacaatcccttaaaatctctctttctctctccatatattaataagtatgttatatattacaatattacatatgtatacgtatgcatgtgtgtgtatatataatatatatctctttcttattgcttctgtttctgtagagagttctgactaatccaaaggcctcaggcaactccccaagtgaaattctctcacttcctccagaagcacccactttctctcctcatatatgtgggtgctgagcagaggtctctggcatgaagagtagtcgaggatttataacccgcctctggctcagttgaaaaataaaaataagttctgtagagagcacattcacgaattcgacatgactcagacgctgaagactccgagccttggccagcaggctcacatttggtaagttgctcggtcctttcagagacctaaggcatcaaaacatctgtgttcccattaacaaaatgctgacgtgacgcatagctgtggcttgggagaaaccagcgtgggagacggcccctccaagtctaggggtcatccgtggccatcggaggtcttggagctctattgtcaccaaagaggctctcaaaaggtgtcactgtaccaagactgtcactgtgaggaagaccatcgagccaggttacaggagaacagaagccccagggaccagtccccatgtttccgtacatactcctgaagcttctctgtaccctctgttgccttcagagcaggttcggagtgagcccaaacagcatgggggcctggatgggatgagaggggtcaggcctgctggcaggggaccgggtgagccgggggacacacacccatctttggctgtgtccacccttggaccaggaggtagggtctgggggtacgaaatgtctctggaggcccagccatcctgcaagtggtagttggttctcagaggaagggagcctggtgatctctgaggaatcttccgtggacccgccggagtaaacactgtgcgagaaggggctggaggggagatggacaagaattcccggagaagggcaggggtggatggagcgttccatgggccttcttgcttccaagagccttaaaaccagctcctcccctcgcccagctctcagcactggtctgcgtcttccagaaccatccatgccacctctactccagcttggaaaaacctggatggggtgacatctgttgttccttctctaactggttctctgcaaacattgccattggtgtcaagttagatgaagtactcacccctttaaagagtttcataacagaaacggtaaaccttgatatttttctactcaaagatggaaggtttcactgcatgtctcctcttagttccatttcaaagaagttattaattcaaagaaatggaaactattcgtcattatttattgtcaatgacataagttgggccacgactggttttgaagggatgaaaatttataccatttgaggggatctctctaagaaaaagatttaaaacggggcgcctcaagagccctggaagaggcctgggaaagtgaggacccagacatggcagcttcctcagcttcgaggggacggcctctggaacacgctctgtccttcctggtgtgcaggggcctccccttgctgccctgtctggatctgaccttcacccactcccaccttggagagtgggaggtcagcttcgagggctgtgcggagcctggggttgcttttcactgttgggacctggaaccctgagatgggaaagcctcacccaaaagccagcccttcactgagcagcaggtggacagcccttgagggtccggccggcttcctgtccatcccatagcccctcacagcacccttggcctgacctcagcaaggaccacatgtgcatggaaggaaatggcctgcttccatgcatggctcagagcaggggagggtggtgggtttgggaggggaatggcagacaactgtggctgtgggcaaggagccccctgcccagactgaaaagagtgcattgaggaatgagaattgagactcagagacaggccggttgctctgctcgttaacatgaaaatgatgccacagccagtgttgaggggaaagagctgacatagagcctgcatcctgtggggctgcatggtgacgtctgtgcaagggagcacctgtgtctaacccaagacttgaaacccaacgaaaagttaacagtggttgtctctggttgtgggacttgttctttgtttgaatgcatttttctgtattttgaattgttttgcagagattatgctttctttttatgatcaagcaaaatgataaagctttctcagcttggaaaaagggggcactggggtctcaggcccctcacatgacctcatttgtccccataatgtgggtctcatgggtgcatgtcttggtatgtaaggattccagcttcatcatctagctttgcaaaggagctcggtgatgcctgtgcctataccaactcaggtgacagatgagcatggcatccaggacctgccctgttaggagcagctgcagctcagaccctcaaacctcatgtcaaaggcacggatactctctgcttctcgggctccctggccccagccccggcatgctggcttgccgagagcagcaagatgcttccttgtaccacgctctgtttcatcagcctcaccccagagaggttggaggctgggatgggccacagcctcctcaccttccctcggcaagtcagcctggagccttcctgtctccctccccgcctgggacggagatgcagccttggtttgcttggtcttgaagatgtttaaggtttttccgtggtaactggcaagctgggcacatctcaccctcaatgagcaccggggagaaagcagctggcgcctgttgcccacggagcaggaagtggcaccggaagcagagggcagttgtgcctggagccagcagcactggggttagaaatacttggctgcccagcggccaagtagaagacaagaccctgtccctccacacacactcccctgcttcctttacttcctggagccccaggccatcaccccaggttcctggcagtatgcttgcccttcccagcgcagcctttggcacagatttctcccggcttcaaaactgagccctccatgtacccggggcagctgcggctccgcgaacccactttcagctgtcagggcctggccagctcgtagcgcaggaggcagctgttcgcctggctggatgtgggcaaggacgtctcctccaccttcccttcacgcttcctgcccccgctgcccaggtgcccaacctgaactttgcacgggagtgagaaatctactgtggggcatttgggctcagtcctatcaatccctagtgcaaattcatcaataagatcattcaccacacaggagcctgtgagaacaaaggaggcagtccattggggtggccggcggggctgggtgggagtcagacttcctggcctggctctactgctcctaagccccatgatttgggggaaggtgtttgactttcagcctccatatctttctctatgaaatggagacaagccccgtttctccacggggttgctgccggccagtagctgaactattctttgttacagcgaagaagctctttgtagactgaagtacacaaatgcaattgacatataaaccatgaagtcatctataaaagcagagccccccttttttaaggaaggggacgtgggtgtgggaaatcaggtttgggtggcagggctgcacggtgctgggcaggtacggggttgcaggaggtcgctcctgagtgccccaggacctgcgtgggagggaccacaacgtgggaggaggaaggaaaacaaaccaaacttctcttccgagcaattgcgtttggggctgtgcctggtcaggccctgggtatggtggaggcccaggagcccccgggattaacgaattccaggggcaactggggattcaactgtgtcaaaagcatccattcagtctggccagtgagtcatctgtttggtgaaatctccacggtgcagaggcctggcagcctccctgggagagcggcagtggctccattcccaccgcggtggtggtggtggttgtggttgtggtgcttcgttggtgaggctggaagccaccctggctgtgggggccacacacctccctgccactttactgttccactgtattttagagagtttttttgaattataaaaccaatactcagtagaaaaaaaattaagtagaaaaaataaaattaagactgggtgcggtggctcacacctgtaatcccagcgctttgggaggccaaggcaggcagatcacctgaagtcaggagttcgagaccagcctgggcaacatggcgaagccccgtctctactaaaaatacaaaaattagcggggcatggcggtgggcacctgtaatcccagctactagggaggctgaggcatgagaatcacttgaacccgggaggtggaggttgcagcgagttgagattgtgccattgcactccagcctgggtgatagagtgagactctatctcattaaaaaaaaattaaattaaattaaaacataatccataagcctatccctaaagataaccatcatcgtcttgatgtgtctcctgtctcctgtgcaggcagcagagtccaggctgtgctgttgtaacacacagcccccagtgaatgtgaatggccttagtagagacctgcttgctccacaaggccgaggtcccatccctccccacttgattcacccctcctttactatttttcatgtcctggctctttttcttaattaggtaattaatttttttgaggcagggtctcactctgtcaccaaagctgagtacagttgtgcaatcatgactcactgcagcctcaacctcccaggctcaagtgatcttcctgcctacaggcgagcaccaccatgcccagctaattttttattttttgtagagacagggtctcagtctgttgcccagggtggtcttgaactcctggatgcaagtgatcccaaagtgctaggattacaggcgtgagccaccgcacccagcctgtcctggttctttggttcttttttttttttttgagacggagtctcgctgtcgcccaggttggagtgcagtggcgcgatctcggctcactgcaggctctgccccccggggttcacgccattctcctgcctcagcctcctgagtaggtgggactacaggcacccgccacctcacccggataattttttgtatttttagtagagatggggtttcaccgtgttagccaggatggtctcgatctcctgaccttgtgatccgcccgcctcggcctcccaaagtgctgggattacaggcgtgagccaccgtgcccagcctgtcctggttcttaaaggcagttgagattggaaatatttagtttggttttgttgttgttgttgtttttgagatagggtttcaatgttatccaggctggagtgcagtgatgtgattgcagctcactgcaacctccctcccaggctcaggcaatcatcccacctcagccttccaagtagctggcactacaggcatacatcaccgggctcggctaatttttttgtttttaattattttattttattttatttattattttgagacagagtcttgctctgttgcccagcctggagtgcagtggtgcagtctcggctcactgcaacctctgcctcccaggttcaagcgattctcctgcctcagcctcccgagtagctgggattacaggcacctgccaccatgcccggctaattttaaaaatatttgtagttgagactgggtttcaccatgttggccacgctggtttcgaacttctgacctcacatgatccgctcggctcagcctcccaaagtgctaggattacaggcatgaaccaccgagcctggctgaatttttaaattttttgtaaagatgaggtctcactatattgcacaggctggtctcgaacttctggcctcaagcaatccacccaccttgaccacccaaagtgctgggattacaggcatgagccaccgtacccggccaggaaaccttgagaattttagcattaagtagaatgctggcacctccggggagtggccatctgccatctagaagacatcaccagaaactaacactgccgatgccttgatcttggacttctagccccggaactgtgaggaaataagtttctgttgtttgaacaagcaaacaaaaagtatgatgcttgatgctgctttaagttaggtagcctttatcatgataagcatgatcctccattttctgcctttctatggcttaaaaaaaaaatcatcagaactgaacattgacttttattgaatgcctctttaactctagtgagtttttttttttcttatttcccatgttatatgtctttaaagaataggaaccattgggcattcctgttttgcctgttttacatgtattattggccctttgcttttaaaaatgtctaagagtgacagaaagaaaatgtttgccaaggcccagggttttcagagcattaacttagagtgaagaattagagagaatctctcagagtggcagcgtggtgattataaggctctttgggttcaaataactgttcatccacccggtcatttagagtcatccgtcctgcctgcattttgtttttgtcaaggggtgaactggggctaccatgcatgtacttggggctgtccagcggcaggtcacttttacgttgcgttgagtgagcttcaaacgcggtttggaccccgtggcttcggcgatttcggaagctcagacaagcatgtgggactgagtcagtctcaatgggtggtggcggcgatgtcttctctccgcagaactgtctcagcaaacagcagctcctctcggccatccgccagctgcagcagctgctgaagggccaggagacacgcttcgccgagggcatccgccacatgaagagccggctggccgcgctgcagaactctgtgggcagggtgggcccagatgcccttccaggtgggtccccacgtcggcaccgctggggcggcagcgcagcactcgagcactctccccgagacgctcccagctggaggcccctcgtcacccctcacccttcccccatcaccttccatcttccaactgtggcccccccttttttatttattatttatttatttatttatttttttgagacggagtctcgctctgtcgcccaggctggagtgcagtggcgcgatctcggctcactgcaagctccgcctcccgggttcacgccattctcctgcctcagcctcccgcgtagctgggactacaggcgcccgccaccacgcccggctaattttttgtatttttagtagagacggggtttcaccttgttagccaggatggtctcgatctcctgacctcgtgatccgcccgcctcggcctcccaaagtgctgggatgacaggcgtgggccaccgcgccgggccaatctgtggcccatttgtaagcctggttggtggcagtgggggtggggggagcacattagaaaggcagctgccccctttcttctccctcagcctcaatgtcaccccttttcttcttcagccttttcattctggccttaacaactatcacgtcttcatacggaccaaactgttgcaaggcgccacttttagatcacgcactgcttttcccttccccgtccacaagttggatccagttttggttttgttttcatttttgattttactttaagataattttttagagcagttttaagttcatagcagagttgagtggaaagcactgcgttcctccacaccctctgtgcgtgcacacacacgcgcacgcacacgcgcacgcacacgcacacgcagacgcacgcacacgcacacacgcacgcacacacacaagcacgcgcacacgcacgcacacgcacacacgcgcacgcacacacgcacgcacacgcagacgcacacgcacgcacacgcacacacgcacgcacacacacgcacacacaagcacgcatacacgcacgcacacgcgcacacacacacacacacactcagcccgagccagtgcaatacactggttccagtccatgaccaaggttggctccagtgcttcaggcgtgaaagtgcaccctccagggagtccccgttagtaccaggacggttgggagggaagggctgctgaggacaagttccacttgtctgatgaggctacagccgacaccccagactccctcccatgagggcaggactctgacagacacaagggcactttttcatgcttgccctgtaacagctttcacaccgccaagacccagagatgggcggctggttttcctccggtgtcttagggtgctgggggacaggggccagtcatcatgttcattcaaagtcaggagcctgtggaatatctgacatcatttactcactgcagacacatttatcaagggctgtctttgttgagtgagttgaagtttcctggggaaggcgttggatttcctaccttctcggagatgatggtggcaaatccagctctcaacggcactgagtccgttcctgttttccttggctccacagctgcagaaataaccaccagccaagcctcacactttccaaggcactgtgaggcccaagccctcactggggctccacacaccccaactccatggtgcaggcagggtgtctttccttcctgcctcagatggggaaactgaggccaagacaagtaagttagcggtcaaggcctgactccacaaagccttccttgttttcatggggtcagagctgcctgcggtccctgggagtttcagtggagcccacagggaatgttatacaattcccctgcccatgtgagagggccctgcccatgtgagagggccctgcccgctagacagatagaaaggcagttattattacattattcatcctccttcccaagattcaggggctttcatctctgaaatgtacaacattttttaaagtgccaaattctctttttaaaaaatcgccatcatgtattgtatttctaagtgtgtgggggaccccgtgctgggtactttatgcgtgcagaggctgatcctgtgacagccctgcagaggacaggcagctgtcaggatcccttttcagggtgtggtgggggttgggcccgcacctggaggaaagccagacacctgcccagatcaaatggcacatagtgggaaaactaccttattgctttttaaaagagagacaaggtctcgctctgtcacccaggctggagagcagtggagtgatcctagttcactgcagcctcccaggctcaagcgatcctctcacctcagcctcctaggtagctaggattacaggtgcacaccactgcacctgattttgaaaattttgtaaagatggggtctcactatgttgcccaagctgatcttgaactcccaggctcaagcgatcctccagcctcagcttcgcaaagtgctgggattacaggcgggtgctcctgtgccaggcctgttttgccttttttttttttttttaagggaatttgctgggagtcaggaagaataatttccagttctggagaattcttggtcttcctctctggcttccatatgaagtacctccctcctgtttcctgggtgcatcatcacaacccatcagcttcagggttcatccagagcagcctcagcggattcatgtccccatgttgctgagactgcttaactgtgggtctcactccttacatgctaacttcacctcggaaggcgcagggagcttcgctgtggctctgcacactcagtaggatgtgcttctcgccaacagaatcaaccaaaggacacgttccccttctgtcactagagaagggccttcagctcccatttgggatgtgactacaaattgatttttaattaatttgtatccattaatccactccattcacatttattaagcatctattaagtgccagatactgttcaatctattcaggtatggtgtatttgtgagttgcaggtagttttcttttgtcgaggtttttaaagatttttcatccccaaagagaccctactattttcccccaatgcattttaaaactctttaacgcaataaagtactagatgtaaaaaaaaagaactataaagtaatttatttcagaggctgaggcagaaccccgggagcagccgagtcctgggatgtgagctctcactcgcttgctactcacaaggttattaccactgggggccaacttggagctttactcaaggaaggcgatgcagcaatgggcagatattccccaatcaccaaaggccaccgagcatcctcggagggtccggcacctccctccgccccagctcaggctgccacggctgctcctcaaagaaccctaggttgtgtccggcccaggtgggattttgggcagggctacaccatcctgccagctgcactcctggacagggaggcccatcacgctccttaatggcctctggtccaggacacccctgatcagtgcatcctcatgggggatgctcagtgactctgtcacttgctttgacctgcacagttgaagcaacagttctgtttgtgcctgtttaaaatatgaacatggcaaatgacacttggaatttaccttaaatgcattttagaagtggctctgaatttccatctaaactgaatccaaatccaagccatcctaactttgggcattccctcgtcgcccatgcgtgatgctctgttgcaaaaagaagaggaacaggctagcttcaccccgtctctctccaaccacatcagtccttcgggaaatcttcacagagcagccaggattcgaaccatgtccctcatgctcagctactaccctggcctgagcttccctccccttcctcttgtacgggcacttcacaatcaaaccgcagcaggagtgctgctgagagagacctccagaggcccggtctcacacggagaacaagttgcatggcctttttgttttctttccaatgccccgtgtaactctgagctgtcttgatcctgttgcctgactcatgtctaactactttccacctcgtccactctattccagtcctgttgcctccttgacattcctcagacctgccaggcacatccccacctcaggatgtttgaccagctgtccctctgccctccccagacatctgtctggctgtgccttcaccttcaactcgttctggtgaggcctgccctgaccactgtattcaaaatgatgccctctctccagcatctccagcatcattccctgctttcattttctacatggccccacacttcgccattgcttattatctcccctgctagatggtgggcttcctgagggttgggttttgtctattttgttcatggatatagcccaagtccctaatatagtgcctgcctaagtccctaatatagtgcctggcacatagtaaagatgcaataaataaggctccattcattcatttgttcaagaatgatttatgatttatccagtattcactatgtgccaggcagtgggctggtgctggggatacacaggaacataggccagatgcattctgatggagaggactgaccgcatatctagaaagaggcaagtcaataagaaagttcggatggttacagatactgagaagacagcagagtgagcacctggggaagagtgtctggggaggtctgggttaggcacggtggccagggaacacgcggggaggtggtggcatatgagtggaaacctggagagtgagaaggagccagttgtggaagctctgaggaaagaacattccaggcagagagaagagcaaaatcccaggcctggagctggggctgagcccggcctgttcaggagacctaaagaaacccaggggggctggagccccagaaaatcagagtgagtaggtggcagtgatgaagcggatcattgcagggtgggcctcccacgcttcgaggccttgcacacagcacttagtgtctctgagccccagtctcatcaccttttgctaagcaggcatcgtaccacccatccccaagagagctttgaggacttgatgagacgcagcatgcagaatgaccagcacagtgcacagcctgcagcaggcatgcaacagagggcacttcgagatgggaagtcctgtaattcagtaatgtctaagggctgtggtccaggatgaggagctcgtaatccttccatctctccttacagtttcctgcccggctctgaacacccccgcagacggcagaaagtttggaagcaagtacttagtggatcacgaagtccattttacctgcaaccctgggttccggctggtcgggcccagcagcgtggtgtgtcttcccaatggcacctggacaggggagcagccccactgtagaggtatcgtctctccttcccatcccactgcgctggacccatcacagtatagcaagggtttcttgcatagaaagggtcattccttggaacattttctgcttggttctttaatcattcctcaaccacagaacagcagccaatgtgcctgatcactcacctccatgccaggttggcgctggtctctatctgtatgagctcactatatcttcacaataatttagtcttgttttgcatatggggaaactgaggcacacagaggttcaagaacttgcctaaggttacacagctagggggtgggcggcacagttaagatgcttggcacctggacactctgaccccagagtctgcgctccttcacaccactctctgctctggacaccagtgacttgttcttatcaatgtgagggcaagaagctgctcatgggttggggaaagggaccagaggaaggtactgcaggatgatgctgctgtggctgctccgttctgggcctgcagtctgtctgtgaggctgctggtaacctctggggctgaggaaactcctcaggtgtcctttctgtctgcattgggacttggtatcaagaggctccaggagagtccactgtgtcggggaggcatgagaaggcttctctctgtgctaggtttaaaaacagcacttttttgatatagaggaaaatcagccttggcacaaaaatctgttggcttttcaaaaacccatggtcaaaaaaatcttggctaccattcaccagtcattttcagagcaaggttcgtgggacatctgctgaggcagaatgtccatgattctagccaaagagttgaaggagaaacacggacattatataaacaagaagattgcaaaagcagagtagagagaggactttgtttttgtttttgtttttgtttgagacggagtctcgctccgttgcccagtctggagtgcagtggcataatctcagctcactgcaacctctgcctcccgggttccagcgattctcctgcctcagcctcctgagtagctgggactacaggtgcccaccaccacgttcagctaactttcgtatgtttagtagaaaagggatttcaccatgttggccagactggtctccaactcctggcttcaagttatctgcctgcctcggcctcccaaagtgctgggattacaggtgtgatccaccacacctggccaagagaggactttggatgcttaaattacttgaaaacatagaggaactccagaaagtatgccatccctaaagatgagtatggattgccatgagaagctcagggaaaccagaatcacatttacaatttaggcttctctttcctgacccctggaaagagtgatgatggttcaaaggttgatgactggctctcagacccacctaggaaccagtcaggaagtaaaagtcatgtaacatgcgaacaaaacaggggaaatgccaatatctggtatttacttacttgactctgaaagatctcaagccaggttaagcacctcctgggtgataacccatggcgggggagatgggtacacacagatatttcatttttattgttttgggtgtcagtatttttaacttacagattgagttacagaccctggttggtttccttctcggtctactccgcactttcaggacccatttgcattgccacgtgcagtctgctccagtgcctctgatagctgcctcgtcctctctggggtgcacccccacatctgatctgtccaccccctgccatgggcacctgattgcagtcaactcccggccaccacaaacaatgttgacaaggccttcttatcgccctactttgtctctgggctgtgtatctgtggctggagagggcctactggcttcaggctcgctttgaactgagcactgcctgccactcagcagaagggctgcacctgcccacgcacccccaagcggtgctgcaagcgaaagcacatcttacttatgtgtgtgctgttttttcttgcttgctcagatattatccaaatattctgtcctcaatggcgacatactacaatgcacatcatgtgattaaaatgaaaagatgagttcatcagagatgatagcagaaagaatgcctttttagggagatagatacaaaacactggaggcccaggaacatagtcgtgagaagtgactcaagcaaaggaacatgtggttacttgacaaaggtggagacccaaagcgctccccacagtccatctccatcctagtggctcgccaagaatgcctttctagaggatcctgggtgtgtccacgagcttccttcttgaccttggttgctttagttatgcatttgcacctgcctcgctgcagcaggaccccctcaatggaaaagagggtcctgccgtgtcctaacttgtgccatgatctcaaacattcaggtcctccagagtcacccaggaagctcatgaaagatagattctgaggtctcaaaagaccgatccagtcggaacttttatagatgagacccaaaacatctgcatttttaatatgttccctaagtaatactgctgttaactaaattttgagaagcaccacttggttcgttcttgctattgccagaagcagaaaatatattgaaaattttgaagtgctaatgcattttgggcccaaaccagtcagaatgactgccagccacaggcaaaacagtagacagatgtatgtgtgtcatctctgtccaggaaagacacgttatgttatgttatgttatgttatgttatgttatgttatgttatgttatgttcactgctacttgccctgatgttttgggaaggccaagccaactcttacaaagatcagagcccacagccctgctgagcagacttccctttcttgagatgtggagggcggactttgcctggaggaccatggtgcagagcagacggtcccacctgccaggcgtccagcaagcctactgacctttcccgtggtccaacgtggtatcctcccgagtcttgcccttggacgtaccagttcattccagatgcaccttgtgctcgtctctcatctccccatagcctcctgcatagccctttttccttctaccctgacttccacaccaaagagctgcatgatgcagcccaccttcgggatgcctactcagacagcatgtgctatcaaaaacttgggaaggactaactcagggaacaaggtgatggccagtccaggatgagatcttagatggagatttttcttctcttgaagcatagatggggcctgggcattgaccccatggtggtgattgaacaaaaatactcatgtgttacaaccaagctgctccagcagctgctggccacggcccctcctaagtgagtagactctgcctgcaccgacacttctgttctcagcaggaattgatgtgattcatggttgttgtctccagcaagagcctcaaagcggtgtcagccaaacttgccaggagggagaaatagtgctcctgactgctgtttgatgaccaattgtgacagtattaagggtgtggacgggacacaggctggaactcaacaatctagtgaccaaacctagaaacttaccagcaaccactgagcacacccactgcatgttccaaaccaccagtcgtgtggttgccatgtgttatgaccacagagtgggggtggggcataatcttcttaattacagagaattcatttcaaggcccaaaatatcagtgccagtgacaaatttggcagtgctgtcataattgtccctcactccaactctagtcagctgcttggaaagacagtgatgaacccaacttggcagggaaggaaattgtgtgtacacaattacgccattaaaaaacagcaggcaggccaggagcggtggctcacgcctgtaatcccggcactttgtgaggccagggcagcagatcacctgaggtcaggagttcaagaccagcctggccaacgtggtgaaaccccatctctactaaaaaatacaaaaattagctaggcgtggtggtgggcacctgtaatcccagctactcaggaggctgaggcagggagaattgcttgaacctgggaggcagaagttgcagtgagccgaaatcacaccactgcactccagcctgggtgacacagcaagactccgtctcgggagaaaaacaaacaaacaaaaacaaacaaaacaaaacaaaaaaacagcaggcgtaggtggactccagaactccagagtggaaagcagccacttggctttctccatttctcctttattttccttttttcctcctcctttctctgaaggccatgtttttaagacgtaaagctttctgaattggtaaccatagctgaagatcttgtgcctttgacaacgtgggtaaccaaagaaacgaatttgagagatataaataccgttgtcacttatcgtcatgctggtggaaaggaatctttgtcagtcgtccccaccctttatttttaaccttcattctttcattcagccaatttttactgagcaccagccattcacaaagctggtgccagatgccagggactcaatgtcgaatcccacagacacgaccctggcctctggggtgcacaggctaagaggggaggcaaagcaaagcaggcagccacacaccaagggaagcgagctgacgtttgtggtgagggccacacatgacctaacaagggacagagtaaacagcacggggcaaggagcagttgagggcctctgagcaggggacaatgacactgagatgaaaggaggaatgggatctagccaggcaaagagcaggtagttgggcagcacagggcagacactgttttaagaaaaggaagaaggggccaggcgcggtggttcatgcctgtaatcctagcactttgggaggccgaggtggatggatgacttgaggtcaggagttcgagactagcctggccaacatggtgaaaccccgtctctaataaaaatgtaaaaagttagctgggtgtggtggcaggcgcctgtaatctcagctacttgggaggctgaggcagaagaatcgcttgaacccgggaggcggagattgcagtgagctgagatcgcaccattgcactccagcctgggtgacaagagcaaaactccatctcaaacaaaacaaaacaaaacaaaaacagaaaagaaaagaaaagaaaaagaaaaggtgagtggatcacttgaggtcaggagttcgagaccagcctggccaacttggcaaaacctcatctgtactaaaaatacaaaaattagccgggcatggtggcatgcgcctgtaatcccagctactctggaggctgagctgggagaatcacttgaacccgggaggcagagattgcagtgagtcgagatcatgctactgcactccagcctgggtgacagagtgagaccctgtctcgaaagtgaaaaaaaaaaaaaaagaaaagaaaaggaaggagaatgagcaaagacccccagggaagggaagaatttggcacaattgaagaaatgaaaaatgaaattatagaaccttgttgctggagattatatgagctgagagtgagccaggtgaggtggagagacacgcaggccagcactgtagtcatgggccatgcaggtggtgggattttagttctaagcccaataaacagggttaagacaagtgtcgctgctgcatagagaatgcattggagatgacaagaatggaagctgggaaaacacataggtggctattgcagaagtccaggggagagattgtggcagcggagattctaggtatttttagagacagaactgatggaatttgctgccatcccatgtgggctgtgagccaggaggagaaatcaaggctcccaggctcaggcttggatgatggtgtgccgggtgtcatttacagagatgatgaagactgagcgatggatgtggtttgtttttaaacagctcgtgtgtgggtcattgatcagaattccattttggacatattacgttaaaatggctgtgcgacagacaccctagtggagatccattcattccaccctagatgggtagacatcgtctggagctcaaggcagcagaagggttggaggtacccagttgggagttatttgcataagatagtactgaaatccataggcagtggaaggaggacctgcaaggagaggatggagacagaaacgtgactcaggcagagacctgcagggcactgagaagtcaaatggagaaggaggagggcgaaaggagacaggaggggccgggagaggcagacttcggggaggctgtggaaagcagggccagtggtgctggatggagttttggaagggcattttgcagtgagaagggagcagagcttcagtccacctcaccttctgtatcatgaggcctttcccccgagacctttaaaaaaaagatttgagtagaaagagctgccttttaaatatatagtagacactcaataaatagttactgagtaactgactggctggctgatttaccaaatgattaaattaatgaaaaaaagatgaatttccttctagtcttttatctaagcacatacacatacatccaagtcgcacatattcagtatcatctgtgtatagatattaacgtgagcaatttttcattacctcttctttctaaatgtaactctttatgattaggaagcacttcctcctaagggctattctaggctttattaaatggcacaatcttggctcactgcaagctctgcctcctgggttcatgccattctcctgcctcagcctcccgagtagctgggactacaggtgcccgccaccatacccggctaatttttttgtatttttagtaaagacagggtttcaccgtgttagccaggatggtctcgatctcctgacctcatgatccgcctgcctcggcctcccaaagtgctaggattacaggcggcgctagccaccgcacccgaccattaagcatcttaaaagattttttcactatggaaagtttcaaacacaccaaactacagagaatagtagaatgaacttatgtacctaaaatccagtgattaacacagcaaattccttaacatcatcaatatctaattagagtaaaaattcccccaattgtctcacacttttttaacactttgtttgaatcagggtcaaaatcagttttataacttagaattggttgataatgtctcttctgcctcagcgagtgtcactaccatccttatctgatgtctgtttagttagagcaatttcctgagttttcccactttcaaaaagtgtgcagcttttttactggttgttagttccattggatataaaacacctatctcacatttttcttgagtatcttatgtcactctgtgtcttctgttttaaactgatgctattgtgctactatatttgtctttttgcctgaatgcccccaaaatatattctttttctttaaaattcagtcatttgattaggatctgtctcagtgccagcctttctgggtcagttttctcaggtatggaattcaccttttctttttctttcttttttttttttttttttttttttgagacagagtctcactctgttgcccagactggagagtagtggcgcgatcttggctcatgcaacctctgcctcctggcttcaagcgattctcctgcctcagcctcccaagtagctggaactacaggtgcccaccaccatgcccggctaattttttgtatttttaataaagacaaggtttcgccatgttggccaggctggtcttgaactcctggcctcaagtgatccacccgcctcaacctcccaaagtgctgggattacaggtgtgagccaccacacctggctgtaagttcgtcttttcaataggaagtttcagtggctggaacagcctgccccacaggaacctccaaaattttccagggcaaagtcttaatattaaggagactttaacgggaggagagtccaaactgtgcacaacaaggaaaataggtgcaaatgaaagagatggtcatccagacaaaagtgcaaaggaggcagagctgagaaagtgtgaggccctgtgtttgctcacgttggaaaaacaacagaagtgaagtgagaatttcagagtcatgaagttagcaaagctatatggaaaacatttcacttaattatgagtaatgaaaaggattcttgacaaattccttagaggatattataaaaaaagagtaaaatttctatagacaataaagaaatgccggaaagacatggccataaaacagataaaaactataacctagagtatcacaagctgaaagaaatgtttaaaagataaaagcaaggaaagaacagtttagataaaaatgagaaaacactcaaaaatgaggtgattggaaaaatgaaaaacaggaaatgagttgatagaacccaggaaggaattagaaataaaagaaaaaagtcaggaaggaattagaaataaaagaaaaaagtcaggaaggaattagaaataaaagaaaaaagttcggtcatgcatataaaatccttagctaggcttcatgaaaacagtaagatgaaacttacttacgtgaagtttcaccttcacgaaacagcagatgaaagcagaattatcatctgggctttggcttgccagcccctgccatgcacttgactgaatgccacagcctgggacatacgtgcgtgtgatgacaactgtacttcaatcaggacacagagtgggtgccgggctggacatcaggccattggatgcctctgattgcatatcaagataacagataaagagagtctgaatgcagcctgtctagaaatgaatacactgggtggatccagagagggagacagagtgtacggtcctgggacagctgtgcgtttctctgctgcaccgatgatccccaacacccatccacatggttcaggtacagatcaggctcaatgccttcttttggcaggcagcaaaggagagaccacagcactggccctactggggccaagctacaagatactggtgttcacattttctggctctctgcccacaacttcacggcctagtgatctgcccacttccagactacgctggtgggcaaccatggagctggacaagggataacagtaaccccaagctctaagcaaccccaagcatttgtgtacagtcatttcagacacattcctggaaaccggtcttctgcaaacagaatgtatgagggacagtgcaaccaggctgaggttactgagaaactgaaatggctccttctctagggatgagcagcattcgggtggtctgtctttttgcaacaaatagaaactgtttaagagtctaatgacatcccaatctccaggaggcttaagggaagcctaagtccctcccattccacccaaaacaagtctgtcgttctcattaggagcaaagcacctgtttttcttcctcttgatagacacacaggaaaggctgcttttatgccaacaaggaggtgttttcagttttctttccgaagataatgtggtcaagtcagtgaactgacaagcctctctctgatggaaatggcctatttctgtgcactaaaactgggcttagggaattcataacaagcacatgtggcctatggggttttttttgtttgtttggttggttggttttttgtttttgagacggagtctcattctgtcacccaggctggagtgcagtggtgggatctcggctcactgcaacctccgcctcccgggttcaagcgattctcctgcctcagactcccaagtagctgggattacaggcacataccaccatgcccagctaacatgtgacctctaggttttaaaacaatcattttttttctaattaaaaaaaatgtatacatgattattatgggaaaagggaagaatacaaaaaattataaactagcaaagaaaaatcacctgtaagcctaccactcagagaaaaaaagtctactgagctttttaaaataacaatctctctctacaaagaccttttccacagaagtgtcgtgtagatgagcaaggaacgtctccctttaccaatgttaaggaaatgtcaaaaaactcttacctggtcaagcacagtagggcttctggttgggaatttggagaattcattttccccaaccctggacattccagtgggccatccctcccctttataactgcactgaattttgttcctgtttaaaaatgtttctcccaggtgctggctgatggagcagaagggttgtgggttacagggcctgactcaaaggcaatgtgggcagatgcccacaggtagccacttctgtctggctacagctgtctacactgcacctttgcaaattagaaaatggtgcctgtgggtggggtatggccagctcataggccagctcctgcatgcagagccccaggtgggcagtgtgtgcctgggtgcagggcctgctgaatggagatgcaatagggctgcatatcagccccatcggccccctggcagctcttgcgggtggagagggtggaaagagtgggtggggtcaggtagaaagtgggagttctcctacaatgtaaaggaagttaacccttcatcagttttttattgtatttgttttagacctagaactcacatccgtatatttgaaaattatttatcttcctaggtatcagtgaatgctccagccagccttgtcaaaatggtggtacatgtgtagaaggagtcaaccagtacagatgcatttgtcctccaggaaggactgggaaccgctgtcagcatcaggcccagactggtatgtagccaccatggggttaggtgaggacatcctgctgtggggagaggaggaccctaggcataggtccccaaatgcagacatgtagggagctcagtcccccactcaaagatgtagcttttcctctctgtttcacatccaccgatccctctggttttctaaggtggtcacttgacagagcttagctctttgatgcaaccagagttttgacccttcttatagtagaaaacacaagcgcaagaactgactcccaacgtaaaaatcccctagattgggaatgtggcccaagaagtttcactgttgccacctttgcttggtcagcatttcttacgccagcagaaccaccttttctttccagtgttcccattacatcttgcaaaattagcagctattgatgcaggcccaagtattttgagagctggataactatacatttgactggttttgagattactattcacatcttgagtctcaacatatctcgacccagagagtctaagaagtcacgtggtgcctggttttgcatatggcaagaaaatccagtgataaggaatctgtggaggatggacaggggttcccgcaccatgatgcaaccaagatttcattcagccccaaagatatcctattccttagccacaaaagtctggtgtgttatgcctgtttgtctttatttctgtatgaaatatctgtggggggaagggacattggggctagtgcagtgtccagtggataagagctttatcaatacttatgatcctggcactggacccagcccaagctcaggtttaaatagtgccccaagagatttgctgcttaatatgccctgattcagttcagctgagtcagctggctgggcactttctcaaaatgaggctgtcctcccgagctcagaggccccttacagctcctgtccctggaactgctttctatggaaactgaggccagagacagggctttcttggagacctcactgcctctccccttgtttacaaacaagagggaaaaagaaatgggttcccttctgccctaaatatgccagtcctggtcactgaatgttctaaaccccactctttagggtttcctcccactgtgggattttttttttttttttaagatgggagtctcactctgttgcccaggctggagtgtgcagtggcaccatctcagctcactgcaacctccgcctcctgagttcaagtgattctcctgcctcagcctcccgagtagctgggattacaggtgtctgtcaccactcctgcctaatatttgtatttttagtagaaacggggtttcaccatgttggccaggctggtctccaactcctgacctcaagtgatctgcctgccttgccctccaaaagtgctgggattacaggtgtgagccaccatgcccgcccaaggatctttagacaattgttgctcaggtccaggggggcctgttataaagtgtccccatggccagaatcttccccaggaatgggaaggaggggaagcaagcaggcatatccaaagccagctcctatcctcatagtctccatgaacagccatcacgcatctgggctcttgctcaccttgtccctcagcctgacaccttccttcccatcagctggcccatgcctttccagttccctggaggagcatccctccaattccttttttaaaaatccattcaccctattttttatgatgataaaacatatatataacataaaatttaccagtttcatcctttttaactgtacagctcagtggcattaatcacattcacattgttgtgcgaccatcaccaccatccagctccagaattctttttgtcttgcaaaactgagcttctgtacccataacaggacaactccccattgccctccccacagcccctggtaatcaccattcattcttctttctgtctctgtgagtctgactgctctagggacctcatctaagtagaatcatgcaggatttgtccacttgtgtttgattcccatcaatccttgaaaaactttcagaaaaataacattttttcctgattagaaatataatttggccaagcatgatgactcatgcctgtaatcccagcactttgggaggctgaggtgggtggatcatttgaggttgggagtttgagaccagcctggccaacatggtaaaaccctgtctctactaacaatacaaaaaaaaaaaatagcagggtgtggtgacgtgcacctgtaattccagctgttcagaggcagaggcaggagaatcatttgaatgcgggagacagaggctgcagtaagccgagatcgtgccactgcactccagcctgggtgacacagcgagactctgtctcaaaaagaaagaaagagagagagagaaagagaaatttatgttcctggcaaaaaccaaaaatgtgaacactttagaaaagtacaagaaatacaaaaaaaaaaaccaaaagaaaacaaacaaaaaaaaaccaggaacaaaaaatagtggcccatgaacagaccaataatgagctctgaaattgaattggtcataaatagcctaccaaccaaaaaaagcccaggacctgacggattcacagccaaattctaccagatgtacaaagaagagctggtaccattcctacagaaactattccaaaaaactgaggaggatggacctctccccaacttattcgatgaggccagagtcatctcgataccaaaacctggcagagacacaacaaaaaaagaaaatgtcaggccaatatccttgatgaacattgatacaaaaatcctcaacaaaatacttgcaaaccaaatccagcagcacatgaaaaagcgaatccaccatgatcaagtaggcttcctccccgggatacaaggttgattcaacatataaaaatcaataaatgtgattcatcacataaacagaactaaaagcaaaactacatgattatctcaatatatgcaaaaaggcttttgatgaaattcaacatctcttcatgttaaaaactctcaacaaactaggtattgaaggaacagacctcaaaataataagagccatctatgacaaactcacagccaacattgtacggaatgggcattctccttgaaaactggcataagacagggatgccctttctcatcacttctattcaacgtagtattggaagtcctggcgagagcaacaggcgagagaaagaaataaagcgcatccaaataggaagagaggaaatcaaactatctctgtttgcagatgacatgattctatatctagaaaatcccaaagtctcggcccaaaagttccttcaactgataaacaacttcagcaaagttgcaggatacaaaatcaatgtagaaaaatcactagcattcctatataccaacaacaaccaaactgagagccaaatcagaaagacaatcctattcacaatttgccacacacacacaaataaaatacctaggaatacagctaaccagggaggtgaaagatctctataatgagaattacaaaacatggctcaaaaaaatcagagaagacacagacaaatgaaaaaacattccatgcttatggatacaaagaatcaatatcattaaaatggctacactgcccaaaacaacttacagattcaatgctattcctatcaaactaccaaagacattcttcacagaactagaaaaaaattactttaacatgcatatggaacccaaaaagatcctgaatacccaaggcaatcctaagcaaaaagaacaaagctaaaggaatcacattacccaacttcaaactataccacaaggctacagtgaccaaaacagcatggtactggtacaaaaacaggcacgtagaccaatggaacggaatagagagcacagaaataaggccacacatctatgaccatctgatctttgaccaagctgacaaaaacaagaatggggaaaagactcctattcaataaatggtgctgggataactggctagccatatgcagaagactgaaactgaaccacttcttacaccacagacaaaaatcaactcaagatggattaaagagttagatgtaaaatccaaaactacaaaaaccctggaagacaacgtaggcaataccatcctgacagaggaatggacaaagatttcatgacaaagataccaaaagcaattacaacaaaagcaaaaattgacaaacggattctaattaaacttaagagcttctgcatagcaaaagaaagtatcaaaggagtaaacagacaacctacagaatgggagaaaatatttgcaaactatgcatctgacaaaggtctaatatccagcgtctataaggaacttaaatttacaagagaaaaacaaacaaccccattaaaaagtgggcaacgtacatgaacagaaacttctcaaaagaaaacctacaacaggccaacaagcatatggaaaaaaaagctccatatcactgatgattaaagaaatgcaaatcaaaactatctggtatgagatactatctcacacccctcagaatggctattattaaaaagccaaaaagtaaccgatcctggagaggttgtggagaaaaggaaacccttatacactgttggtgggagtgtaaattagttcaaccattgtggaaagcagtatggtgattcctcaaagagctaaaagcagaactaccacttgacccagcaatcctattactgggtatatacccagagcaacacaaaacattctaccataaagacacatgcactcgaatatttgttgcagcactgttcacaatagcaaagacatggaaccaacctaaatgctcgtcaataacagactggataaagaaaatgcggtacatggggctgggcgtggtggctcacgcctgtaattccagcactttgggaggccgaggtgggcagatcacgaagtcaggagatcaagaccatcctggctaacatggtgaaaccccgtctctactaaaaaaatacaaaaaaatttgcccggtgtggtggcgggcgcctgtagtcccagctacttaggaggctgaggcaggagaatggcatgaacccgggaggcagagctcgcagtgagcggagatcgtgccactgcactccagcctgggcgacagagtgagactctgtctcaaaaaaaaaaaaaaaaaaaaaaacgaaagaaaaaaaagaaaagaaaatgtgggacatatacaccatggaatattacgcagccacaaaaaagaatgagatcatgtcttttgtggaaacatggatggagctggaggctaccatccttggcaaactaacataggaacagaaaaccaaatacggcatgttctcacttataactgggagttaattgataacaacttatgaacacaaagaaggaaacaacagacactgggtctacttgaggggttggggaggagggagaggagcagaaaaggtaactattgggtactgggcttaatacctgggtgatgtgtacaataaccccctgtgacacgtgtttatctatgtaacaaaccttcacatgttgaaggtcttcaaacctaaaattaaaaataataaaataaagaatacacacacacacacaaagaaacaaaaaatagtggcccatggttttaaactctagtgatcaccgttagaattttggggtgttcaagtctttttaagtgaagacgtggatttgccccagctgtccttctcggggtgcggcttggtggcctgcattttcctgcaccattctattccagggcgcttcctttcccgcgcccccttcgcgtaggccctggacgggtcgtctgggtctgtggttgattacttgtctctcctttccctactccagagtaagccctttgagaaggggccgtgcctccgtcttggttctgctcccggcccctacccaaggtcgggcccacggcaggtgcgccagggcccggcactgagcgtgtcttctccccgcagccgcccccgagggcagcgtggccggcgactccgccttcagccgcgcgccgcgctgtgcgcaggtggagcgggctcagcactgcagctgcgaggccggattccacctgagcggcgccgccggcgacagcgtctgccagggtaggcgcgggctccgccaggacactggggacagcacggggaggacatggggcggggaaggggctctcacccaccgccctcctgccggcacgggtggcttcctgcgcgcggtctcagaaggcctggccactttgcattataggtaagtgttgacctagtgatggctagaaggcagctaattcacagaaatcagagctcgccccgcctcagaacctggtccagcctatgcccaagccacacgcgcttggttcaggagagccttgagaccctccatcccctccgccctggctggaatcacgtctacgggtggcaaggaggagcttaaatcgccgtgttggtagagcgggcccggagctgggtaggggtgtgggactcattccttggtcccctctgggcttagctttcctgacggctcagttttgctgtgctctcctgattaccagagttctctccccaaacaacgcaaagcaggagttcaaagctgagatctggtcagttggtgctaatagcctcattttacagcacagaaaggaggattcccaaagataaagagagttaacatggggctgttaacccatccctactttctgggaataggcttgatttgccagcctctgcagggtctccccaggtgtcttcagcctaagacagtgatgcctttctagggcctagcacttcagctccctctcactcctccttttagccctctgggccctcggcttaggagaaagggaagcacacctgctcctcttgtgagtgctctgctgggggtagggcatggcggctgcccgaggcccagccacttaactgcagctgccactgcctccaggaattgaagcatgattgttctgggtcacagctggcaacacttgctgcatggctcctaaagtcacagtgagcacttctgtctgcagacgtgaacgagtgtgagctctacgggcaggaggggcgcccccggctctgcatgcacgcctgcgtgaacaccccgggctcttaccgttgcacctgccccggtggataccgaactctggctgacgggaagagctgtgagggtgagtgaggctacagagtgtcgtctgcacccagccacctgctgctgtgctgaacccccaggacctcacagtcgggagtgaggtggttaggagagtcacagtttcagatacattggatttttaaaaagccaccaaccaaagggcttctcaaaggtcaggccacattatcatctacataaataggaaaatgagttccttaaacatcttggcaactagtcttttccgactttatttgagtaaatgggttttttgttttcttcaaggtctggtcaattctacccactcaacaattccttcagctagggctgggcctaaaggcagagtggccaggtggtcacccatgtcatgtaatctggaggaacccatgagactccatgaccctgtgtccacctgtaagtccacctctgaaaggggcagcaccttacaggcacttatgtcttagtgaggtcgggcgctacagcaccagccttgtctgatggtagctgaggacaacaagggaggcggagcacccagggagggacaagagtcgggggcatcactacccctggcttgtgaggtacaggaagtgagggggcttatcagagcctgaaagattgtggctctgatcaaggacacagcctccatcagaaccacatccaggcaggtcaggactcctcaggctgggtcactgtcatttgccaaccccagctaaaaaccagtcagcctctcaggtgcagagagtgggttggggggcagcggcgcagatggaaaataactggctcaggtttcaccccagtgctgaatcctgtccatcagcagtggtttcctggagggccgggttgaggtttctgaggctgattcctggcagagtgggaaagaacatcttaagttgacaaggaatgtctgcagcagggatgggaggcacctaagagattaggaaggatgtgtgcagagtgggttggttgtagaacagagaggctgagaaccctcgcaacagtcaccatcatcactacaggacaagtcccagggacactgggtgcctaacaggaagcctcctgtgtttccccacctccacttagggaaaatacagatgtcagttgatgtagacatgctgaatctccacatgagctgagtcagagcacacatctcaggcctgaagcccaagtgggatcatcctgacccttggcccttaaaccaccatgctgcagtgggcctttcggggggctggttctgctcctgcaggcatacctcacactaggagggtggacaggcccacctccccagctggacttcccccatggaaacaggacacagaggggagccccgctggctccagataacagctctgacccaccaagggagaacgggagaagagagggcagagggctcctccatgggctgacgtgggaatgtgaggggagaggtggctccccggtgacatcccattggggccccgctgcagggctctgaggagtgggtgacctggggctggagcaggagaaggcatccagatagccacccacactccctccctcccacagtgctcacgaaggcccacctggggttgcttggggttgggagggacggcctccagctggggagactctctggatgtctgcaaagggagcagagaactcatacaaatcatgatattgaggtgtctgcactcgcatggggtgaggctggcagggaagactttctagaagattctaatttaaaaaaagtgtgtgtatatatagtatatataggtatatggtatatatatgctgtatatggtgtatatatggtatatatatgaatatggtatatgtatatatatgtatatggtatatatatatacacacaccatatataccatatatacgtatatatggtgtgtgtatatatataccatatatacatatatatatataccatatacatatatatacacacacacatatatatatatgaagaataacagccatggagggtaatggggcacttgggctgagaagcagacaggtctaagagaagcattgtgaccagtaacactcacctggtgctttccaccatccttgccacctgtcataccccagggaaagaggacaggatcccagggaggggcactccctggcatttcctcagggccctgattccacacagttaaggaaggcaggctttctgctttaagaataagtgccaggagcagggagcaccacattacaggacctgcagggcctctcatgtggttctgtctgcaatggagggaaggtcagggcgattctcacctgttgtatgtcctgtatctcagatgtggatgaatgtgtgggcctgcagccggtgtgcccccaggggaccacatgcatcaacaccggtggaagcttccagtgtgtcagccctgagtgccccgagggcagcggcaatgtgagctacgtgaagacgtctccattgtgagtatctccaggggaggcacaccctcacccaggcctccaagtgtggctgggctggatgcttcctagaggttcttgggagaaggtacagttataccatagaaagatgagaggcaggaggctgggaggctggtgtctctgaatttccatttccgcttagtggttgcatttaatgcgttgctgctctggagaaataagaaccccattccccatgggagtaatatactaagtgcacccccactacatagaggttgatggggttgctgccaccccaggatggcaaagccagggcaggcactgaagggaagaagctgttggtgacattaccctgataaacccatagcagcccaggagacaggtatagatcacatggatttgggaggtgacagcattcacatagccaggaactatagactcccttgagttacactgcatatcccgtgcaccctgcattatatcactctgcttttccaatagtactagaaggttctacatctagtaactgcaactcttaaacagcaagtagagcttttttttttttttttaaagttgggagatgggcctttaaggggaatgactacaactatcacaaagcacatacattttcctctcaaaaagagatcacaagagccctagcgttgtctttaaaatgaagtaacagccatggagggtaacttaattatttgaattgctgttgagttaaagcagattagaagcagcaagaaacttagtggcactgaagcatggcagtttttagagagagtgaagacatcagaaccttcctcatgaagtcactcggtgaagggatagggaacgggtctatgacggcctctggggcattcgaccaacagctggatgtgacagttgactgcataatcatgatgctacagaatcgccaaatatactagattgcatttgtcttttaacaacatagagaaatatcgaaagcatttccacaagaccctctttccaaatgattaaggaaaacagggcttcctgcgttgagaatacacgtgatggccaggcacagtggcttatgcttataattcgagcactctgggaggccgaggagggcggatcccttgagatcaggagttcgagaccagcctggccagcatggtgaaaccccgtctctactaaaaatacaaaaattagctgggcgtggtggtgggcacctgtaatcccagctacccaggaggctgagacaggagaatcacttgagcctgggaggtggaggttgcagagagcctagatcatgccattgcactccagcctgggcgacagagtgagactctgtctaaaaataaataaataaaatacatgctgctgtgtttaggaagttcaccgtacaccgtgtgggaagcactgcattacaggatgttgctggctaactgctgaggtcctgccattactgggcgaggtcgcagcacatggagaaagggcacctggtttgaatatcagcattgccattgttatttaatattcccaggctatatttttctgtaaaaatgatagtaatagcataaataaatgtatgtgcacacacatacacacgtacacaggtgggcagggagcacccttgagcaggaacagaagcagcagcccttcctttgccatgcctgacaccagctacattcactcgtccacagctccatagctcctgggtgaaggacccgtggctgggaaaggtcatctaggtggcctctgcaagagggcaggtgggcagccgggtcagagcagctcttcatgagactccccaaggctgactgcctccattttgcctctccgctccagccagtgtgagcggaacccctgccccatggacagcaggccctgccgccatctgcccaagaccatctccttccattacctctctctgccttccaacctgaagacgcccatcacgctcttccgcatggccacagcctctgcccccggccgagctgggcccaacagcctgcggtttgggatcgtgggtgggaacagccgcggccactttgtgatgcagcgttcagaccggcagactggggatctgatccttgtgcagaacctggaggggcctcagacgctggaggtggacgtcgacatgtcggaatacctggaccgctccttccaggccaaccacgtgtccaaggtcaccatctttgtatccccctatgacttctgagggtacacaggggcactggggtgtggagagctgacctcatttctcttccccgaaggctcagcttcgggcaccgactgcgtggagcctcccgcctgttcccgccctctcaccagtgcacccaggcttctagggcagcgttgcacggcgccccatggaatagcacggaagagcagccacaaaactcaactgctgccatcactctttttttttttctgctttgaggcccttcccttagattatgcactaactttcttaaaactttttcatccaggggatgggtggctttccaaaatgctgtgcaaatggccttgtgagtttgaactagctggggagagaaaaggtggcaatgtgtgtcaggtgactatcagcccttctgcctttttgtagccaggcttgctatgaatgaaacggttctagtcgtgcggggggccctagtcatgcctctgcgcatgtggcataggaagtggagtctcctcccatgacccagcacgttgttcttatctgccttttcctctgtgacatgcctgcctgcctgccttctcatcagagagtcacaggagggccttaaaccccacgcagatccttctagaccaaggacccattgttaaaagcatggattctgcctgagttacttcccttttgagaaatcatatctcaaatacataacctggtaatataactgaaaaaataaaagtgattgctccttcc

SEQ ID NO: 685 - DNA, 49830 bp, Homo sapiens; identical to SEQ ID NO: 684

SEQ ID NO: 686 - DNA, 174163 bp, Homo sapiens
ggaaggcagaagcaatctctgccgagagagtcagccgagcggccgcgcggagaggaggggcgggcggtccccaggcgggcgggtgcagggcgcagggcgccgacctgctggagagggggcccgggcgcgaggcggagtcccggcgcgcagccaggctggtggaggcccccggcaggctgcagattccctccggctccgggagccgcagcaggaccggccaggaggcgccatggaggggagccccatcccggtgctgacagtgcccaccgcgccctacgaggaccagcggccggccggcggcgggggtctgcggcgacccaccggcctcttcgagggccagcgcaactacctgcccaactttatccagagcgtgctgtcgtccatcgacctgcgcgaccgtcagggctgcaccatggtggtgggcagcgacggcaggtactttagcaggacggccatcgagatcgtggtgcagatggccgcggccaacggggtgagtgtccggatgcccctcgcttcccgccgcgccgccgccatgccctctcctagcccttgtccccctgctgcctccgggcccagttgggaggcccctgcccggccccggctttgctacctcactcccgcgtcctcaccctccagcgccccactcccgccgcgctcgcagcctccccggtgcaccccggacactgggttctattagtacccaccgcccccaaaagccttgaggggtttccgtcgttcctggagccactccgggcgccctggactcttctccgactctgcgcacatcccgcacctgctcatttttctttcggacattctcttacccggccctgtagattccaaggcagctcccagttttccatattgttcccaacgcattcactgcccacagtccccacacaaacttctttcgcaggctcacaacatagtccctctgccccgtgccctttttgcaataatctgccagtcccctaagtcttagctctgcctatttaacagtagtggtgtctcagaacacacacacacacacacacacacacacacacacacacacacacacacacacgatccctgacatatttggcaagagtaggccctgaaggtttttattattttggttctttaacccagtggaattactgaatgatttatttaattagggtagggatggagtggatccatttgtttgatgctaaacagcctgagctcgcagttcccagggggcatatctctaaatggtctgaaatgagatttgcagtggttttcttaatgcaattcccaacttctctccaaatgccttttggcatttgacaacatttcatgcctcttcccctttcggttttcatccttgttttctctcccttctcccacgacctcggtagtcttctgcaatccagattctcagacttcaggtttttctccctctgcccctttcctctctgtcctataactagaagcaccttttggcatagacccatatcccagtttcctctttcccaggtccagcagcatctcaaggacatctacaagagggatacctaatttcaggggtctctgaattatatgtgggaaacatcgtctaaaaaagtaattttatccttattcatgcaaccagacccacactcatagaacttttctttaaggaaagtgtcttgcagatgtataaatgagtgttaacatctttaaaagcgaaactgaacaattccctggcatttgaattccctccttccttcccaaccctctccttttcattttctcatttattattaaaaacatttttaaaggatctccatgcttcatatttatctactataattcctccttctcggtgttgcagggatggggaaagaggatttttttaaaaacataataaaacgcaattgggagaaacagggccagtggtgttggggtgggtagtggaattgtgatttttgactccagtagacaatgatgctggatatatggggtttgatttatctctggctcctcacttgggattgatgaagtttggctagaatcagggagttgaagagaggttgacaaatggtctttcactcttctctgacaggctgttcctgtggagtgatggagaataacgagccttgggagagctatgggagctctcatacttcttcccgagccaattttttagggagtgagagaaacatggcctgtccaatacttgttgtgggtcaggatatttttgaagctacggttgttgatttgcatgggaaaattattatgtcttattatttcttgtcccactttaccataaggactcctcagcttcttacttcaatgggtcttctatgacaaacacactttattaactctaagagtggaatttattttaacagataattagcataggtcaatatatgcttaaaatagggtcaaattaaacctactagctgttataaaggacagatgacaaattaaaatccacatagaagcatcgactcttaaataatctgaaagtactacttctaagaggggtgggcatgggtgaagggaatggtggacatgtttcagaatttcaaacagccaactttaaccaatcttttcctcattttgttcaccttcttgggggcttatgctaaagtgaagtgaatagccataaggctggcttcaggagaaaggtggtctaaaagaactggataattataagcaaaattggtcttgaatgattgaaaattgatgagaatgtgcttgtctcctgatttggcatcctgaattagactcaggaatactgaacttggatcccaaaggctttggtcttttttgatatcctattggatactcataagcaggctagaaaaatagaaaactagaatttattctctttgaactgacaaatctaaccagtgggctgcattctctatatctgaaaaatcttggttttgattgaaaaagttaattttacaaagcaattttctttttttaaattaaatttcattttttttgagactgggtctcactttgttgcccaggctggagtgcaatggcacagtcttggctcactgtagccttgacctccccagattcaggtgatcttcccacctcagcctcctgagtagctggggctataggtgcatgccactatgcacagctgatttttgtgtttttactactcatagggtttctctgtgttgcccagtctagtctcaaactcctgatctcaagagatctgcctgccttggcctcctaaagtgtcatgaaccaccatgcccagcctacaaagcaatgttctaggaaaaactacagttactctttgattatgtaattgctggagaagaaaaacatggcatttctaaaatgatgaactatattacttatattttaatatctcataaagtttgaaatagacatttcaaacataaacatgtataaaaaattttataaattaaaaatataatatcaaaaacataaaattattttattataaaattattatagaatcaaaaacattataaatttaaacaacttttttaaaaatttattttgggatttcccatggagtgatggagaataatgagccttgggagagctatggcagctctcatactccttcctgggccaacttttttaggaaatgggagaaatataccctgttcaatgtttattgtgggtcaggatatttttgaagctatagttgttgatttgcttcaaactttaaaaaatttattataaaattatgggatgtaaaaaaatttattataaaactttgaaattttcaaactttcagaaaagcagagagatgagattaatggcactcataggcaaacatagaacatagattgtaaacattttcctatatttgtgtcatgattattttttgcttgtgtttgaaagtatattaaagaaaatgatattttacccctaaatctttagtacagatttctaaaaaataagaacattttcctgtatagttacgaaatcatcttttcaaacaaaataaaaaatggtttttttatatcatttattacccagtccacattcagatttcctcaattattatgaaatgtccttttattttttgagacaaagtcttgctctttcacacagcctgaagtgcagtgaaacaatcatagctcattgcagcctcaaattcctgggctcaagtgatcttcctgcctcagcttcctgagtagctaggactataggtgcacaccaccatgcccagctaatttattgtttttgtagagatggaggtcttactacgttgcccaggctggtctcaaacacctggcctcaagtgatccttccagcttggtctccctgaaatatcttttgtggctggtttgttcaaattagtttcttctaatcaagggacacacattgcatttgattatttagctcaagactttttttaacctggaaaataccctcactctttgtttatgtatttatttaatgaaattgattgttgaaaaactagtcagttgtcctgcagaatatttccccttctggaattttctggttgctttttatggtgtcatttaacttttcactctgttttttcctggttaactggaagttagttctaaaggcttttaggcctgctataacaaaataccaaaaactggatgacttataaagaacagaaatttatttctcacagttctagagactagcaagtttaagatcaaggagcatgcggttttgatatctggttaggaccaactttctggttcatagattggccttcttgctgggccctcacatagtgggagagactagctagctctctggggcctcttttataagggcactaattccaatcatgagggctctgtccttatgatctaatgaccgcctaaaggccccaccttttaataccagcacctttggggttaggatgtcaacatattaattttgggaagacatacacgttcagcccattgcaaggtttagttagattcaggttcaacttctttttttaaagactatttcataggcaataatgtgtattcacatcccatcattagtgatggtgagatgatcgcaaggttagggcgatcactgcctatctcctctgttatattcccccttgggtcaagccagtagtctgtgacgtgaactttgtaccatgtgtatattcagttatattctgtatcaatatttacttgattgttttagcatttattaatgatccttgcttgagttgattatttcattaggggtttcaaaatggtgaatttctaattctctaattctatatacatgttttagctggcatttttctataagcagaccattttcttcacaactgggttatttggctaccctgaaacatagttccttccgggaaggcagaacatatgtttatttctgtcttttaaaaattactggtgtttggagtgaagatttggtgagttaactacctccacaggtgacaaatgaattttgttttgtctcacttttgcttttttgaatatcactgtggatgcttggatttttatatttaatttgaatggattagggaataaatgagaagataggttttatctgtttctgtagtttttatgtggctgtgtgaacttacatttaaaaattcccagaaatattttaattcccctttaaagatataaactatgtcatactataaagcaaaagaaaaaccaatcatgtgaagagtaaatagtatctttaaacgaattgtggttaagcttagtttgtaactaattagttttttattttctttctacttttatctgcttcagagcctcttcagtggtttagatcttctatgtgtcaaattattctaatctcttaaaaagtttaagagctaaaatacaacacaatgactacaggaatgcctttgtccttttctgggtgggtacacctaaggcaatttctttttctcttctttgttctctgcttctttcttattcttaaatcatcttcaatattggacagatgtcagcactgtgcctgcctcaagatgtttctgactttttctttttctttttttttttttttttttttgagatggagtcttgctctgtcacccaggctagagtgcagtggcacaatcttggctcactagaacttccgcctcctgggttccagtgattctcccaactcagcctcctgagtagctggggttacaggcatgcaccaccacgcctagctaattttttgtatttttactagagacggggtttcaccatgtcggccaggctggtcttgaactcctgacctcaagggatctgcctgccttggcctcccaaagtgctgggattacacgtgtgagccactgcgcccggccgtttctgactttttctaaagtcttctttctctggagatgacattatataatagcactgttcaatagaagtttctttgatgatggaactgttctgtaatctgcattgtcccagccactagccatatgtgactactgaacacttgaaatgtggctagagcaactgaagaactgaattttgcattttacttaattttaattaattaaaatagaaatgcaaataaccataagtggttagtagctaccatactggacagcaaagacctataattcagcatttaaaatcgattttgttttgttttcaaaaatggagtcagactgttacaacccaaaagaactgtaggttaaattaaggtaaatcaccaaatactacatacacatttgggaaatccaaaccagattttttcatgtgataaccacaccctcttttgactttagccttggaggtaatggagtatggcagaaaaaaccctgtatcagcagctggaagactcaccttcttttcctagctctgccatatattgaccaaaagagtcaaagtccattcagatggttgaggggccttggaattttgtttttggttttcacatacaagttggagggcagatgcgttagcctcttgaaatacccagaaaccacttgtttcctcatctaaaaatcaggtatgacaggatcatttaattatcctggaaatcagatgaagcactgcatatgaaagcactttgtaacatcgatagcactgggaaatgtaaagaccttttactgaaatataaaggtgtatggtcaactgaatatatctcagataattatgatttgactgtatgtattgaatataacctgtagtgggccccttggtaaacaacttacagttttgttgcaagttttagccaagagaaaatgtatttgttgactagtcatgccctttattggccacatgatgagcagcaatgatattaacacacagtgcaccttgcagaattcaagaatgtctcagtgtcttgtgaactaggaagctgaaatgcagtggtatgcagaaggctggctcagtaggagccttgggagtgtcctccagatagatgtttgtgcaggttgtatttgattccagttggccatgaaaagctggttgctctaaagaatgagaatatacttggttttgcatttactagaactatctggggaacaaattcttggggtggaagaaagaagggagggagagaaagctgtgcttcaatacctagggcttctttcctggaatggatctgagaatctgggattgggtggctaatatctcatctctagaagggagaaagaactgggtggtgatggctttgtattttctactggagttcactacagaataggtgaatggaatgggctgctatgatccagacattagggaggacaggtttgtgatacattagaagacttgaatgagcccttctatgattctctcttccctctttctgcttccctttctgaatccccatccccaggttgtggaattagcaaatctattatgtgagcaatagcaaacttacaggagcccttggctccatctatctccctgtttgtgtcagttcattctggatgcttttagtctgtggtcttcattcactctttttatggggaagtaaaaggagtgggacagattatgagaacagctgggtcctcccagttgctggggtggttattttaagctttgtttaatgtgtccagagacccagatggcatttttaactaagctgctttattaaatcttgtgataaagcatagtgatgtttattgaaaaggcagacacacatcagcaacattatgcgtgaaacttgccctaagaattttctataaaacatctgttctctttgagccttttgtgaactctggaagtttgctagtttctatacagacttgaggacaagaagttggaacccacttttggagatgtccaagcataggtattggaatcattaatcctaaccctctcagttttaaggccccggatacccttctgttagacaacagtaacatgagcaagcactgtaataacatttaaacaagattatttggaaataatggacaagaaaaattagtataaattgtttggggattttaaaattaaagataaaaagctagggcttcaatgacctgtgccagcctatagccttaagagtcaatttgcaaacactcaagatttggccaatatgcctctactacttctacttaacacagtcaaagggaaatttttagattctttcatctgatttgactctcttagttatgaataagaggatatctagaatatatatgtgacttgttaaaatgaaaatccaccttctctgagtcttcaaatatcttacatatcttacatttttagtaacatcaacttttgaagtcatgtccgtagttgtatgaaaagaaaaatttcaggaacattcaacctcaaaagttctttttcttagtctgaagtcgtagaagcatttgacttttactttctctttttaagtttgtactagtaggtattttgtataaatataatatttaattattgcctttgtattctttttctctagtaaacatcctggtttttagctatcaatatgtagttttacatttagggatttctaatggaaagagaaaggaatctgaaatcagaggacaagagtttattctacttgaccaaacacatacgaaatactggaaggagagttttacaacaaatatttaatatctatgacatgtaaaaaggttttccaaatcaagaaaattcaaacaattcaatacaaatatcatcaataataacacatgaacaggtggccaaccttattaataaccagagaaatataaattaaaacaatccatcaacttgtaaaaaagatgaaattacccagagttggtgtaggtgatggaaaattgtcatgtttgtatactgttcatagaagttaaattgacataactttttggtcaggcaatttggaagtatatatctaaattaatagagtagttttctaataacctgggaatctcttaatctaagaatctttactgtagatttttctagaacaaatgtacaaacatctatgtacaagggtactcactgcagcattttgctaaggaaaaactcagaaaaaatctatatgttcaacagagaacaggtacataatttatgacacaactgcacaatatacaccactaaaataaaggatataaatttatatgtagtatgaaaaagatgtgaatgatagcttgttggtgaaaaacagcaatgactggaatattgtgtgtaacgtaatcctgcttttctgtatataatgtaggcatagaaaataggattgaaaggacatactctagtcaacagtggatatagcttgggtggagggggtgtataatggggaaggagagtcccttttcctatctattccatatacatctctggatttaaaagatcatacatgcatatgcattaccttcaaaattaaaatgataaagacaaaaggagaagctttggatttgaatcatgatactactgtttgcaacttatatgaccatggggaagtcgcctagcctcctagggtttatttcctcatttataaaaatagggaaagtaataatacttgtctacatatcttctagggttgttgggaggattgaatgtgataatgggttacagcattatgaattatttattcatataacacaattattataaaaatattttgctctgattaaaataaaagaaggacgagatcatgtgtgtttttgtcccagtagctttactaaccagaaagcgcctgctgatgtggtgatcacagttgctttggtgcagcttcctcttgacttttggcatttctccatgctgctagctaaggctgaggtggcgactgttgaaggtgtgagcttctccccctcccggcacacatttgtatgcgtactcacactcatgcacacacaaacacacacatgcacactctatcacagtacatgaggtggcagcagctgctccggcatagactttcacacaacataaaggacttttttggtgtggtctgtgcattatttcctgttaagcgtgagctgagtcagtgccctgcttttccatctgaaacctttctgaggctcaggctgtgttaagagcaaaccctctccccttcatgcccaccccatggccctctactgaagccagatcttaatctgctcatttcatgaggattttcaaatcgaatggactgggccatgtgagagattactgaaaggaacagaccaagcaggggctaagagactccacgctaatctgctgagtcgtctgaaaatgcacagctgtgggagctcacggtgctttaaagtactttggcaggatgtttgttcagggggcctgttcctgcatccctgctgaatgtttggttaggaggcataatctttttttggacaggatctcccaaatgtaaagtgatagatgctaatgtggaatataatacagaagatccagcttggatgtcataaataacaataaattgtttaatcttgctgagctgtaaatctatgattgccagaggtctttagttcactggaacatagtatgggggcaggggcacttagcaaataggcagttattattttccaaccagacagaaactggtctgatggaatttatctaaaaaggcatacacatgtattttaattaattgtgacaattactcagagaaaacacatggccctaaagaggctgaggggtttttttgttctacctataaatgtatatgtatattcacctatattctacctatgtataagtaagagaatgagtttttgttttggggatatatatttatacgtatctatacagatagatatacacatacttaatttctgtctacctattaaggtgcagtgccagatggaaagtatttttaagcatttagatagtttattctatagcatatgtgtgcatatagcccccccataaagctttgtctcttttctggatatatttaacaagaggctagaacagagtccaaaatgtcagaaatgtttgaacattccatagaaatgaaggaggtgtttccaaatgacctatgtttctatggcaataaatagaacttgtgctgcgttggatgggtcaggagtaaggaatataaacagtgtaagtatgactattccaggcagaaatctaccttgtaagaacagctttgtgcagtgagctcaacaacattgatcagttagcagtccggttcagtacaacattgatcaggtagcaagccggttcggcagtgccagtcggagacacagatggggacaatcaaagaagatgcaggtcaggacaaggatgcagacatgtacctgtcactaccatggacttcagcagcttcttagtgagcaggtttatgattaaagaagaaagacatcgttgatatgtaagcatgttacaattaatttgctgtttagttattagcaaactacatccagtttttagtttttaggttttttttttcttttttcttttttgaaacaggttcttgttctgtcatccaggctggagtgcagtcgttatccaagctcaccacagccttaaactcctgggctcagtggatcctcccacctcagcttcccaagaagctgggactacaggtgcacgccaccatggccagctaatttttcttatttttttgtagagatgaggtcttgctgtattgcccaggctgctcttgagctcctggcttcaagccatcctcctgtcttggtttcccaaagtgctgggactataggtgtgactcaccatgcctggcctacatccagtttaatttatactacagtgtgggtttagtcctcaaacatgtttttgttttacatataaaaatttgaggtaaaagaacatttttacattggtcaataatggtacatttaaacaatggacgactatatccattaaaatcatgttgtggaagaatattcagtgacatggaaagattgactcaagggcaagtgaaacgtgtcaagagtctgttaggtactagacactgtaaactgggtcttggctgtgctacttgcttacatcctccatcatgtgatcttttagataacaaaatcgagatacatagggatttgggatcttgcgcaaagtcacccaggcagtaggtggcaaagtcaattcttacattctttcccatcgaacaccaaaatctcagcttacctcagggcactcaactctgctttcttgacccacacccaggtagacccaatggacacttgtagctcttatccagctggggtggtcacctcataaaatggcaacaagtggagccctttcttgttctagtgagtcagactgtataccttaaagatttcagagcacttcctatgtactgaaatagcctcattaccaggaaggacatacttccaattttcaccacctccattttgcatccaaggaagattagatttcttgatcttctcaatgaaatcttgagaaatgggtgggccgattgaagaacaagacttgggccacacttctagatgcctgtgacttttcggcacttattcagatattaggaattgattatgaaatccatggtggtttgatgctcatgaactctcatccatctctccagcatgtgtgtaaagacttccagaggtacaggacgttgaggatgagctctcttacttccatctggtctccatgtaacaaatcatataactgcacaattatccaaatgcaaatgaaggagtcccttgatgtttggataaccacattcatgccttgagtttgttatttcttgaaattgcccttatccgtcacctgtttacccatggacaacactacttaaggactggcattctgcaacccatggcagcttggctttggggttccttccagtgttttgtttttgtttttaaccgagaagacaggaaacaggcatctttgtgtatatggcttgccacagcccttcgtagatggacatggtggaggctgtatggtcctggagaacacttcctctgtgtagcatcagggaagtttctgttcattgtgtcttcactctctccaattcacttggggagtgatagggattataacacagtgagcagaggatattggggaatgtcatgcttaattttcttttctttttttttcttaaatgacatttaaagctaaaagagaatcacaaagggtaagtctgatttaagacatttcacacatgaaagaaatcctgctttcatgcgtgttatgtcacaggaaaaactcatttagagtcaacattctgcacctactccgaaattttagcctgagggtttaaatattacctcgctgctctctaggactttaatttgagctaattagaaatggaactcatactaaaactagtttaggaaagaagctgttgatgttctgaagaaaaacagctgtcagaaataagatcattaaaaaaccatagttgtatatggcacaaaatgtaaaggaatagaaatgctgggagaaagcttttatagaatgacattttatctttctttggacactggtctaaggcatgtgaaagggcatattgattcccttggcacctggtatgctcatttatggatgaaaaagcccaatgacataatttaggtgaggtttaaggcttgatgggaggcattggtgccattagaaggacggacacaaagagttcttaagtaacggcatcatgggaaatgataattgcacactcctttctactatgtcttggtttccccaagcatttagaagtcatggctaggtaggaacaaatttatcatgagtctgtctgtgtgtttgggaatgcatatgcctcacagatgtgtctgcaggggtctgtgtgataatgttcatatatgtgatagatgtggaccctgggatctgtatctgtgtggaccctgggatctgtacatgtgtgtgagtgacagtggactagggtccactttgcccccttttccgcgtgggagttgaaggaaatgccccttaatggcagtagcatccacttgggtgtgtgcaccttctggaggactgggtgaggttgcccttcttccagccaaacccagaccctatggtgtgggacgttcagcggggagcaacagaatgccatggcttggtcctccctgggctgtggcctggatttcactcaggaatgaaagtcagatattgcctgcttcaatgctgtaaacataactaaggataattatgtaagtagaccatcttttccttgcaaggtagcggtctgctgcattgacagagggtagtatttctaggactttttcagagagtaaaatggtactttaagggataatctgctatctaaagatgaattttaaatgttggagggggttgtgggatttggggaagacaatagaataatttgtgtcatggttaatttaacaaagagtttttgtttatagaatctgatcttcggtggattttaacaaccctcttctttcttggcttttcagataaagatgcagagcctcagagaagttaaatgattgatcctatgtcaggggatagtcaagactcatacctatgccttttaacttcaagttgagtgctttttctttatacaaaagggctttcaaaagttatatttctttttatcaatgactagatcttgaaagccataccttttctgatggcatttatcctgagctaattggtagagagagggtgaacagaagagaagacatagacacgcagagaagaagacgtgaaaacagaggcagagactggagtgatgtgaacacaagctcggaaatatgtggaggcaacagaaactggaagaggcaagggaggatcctcccctagagcctttcgatgaggcagaccctcactgacaccttgattttgaacttctggcctccagaactgtaagggaataaattttaattgcttttagccaccaggtttatggcaatttgttatagcagccttgtgaagctaatacaaactttgtattagattacaaactttgtattcatttcctaggactcccataacaaattaccacatatttggtggtttaaaatcacagaaatttattctctcacagttctggaggccagaagtcaaaatcaaggtatcggcatggccacactctgtagatgctctagggagaatctgctcccgcctcttccagcttctggcagcagaatacattccttggcttcccgggtgtggctgcatcactccaatctttgcatctgtcttcatatctcctcttctttgtgtctattctagtaaggacaaagtgctgcatcttccgtgatggaagtggcccaaattaaccaatctaccaccacgtagctggctgatcatttggggaatggtaccataaggagactcagtgttggcccctgctgctggtagagtaggcactctgcagtggccatagccaggtcagccttggtgagtgaatgtccatgttgttgagcccatgcatagccttcacccctgccatcacggccatggtattacagcattcttgcattgctataaagaaatacctgaggctgggtaatttacaaagaaaagaagtttccttagctcatggttctgaaggctgtacaagcctggtgccagcatctccttggcttctggtgaggcctcaggagcttttacacatggcggatgacaaagtgggagcaggcatatcacacagcaagagtgggagcaagagaacaaaagagaaggtgccacatacttttaaacaagcagatctcatgtaaactcagagcgagaacacacttatcgtcaagggcatggtgctagaccattcatgagggactcgcccccatgatccaaacacctctcactgggccccaccgctaacactgaggattacatttcaatatgagatttggaggagacaaacatctaaaccatatcagccacttggctcatgagcccattggacaatgacaggaatggctgggggaaagccactcattgacatccacagaactggtcatcctattattaaaatcctcctctgcctaggtcaccattttgtgagtgtccataagggacacacatatcttcacaattttccatgtcttaccttagaagccccatcaccctctctttcacatctcctccagtacttatcccccagatgataggaccatgtccagcaatacctcttctctctggtattgatgggttaatgagcagatctcacataggtaaaatttccagatatctagaatttaatcttctggtaattctccaattataactaaagtatttcaggttgaaactttattcaagtgtaattactcactttaaccttcttaaacagaatgtatattaccttttcaaaaataactgaaatttaataagataaaaatgtatctataattgttcctacttaataactttacatgtttatttctgcatttttctaagtccttgccccaaagtggacataattttatactgtaatagcataaaataattttgcatttgacatttttgatttggcattaaactgtcgtttatgtttctttcgctactgcttaagaaaatgtgggtggttgtaataaataaacctgaaatgtaggcaatttttattgccttaaaaacaatagaatgttatttctcactcacaccatagtccaatgaggatgtccctggtgggcaaagactcttgtctaccaaatgggatggggacccagtttccttccctcttgtgactctggcattgcctagagccacatgattacctgtactgaatctgtagaaagagaaataagcagtgtagagatgatatgtttgttttctgatatcctcagcctagaagaaacacacattacttctgttctcattctcatactagtttatcacccattgtccaaatgcaccatgtggccacacctagatgcaagggtgggttggaaaatgtagcccctggctgggcagctgttcctcagcattgactctgtgctatggaagggcttcctaagtttttgtggactgctatcccagtctgtcaccactatacaatcttcataattttccctttaaatggctgagagaaaattttgaacaaaagctacaaacatttttcagattcttgattctccagacttattacttgagggcagtgactaaattatattcagttctatatcagaaggttcttccatattgccagtttcatggtagatactcaataaaataagttgaatgactacataaattttagcaagagcatatggaaaataatttatcatgactttgggtaatactataggtgtaattattgtcctttctctttcctgacttgattaatagcaccactatccattaagttattaaaggtagaaagctgagattattcttgactccttttctcactggtccagtattagttatttattgcagtgtaagaaattaccatgaaacttagtggcttagttggggcttgatgggggctggaggatccactgcaagatggctcagtcacttggctggcaaggtggtgctggctgttagcctcccatctgatcctcctctttccgctcctgccactcttcaaggtattttttccagagcagccgttcatcattcatttattttttcccattaattaattcaacagatatttattgtatacttaccatatgccagatttgttctaggttcttggaatatagcagtgaaaaagaaaacagtccttggatcttatatacagtggggaaataaacatataatgtagaaaattagatggtaatatgtgtgagcacatatatttattatttctcatcatttctatgagacaggagatgggtattctggcttggggactcacatgaggtcacagttacatgttggtattggtttggtcatatgaagtcttggtgggggctggaggatccactgtgagatggctcagtcccttggctggaaagttggtgctggctgttgttggcaggccttgctccctcttcacagggcttcttgagtgtcttcatgacatggcggctggtctctcccaaaataagctgtccaagagagcaggggagaagtgtccatgccatttatggcctcaccatggaagtcacacacaatcacttctgcaatatatactgattacccagatctgcatcgttcagtgtgggaggggaccacaaaaaggcaaaaatgccaaaaggcaaggacgattggggccattttggaggctatttaccacagcccctctcttcaatattccagtccacctgcatattctgttcatcctccttccaaaaatgtatctcaaaccaaatgactaattttcatttctgttggctttagcctagtccaagactctatcaacactcgactcgaagagtctcccatctgatattcctctttctgctcttgccccccttcaaggtatttctcccagagaatccattcatcatactttcattattctccattcattaattcaacaaatatttattgtacgcttaccacatgccagatttattttaagttcttgggatatagcagtgaaaaaaagtccttgggctttacatacagtgggaaaataaataatatggaaaatgttaaaggcaatatatgtgatccagaaaattatagcagggtgaaggaaataggaaacaatagaaaagttagggacttctggccatagtattatatagggctgtcaagggtgctatctctgattagcttacattgaaacagaaacccaaaagacagtagagggcaggtatgttaatatctgggcaagtattctaagcagaggaaaaagaaaatgcaagggccctgaggccggatcatgtttggtatgtttgaggaatagctgttctgttccgttgtggctggaacagaagaaggagggcgggagggcgatggagaatggtacatgatggaggtcagattatgtagggccttgtagactacaatgaagactttggctttgttttgggttggtgagggacaaggaaagctattggaatgttttagtgacttgatgtgacttactttttaataggaccatttgggctgctcagcccatgatgtttaaaaatgcaatcaggtcacttccactgtttaaaacctttcaatggattctggttgtacttagaataaaatctaagctcccttagctattattattatattattattaaaattgacatcctttattctctattatagcagtctaattccttcctaatatgtacctcactagtaactattattattattgcttatttgtttataatctgtctcctctgcttgaaaatatgtagcctggggatcttgtggatttccatactaaatcatcccaaggccactttgcttttgagctgtgtgtgtgtgtgtgtgtgtgtgtgtgtgtgtgtgtgtgtgtgtgtgttttgatctcttctgtatctttttttcccctgatctcgctgattgttatatttggtcagtgacggacctctagcaatgatggtgccagggcaactttgttgttgaactgtatgttaaagtttgttttggcttgtcggttatatcagtacttatcaaatgaattatctgggaagagaggagaggatcttattaaaatacaggttcttattcggtaggccttgggtgggccttgaggttctgcatttctttctttctttctttctttctttctttctttctttctttctttctttctttctttctttctttctctttctttctttctttctctttctttcttttttctttctctttctttctttttttctttctttctctctctttctttctttctttttctttcttctttctttctttccctcagacagagtctcactctgtagcccaggctggagtgcagtggcgccatcttagctcactgcaacctctgcctcccaggttcaagcaattctcccacctcagcccccggagtagctgggactacaggcgtgcaccaccatgctcagctaatttttgtatttttagtagaaatagggtttcaccactttggccaggctggtctcgaactctggacctcaagtgatctgcccacctcagcctcccaaagtgctgggatttcaggtggagccaccacgcccagctgaggttctgcatttctatcaagcttgcaggtgatgcccatgttgccagccctttgagtaacaagggggctttattactgagcttggctgaacattggaatcatctgtggagctttaaaactactaatgctgggctctcaaccccagagattgcaatataatcagtctagaatacagtttgagtactagggttttaaaaagcttcgtaagtgattctattttgtagaaatattgagaactactagattggatgatattgaatccaattttaaaacaaggtgtagcaataaatgttcttcagcgctgtgttgctgactttttagaaagtcagttttgtagctctggaaagaatctggctgcatccatgaatgacctccagatctctgcttagcatgactgggtaatttctccaatgtctccagcacatgctgtcacttaacagcagaaagagaattcctactttcaggagaaaagtcattcctgaagattacagttaaaatatgcccacaggtgatgaggttgtactaaatcagtccccttgctctctgagcttgttctaagttacaggaagcagaagaagcagagaagcactccatttcttttttcttgtaatctctagcatgtccacatgcatagtttctgagtcagtagcaaactaagaacttcttgtgtgattcaagctaacccctcgattatcagaagcagatgtttcaaactactgaagatcaatgaggcatatcctatttacaggttaataattgactactagatgcaggtgcaccaaatggtcttagagacattagataggagagacaatgtcagtgctccccctaccctgcctcccctaatctaaagcctactctgtttcttttatcaagttattggctgtatgttaacagagcctggggcactttcctgttgaaatggctttaatcccaaggaactggattgatttttttttttggatggtttagattggacgactgattattggacagaatggcatcttgtcgacacctgcggtctcctgcattatcaggaagatcaaggcagctggtggaatcattctaacagccagccactgccctggaggaccagggggagagtttggagtgaagtttaatgttgccaatggaggtatgtggttcagcatatgccttaataattacgatttctttcctcttatattattatagtctcacagtgactctttgatgatagacaagcaaggtgcagaggacctagctcagaaaaattcagtgaggtgcccaaagagatccaacaaagaagtggcatgatgggctcatgaacccatttgggtggtctcttggtcccctgtactcttcagcataaactattgaatagttgatgcttatctgatatggaaggactctgaattttaacattaaaacataccctgaaggtcgttgtctaaatgaaaatgaccctcattttacacatgaacaaatcaaaggcctgagaggctgagttactgctgaaggccacagggttgatcagggtcagattaatgatttttagcccaaatcctggcctctctttttcctacagtgttgactttctctcaaaatcatagaattgtttcactttttcttatattcacagcaatctatagtttgggggtccttagtggagggggtgggatatatgtatggagtaaatttcttttaaaattgaacacacaaaaaaatagggagaataagaaatagataacatgtacccattatcttgtttttctattttgcttatctttttttctgaagaattttaaagcaaattatagcacgagaacatttcacacccaaatatttttgtatgcatctctaaaaaagaaagacacattgctgcatgactgtgctaacatacctaacaataataacattaattctccaatatcacctgaaaactaatctatagtcaaatttttcaataatccccaaaatattattatttatagctgttttattcaaatcaggatacatctaaggatgccatgcatttgcttggcaagtctcttaaatctcttttaatctagaacactgagtttgcatgaatgtgggtaggagccaaattttaaccagcaacagttaccattataaattattcctcatcccaggcaaagcagtgcagtctgaagggaaaacttattatctatccctccttgcagacgttttacacgttatccaaacaagaaagtgtattcatgttgaatatttaaaaaacaatattgtaaccacaaagcagaaaactaaaccaccaaactacaaaggtagacaacaatagaggaagaagagaacaaattatctacaaagtaaccagaaaacaattagcaaaatggcaggagtaagtcttttactatcaataataaccttgctggtacatgggttaaactctccaatcaaaagatacagaatggctgagtggatcaacaacaagatccaactagatgctgcctacaagagacccatttttaaactttaagaataggcatatattgaaagtaaagggatagaaggagatatgccatgaaaacagttaccaaaagagagcagggatgcctatacttatatcagataaaacagacttccagtaaaaagctgttccaagagacaaagaaggtcatgatttaatgataaagaggtcatcttatcaagaggacataacaattgtaaacatatatgcatccaacattgaagcacttaaatatgtaaagcaaatattagtggacatgaaggaagaaatatacagcaatataacactaataggggacttcagtactccacttgcaacaatggagagatcaaccagacaaaaaattaacaagacaacactaaatttgaactatacttcagaccaaatggacctaccaaacctacattcatccaacaacagcagaatatacattcttctctagcatacatagaacattctccaggatagaccatatgttaggccacaaaataaaccttaacaaattcaaaaagattgaaatcatgtctagtattgtttccaaccacaatggtgtgaagctaaaaatcaataacaagaggaatcttggaaaatttacaaatatgtggaaattaaacaacatgcttatgatgaactaatgggtcaaagaagaaatcaacagggaaattaaaaaatactttgagattaatgacaatggaaacacaatgtatcaaaacctacagtatgcggcaaagtcagttctaagagagaagtttatagcaataaatgcctacattaaaaaaggaaaaagatctaaataagtagactaacattatgccccaaggagctaaagaaagaacaaactaaacccaaagtgagcaaaaggaaggaaataatgaagatcagaacagaagcaaataaaatgtagtatagaaaaactatagaaaatataaataaaatcaaaagttggttctttgaaaaaataaaatctacaaactcttagctagattcactaaaaaaagcagactcaaataaataaaatcagaaatgaaagtggagacattgcaatagatacctcagaaataaaaatggtcataagggattattatgaacaattttatgccaacaaattggaggacctagaagaaatggataaatttctagaaaaactaacccaacaagattgaattgggaagaaacaaaaagtttgaacactccaacaacaaataaagaaattgaagaagtgattaaaaactttccaaaatagaaaagcctaggaccaaacggcttcatggctgaattttatcaaacattcaaagaataattattaccaacacttcttagactcttccaaaaattagagctacagggaatacttccaaacacattttgttaggccagcatcaccttgatacctaaagccagacaaacatattgtaagaaaataaaaccacaggccaatatctctgataaatattgacgaaaaccaaattcaacaacacattaaagaaattatgaatcatggccaagtgggatttatccctgacatgcaagactggctaaacagaatgaaagataaaaaccacatgatcatctcaactggtgcaggaaaggcattttagaaagttcagcattctttcttaacaaaaactcttaacactttaggtatagaaggaaagtttctcaacataataaaggtcgtttataagaaacccacagctaacatcataatcaattggggacaactgaaaacttttccacaatttagtacatggcagggatgcccactcttgctatttctattcaacatagttttggaagtactagcaagagcaatcagacaagaaaaataaataaaagtcatccaaattggaaaggagaaagtaaaataatctctatttacagatgatatgatcctatatatagagaattctaaagattctacacatgcacacacacacacacacacaaacacacacacaaatttttagaactaataaatgaattcagtaaattgcaggatacaaaatcaacatacaaacatcagtagcatttctatacataaataatgacccagctgaaaataatcaagaaaacaatgccatttatgatagcatcaaaaaaatacttaggaataaatttaaccaaggggtgaaagtatactgaaaactataaaacattgattgaataagacacaaataaatagatatcctgtgctcactgatcatggatcaaaaacattaatattattaaaacattcatactaccaaaaacaatatacagatttaacacaacccctatcaaaatttcaataacattcttcatggaaatagaaaagcaatactaaaatttgtttggagcccccaaaaaccaaagcaatgttgaggaaaaaaaagttggaggtaccacacttgctgatttaaaattatattacaaagctaaagtaaaaccaaaacagtatgatactggcataaaaacagaaacatagaccaagggaacagaatagagagcccagaaataaatcaaggcatatatagtcaagtaattttggaccagggcaccaagaggacataatggagaaagaaaaaaacctcttcaataaatggtgcctgggaaaacaaaaatgtaaaagaatgaaattggacccttatcttacactatacacagaaataaaatgaataaagaactaaatataagatctgaaaccataaaaatcctagaagagaacatagggaaaaagttatttgacattggccttggcaatgatttcttggatatcacatcaaaagctcaggctacaaaagcaaaaacaaataaatgggactacctcaaactaaaaagctttttagcttttccatttttcatttatttattttatgcactttaaaatctctgggtattcttttttagcatcttaaaatttatttttatatgagtgcctgtagatttgccgtatcctttaaaaaacaattattttaatatatattataattgtacatatttttggtgtgcatatggtgaaagtcattggagtggaagatatcagggagcttggaaattgaaaaggaattcagaagttgttgatgaactctgaagttatcagcatggatggttgaatggcatcatagacaactatctagagagacagtactttctttacttttggaaatcagtgtgctttggcattaaaactcagggacttgaaaatgatggacacagccaaagaatatagtatggtgcctggggtgtagggagtggagggagatattcatgcattctataatctggcaagcataaaataatgcaaaaacgaaacaagactacctattctttaagttttgtgaagggtaaaaaatggtaaggagtgaagaaaagggctatgtttatttctttgaggacttcacttttcccacacaacaagaaaattgttggtaaaatcttctgggctgtcttctctcccacttactagaataggactattgctattcttttttatgagcatgtattggaatacggtgatggtgctacactctaaggcagcgttgtccaacagaaaaatattgtgagtcacatacatactttacatttttagtagccacattaaaaaagtgaaaagaaacaagtgaaattcacattgtgttttatttaaactactatatctaaaatattattataccatgtcatcaatataaaaattattaatgcaatcgattgcattttctactaactcttcaaaatttggtgtgcatttacaattgcagcacacctcaacttgactagccacattttaagtgctcaacagctaaatgtgacaagtaactattgtattggacaatgcagttctaaggattgagatattttaaaaatcaagaaacaatttttgttcagtagaaagttacagtatagttgacaagtaagattcatacagaaagctatctatacatctagcgatcatttatactttagatctttcaatctacttatttgtttctcaaccttgttgcaaaaaaaaaaaaaatctgaaatggcttgcattaagatatacaaggtaaaaaaaaaaaaaaaaaaaaagcaaaaccccaaaaggtgaacaagtattgatttcatgttcaatttatttaaagtctaatactacttgtcaatttggtcttccgaggaaatgcatcacatatttttagttgagcttcattttggaagtgactagagattgtgagttggggaaaataattaacttaccctgctaagctcacacatcaattaggtagcagagctgggaatagaaagcatagtctcctcttctagatgcactggggaagctgcatgtaaatctggaatccctcacttctgtcaaatgcatatcctgtttgtgtctcataacctgaataaagctgattacgtaaccaggtttccctggcaggtgtgaaactatttttaggaaagatgtgtcattgcttagaagtggattaaaacaaacaaacaaacatatgggttgttagtctacatagaacaggtgaggctgatcaaatttcccccatagtggatgagtacagtataagaaatatcaaggctaattgaactgtgaaccattgatcattgtttagagaacaaatgaatctttttctgcctggtggaggaggatggtaacatttcactgcttgaaactcacgagactttcaaaaacatgtatttttggtgttcacattttaggtcctgcacccgatgttgtctcagacaaaatctaccaaatcagcaaaacgattgaggaatatgctatatgtcctgatctccgaatcgacctatctcgactaggaagacaagaatttgacctagaaaacaaattcaaaccattcagaggtaacagagattttattttgaagaagtcagagtaactatgtggatggggctgactggtttctgtagggaagtaaactcatgaaaattattgcattgttaatctcaggggtgactcgataaatgtgtgtaaacttaatatggtgtagagagaagacatgagagcagccaagatattcagaactggaaactttcaaaaaccacttcccaaactcgatatcattttcaacataggaaaagttttatggttgacttcattatagcattccaaaaataggctgtgaattgccaaaacttgtctaagcaattaaggtgaagatgctggaatgccttagttaagaagaaacctaacaagtcaatgggttattaaatttctcatgaaaggtaggagtttcttttccaagccataaccaagcttggaataattatgcatcagcttattgaatgcataattattgatcacctgccctataccaagcaccgtgttaggagattttacaaaggaattcagtaactatcaaatatatttaggcaagtgattcaaaaattaaagaaccaaaatgagattgtcaaaaatattatcttatattgtaaagcaaatataacttctacagtattcagaagatagctttttgttttatagattaattttagaccatatgacaacaacattaataacatgtatgtatacattttccccctgtattttatcatattgctttttcctagaaggcatagaatagcaatagatctaacatgttttacttttttagtgcttctataagcttgaatgcagtttgtgttaagatggtatcctcattttagaagtaatttaacttagcccaaaagaggaaatacctggtttgtgtccatgtgatattttagggatagagaaaagattaaaatggattgtgtggggggtcacagtatttgcccaatgttaccaaatctttcttgagaagttttgagtcagttgtttgcttaggtaatgagcagaaatttacagagagccatgatactcactggaagcaacagtgcctgcttttgctaatctagctgggagaatgcataggcatatgtgtgcacatgcatgggatggctggacaattaaaggcaaggggtacattatattaagcaaaatgatttcaatatgctgattacatatggttggaaggactaggcttatttttggcatcttcacaatttttatagttgtccgagagacccgaatcttcgtgggctctcattcaggctcattgctgcagccacattgctagttgaatgagttttctaaaaatgttactgataccaggagataggtagagagattccctggcttccaagaatttggagataatcgtttgggataatttatgtgctgtattcttgctggttcaagtgttgagcaaagcttgagttaattaggaacaaataattcctttgcatttcactttaaagtgtcaagagcatgaactatatgatgtgaactttcaatttttactgacttcttgttccctcgtttttcacatttgtttggtactgtgtgttacctattgtaaataccaaatgtatttaggcaagtggttcaagaattgaagagccagaatgaaattgtcaaaaacattatcctataatgtagagtgagtaaaacttccaaagtactcagggcataaccttttgtcttacagattaatttttttatggtggtaaaatatacataacaaaatttaccattttaaccattgttaggtgtacactttatacaggttaatttttaattacttcatagattattatgctcctcatgtaaaaagataatttaaaagtatccatgttacaaatataattatatttgaatgaacacataaattacattgacttaagtgtaagaaaaaatatttttagatatgtatttgatcagatgaaggaataatattatatggcatattaagatctcatccattaaatatcacacctggatttactaaaaattattgaaagtgggttggtaatatcttcagtgcaagtttaaaagtatttcagggtttcaaagtagtatgtatttgaaaaatctgaaaacaatatacgtaagtttcaaaatttagctatgaatttaaaaaagcagggctcctggacaaattttagcacctaaagaattgatttactacttcttggaaaagtactttctgagcattaattatacactgattgacaagtatgaaaaatgtattctgagctttttggtatgtcacataaatgaataaaactttttggattattggttactgggtggtgctagatactggaaagcatttgtgtttaatgagaacttctagatatttgccattcatttggaaattgggtgctagattgggcatgaatgagatttcacgcaaacccaggaatatattcatcaccaattctgcactcgaatctggtaggcacaatggcttttggaaaataggggtcactactgaggtcacttgctgatttgtttcataccagctgagtcagtctttggccagcccccacaagaaaggcaactggatatgccaaaatgcctctaaacattgagatgtgtgctgtgtgcatttttttgggagggaaagtgggagcaggagtaacagggcacatttttatcttaatttattcttgtggttgatattttccttgcaaagaagaatttataacttggtatcatttatacccattgagcacctgaaaagcttgtagtatcttgattgtgccctgatttgtgatttttgtcaacaaatgggcacttcgcttcccacatcatgtgcagggatatgatgggcttgtgaccagaatttcatgctcttaaggtagtgattctttttatgcttccaagtatctttcatgggtacagtcaatgacattttcctttgtttttctatctttagtggagatagtggacccagtggatatctatcttaacctccttcggaccatctttgactttcatgccatcaagggtttgctgactggacccagccaactgaagattcgcattgacgcaatgcacggaggtaagcttgtgattttctccaaatcagtgggcaggaaatattgagacctgtacacctgttgggtttcagaggttaagaggaaagttggattcatagatattcacacaacatgtgtatgttcagatatttggaatgctctggaaaacttcaggacccttatttctgtctttggatgtaaatgaaaacaaaagttgaacaaatgagtttgaggctatgcatgttcaagtgtggagtatagtaaaactgttatttatttgatcatatgcatggcatagtttaaacagtcaaataaatagttcaagatttattgtgaaaacaatctgtacccaactcctatcttcccccaatttgttaccttccagagttaaatttttccattttttcagctgtttcttttttgtatttatctccctatcattaaatattatgaatatacagacccttgttggtttttcagttttgagcattactgaattcatactacaggaactggagctgcagctctttttcaccctctccacccaccacccacctctccacccaccctttccacccaccagttagggaatcctagcatgcttccctaattatatcaccagtttggtaagatcattatctagtgtttacattaccacaacactgctgagccatgcaatatgctataattatatttcctttacagtacaactttttgatttccttggaaacagcaattatcttgttttctcattgcttgcttttaatcaagtatgtttaccactcttaatcctcaagctctccgctagtgtctaaatcttccttcacttcattttcctggagactttgatctgccccactctgccctggttgctctctgagcatgctgtcatcatgaaatctccctttatcaccatggtagtaattctttttacacatctcttatgttaaatgtcctgttccctggtttctttgtctgacaccttgatttactcgtacattttggaggaacacattctccaggaactcagtgagagaaagctcatggtaggtaaatattttgtgtattgtatatctgaaaaggccttttattctacacttgcccttgattaatatttgactgatatggaaatctaagttggatattatttttcttcagaagtttgagggcattgctctactgtgttatagctattatattaaacttgagaaatccagtgctattttgatttttaatccattgtctttcctttttcttctctggaagcttttaggacctttgacttatcttcagtgttcctctgtttttcaataatggatcttagtgtgggactctatctttattatattggacacctgatggaccctttcagtctgaacacttgtgtcctttaattctggaaaagtttttgaattactatttagtaaccattctggttatttttactactgaattgatcctttaattattctatttccccttctcctccccagtttttcatctctttattttgttctactttctgggaaatttccttgactttatcttccagtcctttagttctaccattatatttttaatttcccaaaacttttgtttgtattttccaaagattctctcttgtaaaaacgcatcctagttatgtttcatggataccatatctttttaaacttaggtttactgaggtataatttatacacagtaaaactcactcctggtaggtatacagtttgataagatttgaccaacatatacagtcatgtaaccactatcacaatcaagactgaatatttccatcaccccaaagagcttttggcagccctttgtagtcaaacctctccccttatccccagcccctggcaaccactcatctgctttctgcccccatagttttgcattttccagaaagttatgtaaatggaagcatacaatatgtcaccttttgcttcaagcttctttcactcagcataataatttcgatatacattcctggtgttgcatgtatcagtagttgttccttttactgctgagtacaattttattgtgttgtcgatataccacaatttgtttatccattaactggttaatgaaaattagatttctttttcttctagttgttggctattataaagaaagatactgtgaacattcgtgaacaagtctgtatgttttcatttgtcttgggtaaacagctaggaatgggattgctgagtcatatgatacgtgtatgtttacctttataagaaacggccaaatcattttccaaaatgcctgttccatttgcaccactggcaatgcatgagggctccagtttacctgtatcttcaccaatacttggtactgtcagtcttttccattttagccattctactctatcttgttaatctctattaggatattactgatatattttaaaaagttttcttttccctgtataatttttgtttcctccaggtttctctttactttttgtttattttcacctcatctcaaatacattcctcaaaattttggtgatccttggctttctggcatatttaagaatgaggcactaaaaatctgctgggagctctgagcctgctatgggtcttctccatgggccttactctaagggcttctggctaggctgttctgttctttcttgttgggctgatcatattcctcaggaaaagaactttcaggttcttgccttagcattatctggcctacagggaagacagctttgctttttttccaaatagtatgagcaatgtttctgggtttcagcctcattgcctggtttatattgtatgtccatctttgaatcaattgctctggctagaagatggaggacgctgattgcgcagacataggtcacctccttagccttggggaggtgggatttagccatacccagaccccatgaactgagatggggaagagagtttttctccaaacaaatcccaaatgctgtatccagaggaagaggaaatgtgtgctgggcaggcacaatcaagagatgttcactattggaggattgtgtgttgtattggtggaaaataagtggaaagcaatatctttcagatatttcagctaggaggattacatgctgttccacagatgtgccttatgttctacctcaggctctgttcccttgctcataatgttccttcgatttagatgggcttcccactctaaacccaaacacttgccaactttatattattccgtcaagttccaccagaaatgctgcttcttccttgaagccttatgtgtggttattgcttctctgaagccattggatataattatttcatcaatgtgcattgtttagtcttaccactgcagtcattcatttgcagctttgactcatcccactactagattacaagcccaggaatgtagaaactatgtgctttgcatcccttcaatatgatcccttcatttcctagcagagcagctccatattgcatactccataatgttcattgaactggaaaatactattccttggcatgtattttggtaaaatgtgcttgtttttatatgcttcagtggtttatagtgtttaattatatacttggcagagtccaaatgattgcagagacaaagaacattgctagagccctttaatgcttttgcatatattcagctaaaacttttaatacatgaaaagcaacagacaatgaatcattattatgtagctgatttctttctggcaaccttttagaaaaatttcaggtgaaaaaatttatggaactagatgactgaatacatcttctgtattcctaccacagtaactggcacatagtagatgctcaataaatagtagttcaagcaaatattgttctatattgtatctttaaaacgattgtaaatttatgtttttcttctgggttattaaatggtgtttcctgtactattcagaacaaaatactctggggagaaggttctgcaaatatttaatattgctgtgtatctatttttagttatgggaccttatgtgagaaaagttctgtgtgatgagctgggggccccagccaattctgcaataaactgtgttcccctggaagactttggagggcagcaccctgacccaaacctgacatatgcaacgactcttctggaagcaatgaaaggaggagaatatggatttggagctgcatttgatgctgatggggtaagtaggaaagctgtctgtctgctgaccctttgatcatataatgagccatgcactggaaagcagagaattaatgaacacatctggagctaacatgtatgggacatgtgtgccctaactggctctgcatctgcccttctgtttaatgactaagtattgcaattaaatagcgattacttttcttagttccagatttacgttatggcatacaaaggttgtttatttaaaaatatatattattccataaacctttatttatggctggtgttgttgaaagcaccaagttaagaaatcagctatttctgcaagaaccagtgttctctattatgtttgggagaaagaaagagttaggtatttggggacttctaaagcttgagccacatttcaacaggtggaacatattcctggtgtgtcaagattctgggcccttggtactcagagatttcgaagaatgtttcccatgttctctttggcctcattcaagttgttagattgttaaatataagatggcagtaaagtggattgtgatgattatgggaatgggctgctagcagatgcttctgtccgatcatttttacgcattccttcctacaggaccgttatatgatcctaggccaaaatggcttctttgtgagcccttctgactccctggccatcattgctgccaacctctcttgcattccatatttccgtcagatgggggtccgcgggtttgggaggagtatgccaaccagcatggccctggacaggtaagcaaggatgtcaccgtgaaaaactttatggtagacctttggcgttgatgtctcctttgttggttgctggcgcttattctcccctgctccatttgggaatgcgttgaaagcatgggaacacggtatagtgtactgggtagaagctggagaatcaggtggcctgagcttaattcttggttctgccacttactagctgtgggaatttagacttatttagtctctgtgcctcagttttcttatctgtaaaatgtggataataatagtggtatctttatatggattgtcatgaagtacaaatgaggtgcttcatgtagaacatttaacatggtgcctggtacatagtaaatactacataaatgtttagcaacagaacttattaacctgaaagtgtgtatgtataagtgagggaaaaaaagcatgggttttgaggtcagattatattatgttcaaatgctaacttatagccttattagcactgtacaaatagaaaaatgatacttcataggtttattgtaagaatgaaacgagacagtgcatggaaaatacccaacaagagattcactcagtagggctctaactaaccctattaggtttcattcttcttgctctatccatccctcttgtctatcaccctatattataaaacattgaatttcagagtctgacatgttcaaccagcacgtgttattatagaaacagtgtatgtgcctggtggaaagttagaaaacacaaataagagaatgtaaatatcatatcccctaccttgggttacctatgttaatagaaaaacttatattccttactgtatctctttctatacatatacattatatgcatataattaaaatacataatataatatacataatatatatacatatataatttatttgcctgtgataataccaaagacatcaaaaagcacattgcttgtaacctgctttttcttttccatcaacaattgccaactaccaattaataaattttggccgggcgtggcgactcacacctgtaatcctagagctttgagtggctgaggtgggaggatcacttgaggccaggaattcaagaccagcctggataatagagcaaaaccctgtctctacaaaaaattttctttaatcaaccaggtgtagtggcatgttcctgtagtcccacaccaaatgttgattaggataggaagcaaccagaactttcatacattgcaaacaaaagtgtagaatggaagacagtttggcagtttcttgtaaaatggagcctacagctgaccaacattccattcctaaatatttacccaaaaataatggagatgtgtccacaaaagacctgtataataatatacatagttgcatgattcataatggctaataactggaaacaatacaaatgtccatcaacaggagattgcaaaaataaattgtgatatatttatatatttgtatactacacaataacaagaaggaatgaaatactgacacatgcagtgggtatggatgaataaaaaaatattaaatgataaaaagccagtaacaaacaaatacataatatataattccatttctgtgaagtttcagaacaggtaaacatatatgtggcaatagaaattattacaatgttactgtatgaggggtaggaagaaggcaccgggaaacattctgaggtgacgggaatgttctgtgtcttaatctgggtggtggttacatggatgtacacacttttcaaaactcattgaattgtacccataagatgcatttcactgtatataaattttaccttatgaatgaatcaacaccatgaaaaaatagccacaaaatccagaagatgagattctatgggacaaattagctaggtatgatgacgcatgcctgtaatcccagctacttgggaggctgaggcagaaaaatcgcttgaacccaggagacagaggttgcagtgagccgataccatgccattgcactccagcctgggcaacaagagaacaagagtgaaactctgtctcaacaacaacaacaaaaaaatactgaagggccataacacgtggttctaaatgagatactacattgggcaaaccattcaaaaaagacattctggagacactgagggaaaatttcagtatgatcttagtttcagatgacataaaaattatttatttgtttattttagagaaagggtctcactctgttgcccaggctggagtgcagtggtacgatcatagttcactgtaaccttcaactgctgggctcaagcaatcctcccaactcagcctcctgagtagctaggactacacatgcgccatcatacccagttaattttaaaaacattttttgtagaaatgagatcttgctatgttgcctaggctggtatcaaattcctggcctgaagtgatccccctgcttcagcctcccaaagtgctgggattatgggtatgagccactgaacctggctacttttaatcttcttattagtatcttttaatgggcagaagttttaaattttgatgaagtccagtttatttttcttataattaatggattatatgattattatatatgtctttgtcaactacaagaaatttttgcttcctccaaggtcagagagatattttctccatattttcttctagagtcattgcagtttcaacttttacacttatgtctagaatgattttgaattaatttttgagcacggtataaggtaggggtcgaggttcacttatttcccttatccagtttttccaatcccatttttaaaaaagaattttctttcccctgaatagccttggcaccattattaaaaatctgttgaccatatatatgtagatctctttcagcattctctattctataccactgatccatttgttgattcgtatgtaaatattacactgaaattaggtgagcttcccaatatgtttttcttctttgtcaaattaaagggaaattatatattctaggtcccctgcattttatttcattttagaaccaacatctcaatttctaccaaagcctactgggattttgattgggattatgttgaatctatagagccatttggggagaatagtattttaataatcttgaatcttccattccatgaatgtggtatatctctctatttaggttttctttaatttctcttacatgtatttcataatttttaatgtagagatcttatacaatttttgttaaatttatttctgagtattttctttattttgacgctattatgaatgttttatgaatttaattttccaattatttgctgctggtgcttttttgtaaattgaccttgtattcttcactagaggggagaagaatcacctaccttttggatgcctcccactctacttgtctccctgaggtgatatggaccttaagtccacgatggtgaactaaactcagtttaaaattcttgcctagcagcaccaaagagtggtatgtgattccatgttttctcccatttacctttgcctacacccttcctttaaaaaaaaaaaagactccgtagaattgtagggaacaaagcaaaaatgggaccatttctagaaattgagaactcagagtcatataggatcctgagtgatatgtagggtatttaataatatgggagtatatttaacccttccacttatacagaatcttataatttagaaataatttgtaacatatcaactcacttgatctttgcaataattttatgaggtaattgaggtaggtattactctcctcatattaaagatgttgaaccaatgatcagagagcttaagtgacttgtacaaggtcacacagtgaattagaaattgactcaggatttgaaactaggtcttctgataatagggtactactgtatctgcccaataattataattggatcaaaagggtccctgataaaccagttgagaatattgtcccctgtgggctagcaaataactttccaaaccatggctaggggaggctggttttattctgacaacaaaaaccatttgtccttgtttcttgtggaaatttcccagtagttcttgatttcactttacccctccttctcaataaatctctgtttcagtcagaaaccagaggccttgcttagaaatttcacaaaggacctgttctgatatgtaagtgaccatttaaaaggattattcatgcttgctggttgggaatcagaattctgtggggctctgacttggtgatttgttctgggtatttgatctgttgtgtaggtcccaggtggattctcatgatggacactttataagcttctttcttcctaggtaaaatcaatgcagcttcaaaatttcgaccttgacagtggtttcccatatagcttattttttctttaattagtaaaattataggaatgtgcccataaatgccaggccctggaataataacaactgaggacacagttgagatccattaaatgacacacttgcctaaactcctgggattccagaataaggggaggcctgtacccttgaggctgatgaattattcagacaaactttcattgttcacagataattgtggctccccaagggaagattttcagtgtctttaatttctactcttacagtgtcactaaaacaaggattccatttagcccagaataatacagtttcagccttgaaaatggcattcttttggggctttgtcattctgaatgtgtctgatttgtggttgcagatgaatctgtgttgctgaaacattttggttcaaatgatttcagaagtaaaacacattgaaagtatgtttgtggcctgaggtccgtctccaccccatgtagaggtattaaataatcttttgtgtcatcatccttccataatatttatgaagcacccatctgtgcttggggctgtgccgaattctgtgcaaaacaaggcaaacacacacagcctgaagccctattcactagacatatttacagtctcaaacatggctagcatccttgaatacatcccaagaagccagatctaaaaagtatgttttgactatgaaaaaggccatccaagatccatcacccataaacagggtggtgaatggattagtgctcatctaccctctatttgctcttatgccacccctatggttcaccatttatccactcaagaaatatttattaaggacctcctatgtcctagacatggtccccgtggcagtgctttcagtctaatgcggaagacaaagaataacaagtaagggaaacatacagaaacacaaattgtaacacaggctagtggaaatgaacttggtgcagtactcattggtgggcatcgagcatcttgcttagataggagatccagggaaggactcttggaggagattaggcataggaccaaagatcagaaacaggtatctggacctgactgtgatgctgggattagaaatgacacccacacatgtgaaaacacttattcctcagaaggtagtctacagctatttgttgccaatccccaatctaaaatatgtactatagctttatcttgaacatactcagctgatcgttggaatccagacagtgttaatcctgcaagtatgcaagtatctactgatctctggtgatctcgattcttaccacgtcctttagatctgtgctgtttcatctcccagatcagtcatgatggatgacagtggtggaagagatagtgatgtgagcttatatgtaattactcagtctcccatacattgcttctgctatagaatgatgggaattattttgctttagcagataaatatgttcaaatgtaacctatattaacataaaagaaaaaaagaagaaagccctttatcctgtaagtttttgccctgaaactctgtatagctgattctgttaggatcaaggcaggaaagagatggcaccctcaaaaaggtcttactaaagagaatttagtaattgtaacttaataacctggtctaaggaacggatgaggttaaggaaaccaaaaaacacaagaaggaatggggaggtaccttagcatcagcaatagcaggaagctgttaacacccctaggactaagaagggtccaggggagaggtcagggtgaccacagcctagtgaggtctggagttgtgaaaagtgggctgtcagacaagagctgaacttggcaggggggagaaatgccccaacttgtctcttctcaccctccaacctcctgctggtgcctcctataaccaaactgcactggaagccagagggcagcctatggagttctgcctcctggggaagagaacagggcatttgatgaagtggggactttggggtagaaggggacaaaaagccaccagcataaatggcacaatggcccatctttttgcttatttctacttgcttatctcctagtctcaccctcttccctcttttttggacctcaggcatagagagttgagttaatcatactcatcgttgaacaatcctttaataattggtctgattgaaggctcatttcttattactttaaaaatgataatgcatttcttttctctctgtttgactgccccaccatagacaaccacaaaaaatgtgtttattgggtattgtgtatatattttttgcatatatttttacttaatgtgactagtactatataagagattgtatttgatttcttacctttttttccactaaagaccacactttaagatcctcttgatggctgtacatccatctaggttgttgcttcaaactgctgcttatttgtccatgagtgcatccatgatattttgcccttgattccctcagcaatgaacactcagactgcttctcacttcctatcacagtgaatactgctgcacaggcaccctgtggatatgtgtgagaatctcttcaacacgtgtattcagaagcagaattattgggccagagggggtgtctatacttaatttagtcaattttaaccaaatactgtcagattgcactccagaatgcccatctcttgcctgcttctccaaccagtctctaaattcctgcatcttcaaatccaggccaacacttcatgttgtctaactttctaatttttatccagtagactagatagagagtaacataccattgcaattttaatttttcatgtctcacattactaatgagcttaagcatctcttcatatgcttgagaaatttgggagtttccttttctattaattgcctattcctgtcctttgaccatttttttttttctatttagggttcttctttttagtctgatgaatttgcggaagttccttggatgatctagataccagacccgttgtcagttttaggcacttctaattttcatcttttatctttagacaaaattttactcctgagttcgatagccaaattgttatcagtagacagatctgttatagacaactcaaatttaacatgtataaatagcaacttttctaatttttcctgaaaattgtttttcctgtgtttagtctctgcatgagtcacctattatctaaataataaaccttggaataatccctcattccagatgtaccactaatcactgggttttgttagaaggatcccttaaatgtttttaaattgttatttcttctccattcctacatttccttttctactttatgttctcattatcttttgcttggactattgtaatagtcaataaactgttcccacttcctctagacttcctcttcttcatttcctcttctgtactgtcccaagggcagttgttctaaagcagaaagtcacgcattttcttcccttgtttaaaatgggttagtgggctttgaatgcctgcaggagattccgtctcctgattatacaacatgcacaatctcctgattatagaacacgcataatctcctgattatgaacacttcactcctgcagacattcttatcctgcactctaaacatgtcatgctgcttacagtttcccaaatttgatgccctcacatttctgtgcctttgcatgcacttctgtccctgaaatgtattccctttgccccacctcattccactttgttcttctttatcttttatggcttgagtcaagcatccccttctcagtaagtcctttgataccatgttccctccaccccaacagatatttcaaaaagttaactactatgagctatcaacatgcttcttttgacttttttacaaagagacatctggtgatactatctgttgattgcaaagaaaaatatacctgactaataagaagaaaatgaatggtgcataatgacccaatctcctttggatataataaaactatgcctgatttgtggttttcgtttacatttaggtgagtttgtaatgagttggatttttagtaatgatatgtgggtactgacgctcttagcaaatacagcttaatcaatgtgagatgaaaggaagcaactgcattgtagttatttcctagtcgataatgaactccccacagcctgaacttaagcgcaaggttgtttattccttgccctggcaaattgaatgaggactggattcattaccaaggcatttacaagacgcataaggtggccttcctttatggtttgtgtgttgacctactggaaaggatgctgagactggttcaagtctgtaattgtgtgtttctaagagttggtgtctaatgggaaagtgatctcaggcctgtagttggtaaaaagcatttatgtattaaactggctagagtgagaggaataaattgttaacacttaagactataaactgtaggagatttggagatagtggttaaatcctcttggaaatgctggatgcatcatcttttattcaatttttctgagccatcttgggtttctgctatctgagttagtcagaaaaacacttagatgaatgttaagtaacccaagtgctaaaatatatagtcgtcatcactctcccatgagaactgaaagacgaaccttttttggaagtcagctctcttttatctgctgtatttgtgaggactctttgatactcagattctgtctcgggaagggcattgtcgttatttagggtgtccagcagcctattttcagccctcccaacgatgtggcccttcttggtctaaacaagtcactttgaccagtggtggatggatccaatactgaaagaagctccttagaatcgccctgtctgattagggattcaaggctactttaaactggggtttcaatgccatccagtctcagtgccacccagtctcgaacatgtggcgtgctgttgttctccaacgggaacattaacttcatggcctgcctttgtaatctcaattttggtcttccgaggctacatttggttaaataacctctctcttttattccttgtgacttaaaatacttattcaatttaaaaatcaatcccattgattactgcaaagaggcatgaggtatatgttttgagctgataaaaatgttccatatcttgattacagtggtagttacacagctatatatatatatgtgtgtgtgtgtgtgtgtgtgtgtgtgtgtgtgtgtgtgtatatatttgtcaaggctcatgaaactgtacacttagaagtgatgaattttggctgggcgcggtggctcacgcctgtaatcccagcactttgggaggctgaggcaggaggatcacttgaggtcaggagttcaagaccagcctggctaacatggcgaagcccctgtctctactaaaaatgcaaaaattagctgggtgtggtggcgcaggcttgtaatcccagctacttgggaggctgaggcatgagaatcgcttaaacctgggaggcagagcttgcagtgagctgagatcctgccactgcactccagcctgggtgacagagtgagactccttctcaaaaaaataaaaaaagaagtaatgaattttattttatataaactataccttgataaaggtgataaaaataatcaaactctatttatttaaaaataaaacaaagcatctctcttggaacttcttttctgactaggggcaagaatcattgctctctttgaatgactctagttcccagcatagaggtttgtatttactagaccaccaataaacattggttaggttcaggtgagttgaattgtctctggaatcactgtttactgctttcctttttgtttgaaccaggacataaatatatagcctgcaatcttgtctttggaaaagacataacttacagagttggaggttttcagatatcagtcatcagtcaaatttattggtgatataaaagatataaggaaggtagtttagcccagcctaactctcaatcatatgctttgtgaagccaccagagaagtttggtgcttgacaacgttttaaaatgaaggaggataatgttaagtcatcttaggcctgaaggtacttctggagtgaaagagcattgcagttcttgtgtgtgctttatatttcaaaatgtattttgtagctctccccaccaaaaaagtcttaaaatggatttcagcttcaactttctagggtagtgttgagctgggtctattgaaatactgcttaaatgcttgctaaatatcactgatttcactttacctgtcatgctgagggaaagatagtatctaagatacatgtgcagggtgaatcaagatgctgcctgaaagttttgtgtgctcaggaaagcatttttatttacaagtgaactctattacagcagagatccccaaccccaggccacatagcaggtgagtgagcattactgcatgagtgccacctcctgtcagatcggtggcagcattagattctcataggagagcaaatcctactgtgaactgtgcatgtgaggagtctaggttgcatgctccttgcgagaatctaatgcctgatgatctgtcactgtctcccatcatctccagatgggaaccatctagtttcaggaaaacaagctcaggactcccactgattctacattatggtgtgttgtataattatttcagtatatattacagagtaataataatagaaataaagtgcacaataaatggaatgttctcgaatcatccccaaatcatcctcctcccccagtctgtggaaaaattgtcttccacaaaaccggtccctggtgccaaaaaggttggggaccactatgttatatagtatgttgtttgattgtcatacaaaccttcagaagtatttgaggcaggcactattattgacattgtatttacagaaaaatatgatgatgagatgttaagtaattgcccaaggtcacacagaataaattagtcaatattggtaccagattatctggctcaagcctcataatctcttcactattccttatttgtgagggcaggaaaagttctgattatactccgagtgaaagtcattcgtgtgggttggtgtgggggtaggggtgggggtagggagagagacctgtattacccccaaggtggtagatgacatcagataagcagaattaatttcaacccaatacatctgtaattttgacgttgaatatcactactgtttagtaaaactctgaaagaagcagtcctggctttaacttaagacttccaggaaaatgttgaccgtagttcaaggtaaggttggaaatttacatctttgcctcaggatctgcttgaagatcatcagcagcagctgcactaaaaagtatttattaggcttcggcagcttttctcccttatattctgggtaaagtgggttaagcaggtatgattccttctagaggttgttttgttttgttttgttttggagatgaagtcttgctgtgttgcccaggctggagtgcagtggtgcagtctcggctcactgcaacctctgcctcctgggttgaagcaattctcatgcctcagcctcccgagcagctgggattacaggcatgtgacacaatgcctggctaatttttttgtatttttactagagacagggttttgccatgttggccaggctggtttttaactcctggcctcaagtgatccacccaccttggcttcccaaagtgctgggattagaggtgtgagctactgcgcccagcctaagttttaaatctgagatagacaacactgatgaccagaaacataaaagatatcaattaagtacaatgagatcctctagtaaataatatgttagcaattggatatgagatgcccgagcctaggaaaaaatgaaaacaaatcttgtcagccctatctatatgccctacacaggtgagggtggaatccagacctgggaatccagtcatctcatctctgatcaggttgctgcctgacgattaaatttgtcatttggagttccaagttcttttagagtccctgatggcattggtggtttatattctggcatgagggaaaactccttgtaagttgatgcctgtatttaagaatgcaagatccaccaggactcacagagagatcatatcacttgggatctttgtgcagcaaattagagaaaactagctgaaatggggcctaaatagcaaaaggaatgtgttggcccacataactgaagtagattggcctcaggtgaaccgtgatccagcagctcacatgatactaccatttgacctggtattccctcttgtctgctttgccttagatggtatcactcttatccctaggctctgagcctctgactttctggtccaggtagcaagtgtctgcaggatttctagaccccatgctcttacaccagcttgtctatgaagatggaagacaaagcttttctttccaagaagaaactgaaaacatcaactcaagtcttgactttggttggggtttgtactttcactgactcattgattctctgggactatagaagatgggatagactgacagtcttaagcctccttcccctcattaggtagagctaggaggagggtcattccttcccaaactaaatgactaagaatgcatacatttgtcctccaaagcaagatctttcttttttccttccagaaagagtaactgcagtaattaggacccaattgatggcaaaggggtatgatctaggtgagtccattggggtgcagttctggagggggaattcaggaccttcttcttacctcctcctacccctgcaaatagtctgagactcactaataactgacagtggtattcaaattggaacagtggttcttgcctctgacctttgcatgtgctcaagtagccatctgtccttctttctcatcctctcctctttattcctttcttccttcttcccaccctttccctccatctctattcctccctccttcccttcgcttctccttcccttctccctccttccttccttccttcttttcttatcttcccttcctccccaccttgcctacctctcacatttccattttccaaaaaccttttttagccccttttgtgtgccaagcacactgcatggtactggatattcctgatggagctcatcttcccttccatgttcccttttcctttagcaaacttcactgccaacaaaatgtgttaatattctctgtgtaaggtgttctgctagattcagggaggtccgtggcttcagcgtgaatctcaaggatagagctggggagtgtttttaaatcatgatgacattgttcataaagattgtctcacacagattctactacctatattttggggtgggagggagagacagggaatgtagtttaagaaaagcaagcatttatgtctgccagtgtactcaaatgagctcatgtacgaagtgggacatggaactcgctgacctttattggcctctgcattcagactacctggggttgaattctaactcctctgccttctgactttatgaccttgggctgtttacctaacttctcagggtgtcttagtctatttttggtttcttataacagaatacctgaaacttggtaatttatgaagaaaaggaattcatttcttacagttatggaggctgagaagtccaaggtccaggggcataacaggtgagagccttcttactgtcgaggactctgcagagtcccaaggtagcacagggggtgagggggctgagcatgctagctcaggtctctcttcctcctcttataaagccaccagacccactcccatggtaactcattaatccactaatccatgaatgagttaatccattcatgaggtcagagtcctcatgacccaatcccttcttaaagcccccacctctcgatactgccacactagggatgaagtttcaacagaaattttgaaggggataaacattcaaaccatagcacagggtcttgtactgaggattaaattaggtatatatatatatatatgtatatatatatatatatatatatatatatatatatatatatatatatgtatatagtgcttacagcagtgccagtccacagtatgcgttcaatgaagttagctattattgtcatggcgatggggctttatggataagagagtgaagcataggcagtggattctcatgagtagtctcccgtgcttccacattaaggactaaatgttggccagtggctgtgctcaggccccgtcttccacatgtggatactagtgaggcaggggtgctttcttgctgtgtatattcacatttcagagtccatcagagcttccagaggactctgctgtgtgaacctcacatatctctattttatagtttttcagattactttgtaaataattattgttaattttctttagctttttaaaaatatgtattcatatattgagcctttcagttagtgacctaggaatagacgtacgtttttttggggtggggaaggggtctgtctgttgcctaggctggagggcagtggcacaatcacagctcactacaatgaacttccaggctcaagtgatcctcccacctcagcctcccaagtagctgggaacacagacatgcaccaccctacctggctaattttttatttttattttttgtagagacaaggtctcactacgctgcctaggctcgtctcaaactcctggactcaagcaatcctcctgcctcggcctctcaaagtgctgggattataggcgtgagccaccatgcccagcccctattgccttttgatccgtactttttgattaatatcctctaaaacacatgaaaattcactgttccctctgttaggtgctcccatagaacacatataggaccctagaagtcccatctctttagaaaaattatctttctgggaaaatacagagtttcttttataacacatctgtgtctctgtatgctggccaaaagcctcaaacccccaaacagacctgaaatgtttatccctaccactacttctgataataggggtttgactttgtattgcccacacatcccattaaaacatataatgtgatttgtgtgcatattgtgagcatttgttcattttataacctgtttagtagttcagccaaaagcagcaaaagtgaaataagagaaacatcctgagcaaaagaattgctctttgatatacctgtgcactggcatgagaggacagaggagagatttgtgaaagtggactcctttgttactaatataacaccggctactttctttaacaattaacatctcaaccccaatttatcattattatggctgtttttttgctttcataatgacttcagaaaaattcataacatcacctggagtccctttatctgcaaagccattagtcaatttcactggtactctagggagagacttgggaagtgaaaggtggacatttccccccagatggggtttctttacatgactcttatcaaatcaggtgggtgttaggagcctgagaaatgtgagcgtgaagaaatgtgaaatgtgagatttggataaggtcgtttggatttaaagaggaaatttccatcaagggccaactcctagaggagatcacagagcagaggctggggtgtggctgcaggtaggcatgccattgagccaaggtgggctgactcgaggaagagctcaagcagatgctttagaacaaagcataaatgtcttcttttgagaagtgtctgttcatgtccttcacccactttttgatggggttgtttgtttttttcttgtaaatttgtttgagttcattgtagactctggatattagccctttgtcagatgagtaggttgcgaaaattttctcccattttgtaagttgcctgttcactctgatggtagtttcttttgctgtgcagaagctctttagttgaattagatcccatttgtcaattttggcttttcttgccattgcttttggtgttttagacatgaagtccttgcccatgcctatgtcctgaatggtaatgcctaggttttcttctagggtttttatggttttaggtcgaacgtttaagtctttaatccatcttgaattgatttttgtataaggtgtaaggaagggatccagtttcagctttctacatatgactagccagttttcccagcaccatttattaaatagggaatcctttccccatcgctttttttttctcaggtttgtcaaagatcagatagttgtagacatgcggcattatttctgagggctctgttctgttccattgatctatatctctgttttggtaccagtaccatgctgttttggttactgtaggcttgtagtatagtttgaagtcaggtagtgtgatgcctccagctttgttcttttggcttaggattgacttggcgatgcgggctcttttttggttccatatgaactttaaagtagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaagaactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgacctttgtagggacatggatgaaattggaaatcatcattctcagtaaactatcgcaagaacaaaaaaccaaacaccgcatgttctcactcataggtgggaattgaacaatgagaacacatggacacaggaaggggaacatcacactctggggactgttgtggggtggggggaggggggagggatagcattgggagatatacctaatgctagatgacgagttagtgggtgcagcccaccagcatggcacatgtatacatatgtaactaacctgcacaatgtgcatatgtaccctaaaacttaaagtataaaaaaaaaaaaaaaagaacaaagcaaaaaaatgtgagtgtgtgactgaggtggtacatctgacttcgccattgattctcatcacttctcagggcctcgctttccccatctagaagggctgggatagtggctgttctgcaaagagcccccaggggccacattgcgtctagctcatagctctgcctccctagtaggatgcagcccttgtcctcagggttccaggcagtgggagctccggccaccatgcccatatttaggcagcaactagagagaggatgaagaagaagggcaaaggactacactatcttttaaggagattcatggaagtggatagttgacacttttgcatatatcctataggccaggacttaatgatgtggccacacatagctccaagggaagttgtgaaatgggagtcttcattctgaatggccacgagcatggctaaaaatgaggggttgtcttattaagatagaaggggatgagagttatagagggacaactagctgtctgtactgtgggtttagatgatgtcctaaacattcagtgtagaatattgcagtcttcaaagatgtaaaatatctttaatatttgatcgttaatttttttctttagactaaataatttaggatgctgacataaactatcatgatgatatttttgatgatggtgatgaggatgatgatgaggaggaggaggaggaggaggagaggaggaatatctaccagagaaaatactccagggtgtaggatatgacaatttacaacccaataagaaaagtatttttcccattttacaaataagtaaattgatgctcagagtgggcaaacctctgaggccaaaccaggtcttacctatggagtcatgatatagccacaaagattgggaacaaggtttttgggaagcaatgtggctctctgttgcaagtaacaaaaactgaattccaaatgacataaacaacaaggaaaaagttacatctcgtattaaaatgtctagaaagggcagcagcagaggtgggtaattcattgcctcagcaatgtcttcaaggaaccaggttctatcattctcaggatgtggtctttgaccttgatgagatttcctcatggaaaggccccagcagtgcaagctattaccctcacatacgatgtggtcttatggcagaaaaaagactgcctactgtttatgtgtctttttaaagtcagggaaacttttccagaagtcctcctgtgccatatttgtcctattttgtgtaaattcacctttgctgaggactaggtacctgaataaagtcatgattctcttaatatgaaaagcagtgggaatgattttgggtaggcaactgtcaacacctctaattcattcataggttatttgcccattagccgggtgtgcctgtagtcccaactaccccagaggctgaggctggaggattgcttgagcccaggagttcaagaccaccctgggcaacatagagacatacagcgaccctatctctttaaaaagtatatataaatatatatatacacacacatatatacacacatacatgtgtgtatatatatacacatatatgtagtgtgtgtattaaatatataatgtgtgtgtgtgtgtgtgtgtatatatatatatatgattttcccaatatttaaggacaatctagaattctagaattatggatatttccctgaaaatgtcattacttttggatgtcccttgcttattacaacttactcacttgcttatcaataaacatttattgaaaaccttctctgggtcagatagtgtacgaataatgaaattcatgcttactgtcaaaaaacattttatgatttagtgacagagtcagatatcctcagcaacatttacaaaacaatgcatggaatgccacaatagaggcaatgaggatgcttagaggaaaccacttatattggcctggggaatcggaacttgtggctgtaataaagctttcttctcttagattatgaatgttgctcatggggagcacttaaatgagctccctgagaacagggaccacaacttctttgtttttattttttagtctgagtgtagtgctttgactatagtagttgatcaatgtggtgagcagaaaaggtagcttccctacattacagctagtagtggtgtttgctggacttcagcaggtctttgtaaattcaaagcccaggctctctaacaccatacatagcactttgttactcacaatgaatggtttgctacagaatgctttctcttttctaatctgcttcttgtctgattgtcatgcaaacttgaatgggataataaatgtaaagtaattagcatagaagaagcactcagtgactattacctgctattattactttataatgtagtctgcattatttttcttcctttatttaaatcttcaactttgctgaattgcttattgaagaaaatgctgtctctaaacataacattactggcagctgaaagtgaaccttacacatgatgcttcatggtatctgagagtcatgaagtttacaaagacatttctggtcttattctgataaatatcacatgctaatatttcctacattcccatttactcagtgttccctacttcctaaatgagggaaaagcactgtcgaacagttgtcaaattttcttcacaagcagcttggttttccttaatggatgaaatcacccttcgttgatggatccatctgcacaggaatttctagatcatctcagggctcacactctgggtcccacctcctgctctgctacaaacggttaggtatctttatgcatcagtatccagctggccatagcggccctgtgtcagaaattatatttcctctaattggctaaagggaccattttcttaacagtttctttcttttatagggccatgtgctatgttccatttatatacacattctggaacacagtattccagagcatgttaattgtttagagataatggacctaataaatagaatggtgcggttaaggagaaatccagttgcatggaggtccttggtcttttgtgtggcttgaagaggttgaggatgctgatgtgttctttgggaagagattcacagttgacaggaaacatctgctttaatttgctccaacatcaacaagattgatgtggtaggaaacctgttgttactgtgtgagttccatttatcaaggcagggcttggcccgaaatcagggctatttggacaggtaccacaatgggtcaaaatatggacataacaaagcagcattacttgagagtatcatgtggctgtttctctatttaaagggagtcatgttccttctatacctgtctggctatcttcatttctttctatgtctttctctttatgtttttctttctcagcacatttccattcagggcctcaattacgagtgtaacagttctcaccctaaattctgcctccatatcctctctcctgggtaagaaaggctcccagtgatggtgactctcaatggagggaaattctccccaagggtttcccaaatattttcagaaacagctatgcaaacacacagactcacacacgcaagtactcaccaaaccttggagattatccactacccctaaggtatacctgccttttctggctaactttcagaatcacttacctagaattaattaaagatgctcttaccttcaggaaaactgccttggttttcattatttggaaaagtaaagtttgtatctgacacttaaaatatgcctctggagaactcaaagaattcaaagcattcttatatcagtgcatctgtgatactaatcttttagaaaattattacactgctaataaaatgtgaagtgtggattcatgccactgagcttaggttattgcctccactatttttgaaatgctagtgcccatgatgtcctgatgcaggaactcatctcttaacaaaacaacacagccatatacagaaaaaataaggtcctttttcacccattctggtgtagggtagatcaatcaattaaaagaaattgcaaaggctatatgctatggtttgggtgtttgtcctctccaaacctcatgttgaaatatgattcccagtattgaaggtggggcctaatgggaggtgtttggatcatgagatgaggacagatccctcatgaataaattaattgtgtctcttggaggtgagttcttactcagttcccatgagagctggttgtcacaaagagctggtatctccccaccttcttgcttcctctctctccatgtgatctctgcacatgccagctctccttcaccttctaccatgagtggacacagcctgagggcctcaccagaagctgagcagatgctggcaccaggcttcccgtatagcccgcagaaccatgagctaaatagacctcttttcttaataaattacccagcctcaggtattcctttatagccacacaaaatggactaagacaccctatcactggagtccactcagactaccaggtgagataaatccaggagcttccaggttctttgttcttgattctggcaatgggttcaaataaaagacaatgaaaggatatgctattggctactttgtcatttcatcttcctgcttcctacctaatgacctgaatgcacatgtgctcccgctgtcagtctccccactgtgaacaaccctcctttctctttacgaacctcctctgccctgggcaggctggtgaccacactgctctgggccagatactgtgcccagtacagagaggaggtgcacgaggaaatgataaggcacatctctgctttggagaatctcattgcccaagaagacatatagacaagtaaaccagttacagaaataatggttaaggtacactggtggtacgaagaagggacgaatcagttttgcctaagattggaggatgctgggcaaaaaaggcttcagagaagaggaggtatttgaagagtgcattgaaggttgaatagaaggtttagagaatcagaatttgcctagtgtacagaaagaaaaattgaaaggcagtggacggccatcagtagaagggtgtgaggcacaagttattgaggtacatgaagagactgacagtcatgatcattatgaagcattagttgaagggtcactgaggtacacataagtataccaatggtaatgctgctggaagagtagccaggggactggggaaaagaaggcaccatgttatgtgctgggacctcattcattcttcatgtcataaggagccaattcttctctggacttttccacattccatgcaaagtctgtctggcttcctgtccatttactttctggtcattcaaggcctaccactgtccggtgtccagttgctcctcatatgcagatgaaaaacctgggccaggtcaaagtctgaagacctagagaactgggcagagctctgggcagtgtgggatctgcccacacctctcagagagaggaactgaggtggttgttctgagaggcagtgagcagggagaccctgaagccaaaggctggcaggatccagcagggcagaggccagcaggggaattcagggaagagcctcagggctgacaatggggacacctgactacagtcaaggggattcaaagcacagcctggaacctggaggaatcccctggaacatggacacagaaatgtggacagctgaagccatgaccttgaccacaggtagggagcttgcagttagggacaggagccaactttacttagacataactcaaattcatgtcatttctgaaggaaatgaaatttccttcattttcacctggttggaatttattgctctctccttaatggtgcatagcaccttgtttatttatgctttgagtaattgtaatatgccttgttttatagtatttttatacatttctacttcaactcttgattataaatttgttaaggcagggaatatctatctatctatctatctatctatctatctatcttatctatctatcatctacacacactaatggtattttagctatagcatacataaatacataggtacattttgttgaattgaaattaattgaattaatcccatcctctttcagaatagaaattatgttttctgggagctagaaactattgtgagagatgttagtattgttgaaatttaaaaggggctgtccagttcagttgtggcctggtgtgtactgaatgacatccaaattctaagtaagtggaattgctatcagatctgagataaattaaccatgctcatgagaagatgtagagtgaggaattccttccacaaatgctctgcttatctgattattggttagccagtgatttcctgtcatccacaaaaaaagatgaaatagtaagagaaaagtaaatactaggtgaagtgctttgagccaaagggagtccatctaagaagtgatggatggctctgttgggattccggcagtagtgcatgatgatgttggtgtataaatacgtcagctcctttaacccttgggggaccctgaggcatgtgtttttcatgggcccctagcgtgctcatgcaggattaagtttcagttgcctactgtggtaattggcttgagaagcctatctttattaattttcttctcttccttgtcttatttctcttcttccctacctgtgttctcttcattcccttcctccctacaaaataaactatgtgagtttgaattcttctttcaggattcaagtttactcctggggaaccaaattaagactaaagaatatgtattctctttcttctcatttggcgttgagacattttaaagcctcaacaattttccctatataagcagttccaattatttgtgcctcacttataaaaagtaggtaatgagaaaattaaggcttgcagacaaatcttacacaattgcagcagaatatctcagaaatgtgctcaattctcgggctttctgtttggtctctttaagcaggcaacctcaaagaggtgattctagcttttgtgattatgtgtgattttgttattttacagcctactgctgtggaactctattgagaaaagacactgataaagctaataaaatatacatctgctacaaagaaaattttatctcaaaaatgctatttcctcttcagctctgaatgttgacagattttttttcctaacggggttcagtaggttggctggaaagccaagatcaaataccaacgggaggtgtgaagactggccagcctatgttcaacgagttcaccatccagctgctaagttctccatgctgataagacaaacactctctgaatcggatacgggcctactggtatctttaggaccatctgcagcacagctaggtaaagtaggcacaatttttaagttaggttttgcagaaggtcccatgaaacagggtttccttgtcaaaatacagtgagacataataacagagccatgtttggaggtcccttcattgacaatgggttatgccttcagctttcaggctgatcctgctgagaagcatatgtgattagccccaagaagctctttactgccccctagatccctgtcaaatctaggagatcttgagctgtacttcccctgggcccgggggacgtgtgaaatgcttgtgttgtatcttcattagtggaaatttttgatcaattatcctggatgatccatgtcatggaacattgagctgcgtatcctttcatttccatcattcagggtgatattcaaaatataggataggcatttttaaccccaaagtatattgagaagtaaaattaatgttggagattagtacattacacacctcatcaagcaggaagagacaagaaagcatataaatgcgacacaattctggggcaactcctgtcttcaaaacttatttgcttcagctatagccgctgaggccttactccttttcctgcctgtcttgaaagattgttctatgcggccacccagatttcttgggatctgatgctagaccttggaggaagtcaggtaaagctttctagctctgcctcagttggaccatgtctctcccctgtctctggtttcttgggctactttgatttcactttctgtgttatggaaacctctggcagtaactgttccctgtgtgccttacacttcaattgagatgcacaattgccaaagctctctctgataccaccagggagcagcgaacttaattcttctgtctttgatctctctcttgttttgctgtttctcccctgacaagaggctgagctgctttgggggccaccaagggccattctctccactttgtccttcactatatcacatccccatatgtcttcctatagtcacctgctggcgtgattccattttgtttgttgaatttgactaaaggtgtcttgagcttaggagtcatatcagcctgcccacaaaagtgtcccatttcactgggcaaatcaactagaatgttgttgtatttactctgtggacttaggaagggatcctctgggaattagccccatggggtttctgtcacctcccattctactttggcttagacaaggtatctgagttcagaacctgactctgttcctgcgctcagctttacagacaagtggtattatttttagcctgcagaccttttagttaacaccctgctgcattgagggtgtgagagagaagtgctttggaaatcagactctgttactgatagcttgtcctaaactgaaaaggcgacaggagaaaggatgctttgtgttcaagcagaagaaatctccgatgctgcagctgctgctgcagccttcccctgtgtttctcaccttgctgcggcctgctgtttggcaggacgacttgactggctgcgctgtggtttctgcgcctgtgatggctccttctgaatgccctctgagccctgggggtcttatcagctggctgcggcgggggtgggagatgaacagctcccttgtcaagcccgctttctccttctcctgggaacccctgccgggtcaccagcctaaaccccctctagcaccccatggcctcttgcttggggtgtcagagtcagagagagtaaggaggtgttgggagatgaagttcagagggtaaaatgataccgcaggaggaaccaggcttatgcgagctttatagtcggctgaaaaagagaatgtggtaaagatcaggtggcccgtttcaaaatggctggaacttttacttaatactttacaaggtgcgcccctgccccaaagtataggtggaaataaacctctgctttaaaatctcaacagaaaaatcagatcaaagaaatctggtgaaatacctttgattaaatgtaacacacaattgatctcaattccatagctgattattaatttttaattaggagtaagatacaggcaccatgatgtgtagattttgttgtctaagaaagaagatgaatagaagataatatgttttaactttttttttccaccaagttttaaagttctaagactgctggcaattttcaatgaatatatggggtctccatcactggccattttatgggcaaaacagcaaaacacaaataggtttaatgctgagctcccagcccttatctttgcttctccccctccatttccaccagtcaggtgtctagaaaagaagggcatcctggttgggaggaattggttgtggggaggatttggccatgatcagagtaggtactgcttcagaccgagctggggcattttaaaactgaggcagaagaagccatactttaggggtccggggaaagaaagtaggactaggatggctccacaattcctctgctgatcctctcagagacttagctttgcttagaagcattccctggtaaccagcatctattgctgtctttacttagcatttaaatgcccccagtctggcaatgtcagttatctcagagccaagacagaataattttgtggtagaaatcaaagaattttcagtgtaacatctagggcaggatttgtgcctcttttgcagtggatggccttttcccctcttgacagaattctgttagagcctcacattgttgagatatccccctcatctccattctacagagtgttaatgctgctggaagactgtctgttaaaatcagattcccatcaggctttgaatgctccctaccaaatggcgtagctgcctttgatctgtagtctcacttaaggaagcttttcaagtgcatggaaaatgtcttgaccccagtgtttggacctgtcactgcttgcacaccaaatcaaggtatcatcaagctgaaaacgtacacctagaggaattcctgctatttaatgggctcagccattcctgctgtattgatggcagtctcagctcagctctccctctgggggctccgaagaccctagagttatgttcctcccagcagcaaacctctgaggcttggtgtggctcaaagacagagtcagagctgctttgtcatctgtgattctgtgggttggaggagtagtcagaagtaggtcacatctgaagaaaaattctctgcttgtgatcttgagtacaactgaaggaaactgacccctttgaattcatgaagtaggatgcaaggttcatattatctatgaggactgtaaaaatggctccactgaccttgagcttattcgctcacaatgcatgccagttagatatgggtatttagcatgctgtattttaggaatattacatcaaatgtggaaatacggaggcacatggtaaactgtcacgtactatacaaatgatcattgtgatgacattttcttaaaatgggttatatgaagtataaagaattgagaggctgactattgccagcaattagtttagtatagccttgtttattaatctatggccagatgtggtaccttagagcctatagatcttactgtgcacacccatgaccttcagatgttcgtcgggagacacaacatagagcctggtcttggtgcttgaggaatctgggatgtcatacctgactctttgatgcattatttggataccttaatctctccaaatttccttgtttataaaatgaagatgtaaatgcctcaattgcctcatgtggtggttatgaaagctaaaataaaaatgcacagatggttttgaatgtgctttgggtcagtgaagtgttataaagtgtaaggtgttatgatgatcatagatgtaacttgggatgtatgctttgtccatggatggtttcttatctgaaaggaaaagctgatgaaagctaggtcgacgaataatgtgtgatgagtatatgtgtgcatatgcacacgtggacatgtaggtgcacatgtccatgtcagggtacatagtgttacaaaggggagacgaggtgtgtactgatcattttcacatttgcactctgccccgttcactgatcttcccctaatcggccctgtatctccaggagttccactgcataggcctctgcctagggcctgcttcttctctcacccctggtggctggctgggtcctgttgggtggctccagcctcagaggctacagcagtttcctgatgttgtttatctatagatggtctctcttctgtttggtgtctgagctcttccatcttatgggcaacggattctccatattaaattccttctgtttgaaatacttagagctggccaggcatggtggctcacgctggtaatctcagcatttggggaggctgagggaggcagatcacctgaggtcaggagttcaagaccagcctggccaacatggagaaacctgtctttactaaaaatacaaaaattagtcaggcatggtggtgcgtgcctgtaatcccagctattcgggaggctgaggcaggagaatcacttgaacccgggaggcggaggttgcagtgagcggagatcataccactgtactccagcctgggtgacagagtgagactccgtctcaaaaacaaagcaaaacaaaacaaaacagaaatacttagagctgattctgctttcctgactggcccctgactgattccagatgcttactttgtagatggatactagattaagacatgcatagtacaatttgtagagaagaaagataatgtagaatctaactttatactgtttataagagatatgtctaaaaaatgtgattcaaaatggtttaaaattaaaaattaggcaaatatataaaaaatgaagagaaaaaagcaaaaatcaaggtaataaaatgttaaagcaatgaagatcacttttatttattttaaataactatcataaatatttatgtattgaatgacagcatcagaatatataaataaataatttttaaatgtaaaaaaaaaaatttagaagctatatattaagagaccttactgtaattttcctaacttttgatagaccaagtagccaagtaggaggaacaatctcaacaataaaataataatttattgacctgaaaaaacatttagtagcattgattggctcaaaactatctatatggggggtttgcctgggaactccatttgcatagcaaacactcagtttttattcatgttgagttatattattgggaggagctgaaggagattactgttggggctaatgtccccatcccctacctcttggtaacaaaactgaccctcaagagtcactccttgtgtggtggttttttgttttgttttgttttttgttttgttttgttttttgtttttttgagaggggtttcactatgttgcccaggatggtctcaaactcctaggctcaagtgatcctcctgcctcagcctcccaaaattctggaattataggtgtgagccacctagccgggcccggtgtactttcttccccattcatctagaaaagtaagaaggcatattgttgatgaggtaattaaaataaattaattagcacaacaataagaaaataagtaatgtgataaaagcagtctgcaaaggcataattaaaaaaatttttttcccataggttattgggaaacaggtggtgtttggttacatgagtaagttctttagtggtgatttgtgagattttggtgcacccatcacctgagcagtacacagtgcatgctatttgtagtcttctgtctctcatccccttcccaccctttcccccgtgtccccaaagtccattgtgtcattcttatgcctttgcatcctcatagcttagctcccacttaggagtgagaatataccatgtttggtttcccattcctgaattacttcacttagagtaatagtctccagtctcatccaggtccctgcaaatgccattaattcattcctttttatggctgagtagtattccattgtatatatataccacagtttctttatccactcgttgattgatgggcatttgggttggttccatgtttttcctattgtgaattgtgctgctataaacatgcatgtgcaagtatctttttcgtataatgacttcttttcctctgagtggacacccagtagtgggattgctggatcaaatggtagttctacttttagttctttaaggaatctccacactgttttccatagtggttgtactagtttacattcccaccagcagtatagaagtgttccctgttcaccgcatccacaccaacatctactatatttttttatttttggattatggccattctgcaagggcgaaaatttaaaagaacacacaagaacctgaatttgaaagagtaaatggtggtgaggcacctttgaagggagagtgctctgaggagcaggactgaagagcttggtgttgagaatggcatgcagagctgacattaggttcaatcaggttgtttctcttcccctggaatggcagcctttgggaaataaccccaagagcacaaaatctctctctctctctctctctctctgtctctctctctctctctctctctctctgcctccctctttctctctttcttttgggggctgaggcccttgaagaccctttgcaattccataaatagtcagagacatccctcaaatactacaccatgttcctctgcatgggaaaagtgtggtcacgcatacacgtaactccattccctcccctcctttcctccttgcaatggaaggagcaggaagtggacaagaaaacagaacagtattagagaaacagaatgtacctaaatggggaagactgggctgaatttgaggaggctgagttttacttccaaacccacccaattcactactgctgtatctcttgacaaaataagtagacatagtctgtggccaattttcttctaacttcatctcagaactcctctctcctctctatgcatatctgccctccgcaagcctcagacctcatgatgaacgaggaaggtaaagcatctggaaaagtttcctatgaagagctgctgaaaaagcctgagatgttgtttagtgtagaaaagactcaactttgcatttcccacaaagtgtttcatggaacaccctttgtcttagtctgttccagctgctgtcacaaaataacacagacagtgtggcttatgaacaacagaaatttatttctcacagtactgaaagctgagaagtccaaaatcaaggagctggtgtgttgggtgtctggtgagggcctggcttcctggtttatacatggtttcttcttgctgtgtcctcacatggtggaaggggcaaggcagctctcaggggcttcttttataagggctctaatctcattcacaagggatctgcccttgggatctaatcacccccaaaaggtcccacctcctaaaatcatattattgataactagatttcaacatgtgaattttgggtcaaccaaagctatagcactactcacaagaaatgttaatgggtgttcttaaacaaggcagaagggttccatggacaaaataaatttggaaaaggatgaaataaatataaagcaagtttcttaacttcttcacttttcatagcttttgacagattgttgtgattctccagtaaggactacagaatgtagcatttcccaaacatatttgaccaatgaactaccatcccaggtgtacctattaatgtctcttaggggactagtgggaggttgcactgtttgattttaaagaacgcttgcaaaaccagacaccatgacttcaagttgcccttattagttagacctgtcttctgaggtccaaaattgacctccttcttcctttctctgaaattcatataattatatgattaaacaaatttctactaagacaaatttggtataatcctctagctcttcatttgttattcattgttttaaaagtttcttatttgaaataaacagttagataattataatgggagatcatcttttttgagggcttttctgtatgctctttctagtataagtcacctctttctcttttactgttccttggcaagcaaaaacacaagtttaggaacaagccagagttatcaaaagttctacaggagtgaggaaaaaaagagcaagaggaacgcaggagaggcaactcacttgatgacatggcagaagcatccaagctgctgaattgttttcaaaagatggcaggcagggcccacagtgaaagcatcccatctggttgtccaatccaccatgaaaggggtcgagagtggtaaggattagagtagaggagattcccaggagctattgctggtgatggagggatgtggagactttccattgtttatgtacattagagaagattgacttgaaatttcataaatatatatcttatcttatattccttaatgtacataatggagaaaaaaacccaagagagcactccaagaggagttgagtttggatcaaatcctatcctaagcattatcctattttggagttgagatacctacattttagaaatatttttaatccagaataggtcacatgctaaatattctgggtaaatggtgtttatttgttcattgttttttttcttggcatgtggaagagaaatcatcttgaatcaattgtgttcattggccaaacagtatgataatttgttaaattttactgattaatgatgcagagtcttgactttcattgtaagtaaactcaggacacaaaaagcactaagagatgcccaaagtggttttctataatttaaatggaaataaatttgtatcgaaagtacactagatttcacatttcacatccttttagttttagatttaaaaaaagagcgatactttctgacttctcagctaagatttttatagtggtagtggttgttgatatttggtgtgtaaaacctctttatgctgctttagctatatattttttaagctgactttactatcaaaagcacttgaaatttaaaaattatgtccatgattaaaaacttgcagaagttgcccagcaactattttcattccccagaggcagagagtataatggaaaggaggaatttggggtgagatgtctttcttgtgtttaaattttctactctgaacttggacaagtcacttatcttcctaaatcccaattcctcatgtatttaaaaaaaaaaaaaagaggatgtcacaatcatactgcctattttccaggattattgtgagtatccagtgaggaaaatatataaaagactcttataaccttcagatttcttacacatacatataattgtttttaacacatttctgatctttgttcatatgtatatatggtttcaatcacaggaccctatacacatttgtgttccacttttcatatctaatgttatagttgtgccataatttactagccctttccctattgatggacatttaaatggtttacagttgttccctattataatagtgcagtaataaacatctttgtacattcaggcttttgtctttctctctttattatttttttttttttttggccaatttctctgggactagttccagaagggaggttgtggagtcaaagtgaatgaccatttttttaactaacctgtcttttgagcttttcacttcatccaaatatctttcccttggtaactttcctagaaagtcacagagcactcaaatgccttcttgaagtcagccagaaagattcagaatctacatttggtggccatatttccattttcaggctctttcagaaccactggcctgtgaggcctcccctagactgcaaggcccttcaggacaagattgtgccttaatcatgttggcatcctagcatggcctggcttgtcacaagaactcggtaagtgattaatcaatggagctaaacagagcagatgcctaatacatgataggctccttatggtcacctgacttgccaaagcattcattcatcaaagagtttttaacaatgtcaggcactggtgctagaaactggagacagagaggcaaatgtgacacaggtggcctcatcagcctagcaagcagagcccccctggcagtggaagagcttagtcttgaatctgagaattccttgagaaggggtccaagagtggagttgaccttggcccatgtaatgtgattgcagggaaggcccttgctatgcctaaatattttaatcatctaccccttaatatcagtcattctgtaacacagatcttgttacagagatggaggtgacagaaggggcctctgcaatgttatttgacaaccatatcctgtgtcaaagaacctcaagctctgttgtctgagccaggatgtgagaacagagttccttgacccagcagggttagggagggtttccaaatcccctctggagcagaaaatccctgtttgatcctatccagcatcataaggccacctgctgtgggcatgaatgctggggagggtggggtctctggccaactcaggaaagatctgattctgggcttttcacttgtgtataaatgaatgtgtctaaacattatatgctttccatttgcctattgctggaaaatttgataaagggtgcagaaattgagcaaatagttctgcaaggggatgtagaaagttttccttggcctcagactctgggctgtcttgcaactagttccttggaagtctgtgtaatttacttaaggctggatgaaaaccaatcctaggttttccatgatgcctctggtagtgctggcttagcttgaactctgtgggcagagattgtcaaagaggcagctctgctctaaatttcttgttattgttctctgtggaaactcacagagaacactgacaagtttctgagaccctaggttgttttatgttgaacactgcactgttgagtaaagacttggagttctctttatgagttagaatgttgtggctttccttttataatgctctgtaaagagctctccaaatttggctaaaaatttatacactttatggctatccattgtggtacaaccatatgttcagtttagaacaaataaacacacttgaacttataaacagatgaaactcagtttggtaatatttataatttgttttaatttgaccagaaaagtattatgtgcccaagcctgtcacttagtcaatggtcatcgctgggactgagcactgtttctgggtgtcagatagaaacattaatgatttgcgagtttcaaatgtccccagggagacggctctagcactgttgtgttgcatgggatattggaggcaatttcatatgtgcacatatagttagaggtttgcgaggtgtttattttttggctacctgtagatggtttcattatcccaaatttgtattgatgagcaaattcaaactttttcatttcagttcctatttcaaaagcgcctgtgtctgttttttctttgcctctgttaactggctctgaggtaggcatcctaatgcctgtttcccctgagccaagatcacatcttgtgtttcagctgcaagctaatagcctgtcaggagtatggaaatatatatctgaggtttgtgattctgcatgggatcaggatttccaggagtgcctgttggagaacactctgctctgtgcttctcatgtcttaatgttggttcttaatgttaattcaaaccagctgtggcagacccagttgttcctagaagttgctatctctgtctttcacattctgcaattttatatgcacatacattctatgaaacttcatgaaatttctatgatatttgtgtttcggagaatgctccttataactctgatttcatgcaaaaagttactgccacataaatggggaggtgatatcaattatgcagtactggattcaaacatcaactctgttacttactagttgggtgagcctggaaaaatctcttaacttttatgtccttcgctttcttgatctgcaaaatgaagatgcaaatgatcttggtttggagtcttctagtggtctacagtatatggatgcaacacttttagggtctgctccagttacagtaccaggttataaggattgtaccatcttgttttaaaaatgatatgaagttaaactctgaagcacttagaacaggtctagcacataataaacttttcgtatgtattagttactacgattaccataaaaatctcaagaaaatattaattctctgcttcggatattggacagaactctaattaaatctgatatatgcctaccgtgggaagctcactttttttctgcattgctagagcaataaatacaatcaaatgttaaaaaaatcatcaaccaaccaaccaatcaacaaaaaaaccaatccagattctaaagcaggagaatggcaatcatattcaccactaacacaaatttcacaaaacacaagcttatatcaaagagtcaattcaaacttccaatttaatactctcccttcaggaagtgctcattactcttacagccttcaaaagacagaaactccccacctgaccatggtctttgtcaatgtttttggaagctaaatgaaataaatatgttttagaatgaaatagggggtgacaaatatccccctctgcaatttttcattgattcctaccaattgcagcatcttggattaagaagcattccttctatttgtcctgacatctggagaacaggccacagattttctcaggcctccatcctggagtttaacagctatcactatatggaaatccttcttagagataatctccactgatgcgatttacaacagttttcttcttagccactcttccatgctcatcctttgaatgacagccatgtatggacttgaacctcacagtcctctgtcgcacagggaagaatgccagtgatcttgaataagactcagtttttgtgttgctggaagaaggaacagtatctgggtatctgaggttggttttgtttcctttattttctcaacatctttgagctttgtttgaaatgcaaaacctaattttaaaaattctgctgttggatatatcatttgaaatgtagaaatactctgaaaaaataaacataattgaaatagctttcaactattaataattttaaaaatacatggtttcctttgtctcctctatggttttgaaatttaacaatgggatatttgtcatcattctgcaggttgagtttttcagtccagcgtagagtgattgtttctgtttttattttatttctaaatttttatgcctgcagtggatgtgcgtgagctatggccttggggcctaaacagctctgggtctcatggagagcgaaatgagtgcatttcatgctttcgctttccacaatgtttattctgttaaagtaaactcaacttatggatgtatcattggttgtaattataccattcacataaaaggtaaataatttcaagtaaaattagaatggtatttttgtaaatccttgtactttcctcactgactttcaaattttcctctttcctaatttcatcctaattttctccaggcccaaggacattaaaggcatccatcaacttttccggaatcaggtttctctggataccgtttctgatttggaggcttgcagccatttttttccaagcataaaaatggcttcaactttccatagtaagggaaatctcagtaagggaaatcatatacccctaagtatatgcattttaattttccatgtcttgtcactgttatgataaaaaagaacaacagagtttgaaaactttcagtgattgtaattttctagttagaagtttattttgttacatggttctttctttgaatctcagctgtcttttgtaattagagtattcatcataacatgcatcaactatttatattttctcaataaatagtccttagcaaccaattttgtgccttggtctctttaaagacagtcatacaggtgtcatacccaccttttcctctagaatatattataacctgaataaatcctgggccttatgtcaccaagtttcagggcagtgtaacattcaaagaaacaaccaaaagcaaatgaaactctaagttttgcttgcagtcctcagaacgcattaaaagagattcaatttacagatcctagccacatcgtctaaggttcccccaactccacttcctcactgtcacagcccatctggagcccttgttctccactgccgccttcccactactcgccaacactgtccacttttctttgcctcttgtattctgtttttctagtcctacctctttcttcgcattctcctgtttctgtatcacaggaacccaggagtcaagttggggtagacaaagaagagaagctgatcaggcaaagacaaaattatctttactgggaagtggaggccttgagggttcagagtgaggctgcaaatactcagatagtaatatttttttgtaatattactgtcaccaaggcatttttacaaagaacaccaggatttaatgcagctattaaagttcttagtttactttgttgaactttccaaaagaggcaacctgtccacagttctgaaggctgtggcaatggagtgtgccctcagagaaacctcaggagataaaatcacagtcttcttctagaatgatcttataacagctagaagggcaaaatacacttttaagagttggagtctattccatcttataaggatgggggatttattaggactctgtgccaagattttccagaatttctctctaggagtagctaaaggagggagctgtctgagaggggattgctggggacaatgaaacttgggtttgaatagcacttcatgtaagatggaaagaacatcatttctcacagcaaagtattaggggtggggatgggggtgggtgatcaagatcaatgcagtgtcaaaacctcagccctccaatctactcctggaatttttacagagtgtgagatgtttgcagaccaggaggctttcttgcatttatgcctcaggaaatgggtcgttttataattcttgtggggttctttttgttgtgttgttttttgtttttaaaaaaatccctcttcctatacagaatcactattaacagtggtatgtgacttttcagacattgtatgtgcatacatccccacacacacctttatgttgttttttatttatttgtttttattttttaattttttttttttgagacaaagtcttgctctgttgcccaggctggagtgtagtggtgccatctcaggtcactgcaacctctgcctcctgggttccagcaattctcctgtctcagcaacccaagtagctggattacacaggcaagcgccaccacacccagcaaatttttgtatgttttgtagagacagggttttgccatgttggccaggctgatcttgaactcatggtctcaagtgatcggcccacctcagcctctgaaagtggtgagattacaggcgtgagccattgtgcctgaccatgttttaaacaaaaaaaaaaattgacgttatatttacactttaatctgaaatttgcttttttcaatttacagtttgtcatgaatatccatgtcagaatatttaaatgtaccattttttttttgagacagtatctcactctgttacccaggctggagggcagtggtgcaatctcggctcactgcaacctctgcctcctgggttcaagccattctcctgtctcatcttcccgagtagctgggattacaggtgcctgccaccacacctggctaatttttggtatttttagtagaaatggggtttctccatgttggccaggctggtatcgaactcctgacctcaggtgatccgcctgccttgacctcccaaagtgctgggattaaaggcacgagccactgcgcctggcctaaatgaaccatatttttttaaacagttattttattccgttataccatgatggaatcttgtacacaataattcccctattgttcaatatataggttgcttccaattttgcactatatatacaatactgcagtgaataccctgctatgtatatttttgacacacctgccttagtgtttctatactattgatttctaaacttgtagtttctaggtcaaagagtgtgctttcaaatttttaattgctgatgctacaaccccccgtcttccccaaagttaaaaaccctttgtcccaaaagtcaggggacttaatctggattctgtcgctgtttagttattcatgttgggcaagctgcttcttcacatctctgtgaaatgaggaaagtggaacagaagatgacctctgtgttccaatgtcccatgagcctttacctttacaaattgatttgcccaatttcagagaattatttagggctgtttcaaaccaatatgaaaatctgctctttaaaagattgttgagagcggagctaattttttttctgattaagctttgattagtaaacaaatccattaacctcctataggattattttgacatattcaagctgtgactttttctttcacagttttttgaaagctgagagccaccactgagcaaactctcatttaggccagattttgttttattttgtccagttcgaatcagtttgatggctgtgtgtttatgcatgatcttaaatgttccccagtactgggacagggcacatttgacctgttggccgatgaacagatttggttttaatcaagttccaagtcagataacagcactcatgtgatagtgatctttcactttaaggccatgttttgttcactgaaccttgtaaaaatcaaatacataaataaaatgaagaggtcaggaaagatggtttggtttctttcaacctactgctttttgaaggctcagggccaaaagaaaaggaaagtagaatgatagggattttgttatttactatacttaactgaataagtctgcagatgtctggaactatcctgtataaaacatcctattcaccagttcctaagagaccctcaaagagacaattcgagtttaacgcataaaatatcaaagtgggccagacgcagtggctcacgcctataatcccagcactttgggaggcagaggcagatggatcacttgaggttaggagtttgagaccagcctggccaacatggtgaaaccctgtctctactaaaaatacaaaaattagctgtgcatggtggtgggtgcctgtaacccgagctacttgggaggctgagccaggaaaatggcttgaacccaagaggcagaggttgcagtgagccaagattgtgccactgcagtccagcctgggcaacagagtgagactccgtctcaaaaaaaaaaaaaaaaaaaaaaagaaaaagaaaaaaagaaaaaaatgtcaaagtgaagatttgaaatctgttcacagcaatacagatatggttgagaattttgcattgatagggtactttgaggtccactctgcaaaatattatttgtaaattattttgtttgctagttagccaaaggtgtgaaacctggtgttaaaattgtgatcttggcttggtgcggtggctcacgcttctaatcccaatactttgggaggccgaggcaagtggatcacccgaggtcaggagtttgagaccagcctggacaacatgacaaaacccatctctactaaaaacacaaagtttggctgggtgtgctggcaggcgcctgtaatcccagctactcaggaggctgaggcagaagaatcgcttgaacctgggagtcggagatcgcaccactgcgctccagactgagagacagcaagactccatctcaaaaaaaaaaaaatggtgatctctctgtgatgtagggtcctgactagagtgactactgcacaccacatataaattattcctacttatagttaaggtgccaaagactggtgttaatttgatttttaaataaattggaattaattaaaaattatcttaaagtcactcggaaacacttgcatcctaagtgggagagaaagtgatggccattctcctgataagtcctgcctgcctccaggcctttgctcaagctgtttcctctactaggagtgctgttctcacagctggttcctattcttcctccagttcttgggttctgtgccacccacttagagaggcctcccttgagcacactacctaaggagagcccctcccttttattctttatctcagtctcttgtttcctttatagcccatgcacatttaattttattaattttctgcatgtgtttagtttttagaattttaacagctttattgagatataattcacacaccatacagtttgcacatttaaaatatacaatttaatagtttttagtttattcacagatacatgcaaccatcatcataatggttggcaattttcatcgggtaaaaaagaaatcctgtaccctttagctatcaccccatcatacatccatcacctctccatccctaagcaaccacaaatctacttcctgtctctgtagatttcccttttccagactttcatatgaataaaatcatatactatgaggtcttttgtatctggtttctttaacttagcctcatgtttttaatgttcatcagtgttgtagcatgtatcagaactttatccctttttatggcttaataatatttcaccatatggttatagtgtgttttgtttatccatttgtccattgatggacatttgggttgtttatattttttgtctattatgaataatgctgctttaagaatttgtgtacaagtttttatgtgaacatgtgttttcttttctctgtatcctgtatctaaaagtgggcttgctgagttgcttatatatatttttggatgtctcatttactacagtagaaactccataagaacagggaccacatctgccttgtcactcttactgccacagtacctggcattctaccttacaaagtaggtgatttgttagtaacttggtgaacttttcggtaaactaacatgcattgcacctaccagacatctggcatggtgctggatgcctatattagatatggcctgaaggagttactgtgccagaaatgtcagccccagcaccaacatcctcacacttactaagggaactaacccggagacccacctgcctatttcacaccacataacttagctcccacagcaagacttcacccttgagccataacagattagcccaaaggtgggcaaccagcacaaatgtagcctattacaaactggtcagtgtcctttgaggtacagcaaaaagctctacccaaacagggaattaccaagcctatcatgtcttgtttttaataatcctgaacctagtaatttgaatatataagaagtaggtaagacttagtgggagtagtttacaggtcattggcggagggaagctggtaggtcaagatgatcgtggaagttatacacaaccagaatgatgagaaagcaggacccggaagataaaaaatgtacttatagaatgaagacgagcagccagagagaaggagtatctgggtcaaggtgatgacaagccaatgacaaactgtatacactccttagttctgaacaacatgaggctttttctctttctgagacctggttgtttagcatttcctgtatgtctttgaaggcttggcctcatgattgaaatttctgtgtcctcactgccaagtgtatttgtaccaaccacttcatctcacaaaatcctgccctgttattcaaggttacttgagttgaggcttttttccttgcaaccaggaaagctgatttttaaaattcgatattaactacattttacagaagatgaaaccagagctcaaggtcatgttttagtaaagtgaaggttgtggaattcagaaccagatttatctgactccaaggtccaagctttttaccctctaccatccacccagatgtatttcctgactcattcaggagtttaactttaattgtgatagcaatattctcccatcagctaagtgaaccagcttggaaataagtgtattaatgaatttcttcactaaaatttaaaaatgcctttgtatttatgcatagctaactcctgagtttccattattgataataattaagaactggtttgtatatgaaaatgtgtttgtagcatacatttggcttcattatctccatcagttcacatcactttgaaattaaaatcaaatgagatcatgacacatacctgtcagtgacatgcaaattaaaaattcttggcaacatagattaatgatcatttttgagatttttctctcttttattaattttctcctcttgttttattacatctgggtacttattgaaggaagagactctgatagaggatattgttagtggagaaaaggaagcttggcaactttcgtgaaatggtgtgccttaaagaggaaggaatttacagtaaagcctcagggagcccaatgcttaggcaacagtctacaagttggtgaatatctctttcagattggtgttgtgctttacacgatactgtattacaaagctgctaaacaacaaatggtttttctacagataggggatctctaggcatctcaaggataggaatcaatttttcaaagggacacacacactcacacacacacacacacacacactctcacacattttacccacacatgcatatactgtatatacacacccacaatactttgtagaaatgctgccagtatctctctagactaaaagtagtaaacattctctgcagttttatttttgaattatgttgctaacctttaaaaatggggatatttcatataaaaatccaagttgttgtggtattattgaaaaattgcagttctggcagtactgggcctacatttccctatagcaatatttgtctgaagctgagtggaggctgtttctaacagccacacaggctgtctagttcatcattgtccccataattctctgttgtcacatatccagctggctgctttaccacacatcacgtgcttggctcatggagacatttactctctgattaggaacccagagttcctggccaggcgaggtggctcatgcctgtaatcccagcactgtgggaggctgaggtgggtggatcgcctgagctcgggagttcagaaccaacttgggcaacatggcgaaaccctgtctctactaaaaacacaaaaaattagctgagcgtggtggcacacacctgtagtcccagctactcgggaggctgaggcaggacaatcgcttgaacccaggaggcagaggttgcagtgagccgagatcgcaccactgcactccagcctgggcgacagagggagactctgtcaaaaaaaaaaaaaaaaaaaaaaaaaaagatagaatctgagcggttgaaggtaatctgtagctgtttgaacatattttgagacatgactgtcaacctcagatgtgtatcaacatttcctgtggagctttccaaaaatctaccttttatctcccacttcccagctcccctttcagattcattaggtctacagtggagtcagggaatctgaatgttgaaaaagcttcccatttagttctgattttgagtaagatggagtaagcacacttcatccacggtcttccccattgtatgtggctataaagtctagacaagatgtacgaaacaagctatttgaggactctgaaaaagtaaataatagtagatagattggagaagaccagaatttaagacaccagtgaactgatgatgagtttctcttttgtctgtccagtattcttccacttgaacccaacatagcctgcaacctggaagcaggcatgaatgcagacaggaaagtcctctagttctgtttcgaggaacttaacagtcagagagagtctctgtgtgtatgttgggggaggagggagagattcctcatttttcattttgtttttttccctttctcttctttactctctgtgccatagctcccaaacaatccaagatggccaaaaagagcctaaaacttggagggaggaaagccttcattgccacttggagaagtggtggtcccaacagactagggagaaacactgttgcctcttttttcttctgttttcctactcattaaccccatttctttcaaaacgtgggtagactgagcatggtggctcatgcctgaagtcccaacactttgggaggctgatgtgggaggattacttgagcccaggagttcaaggccagcctaggcaacaaagtgagaccctgtctctgcaagaaaactgaaaaaattagccaggcatggtggcaaacacctgtgatcccagctacttgggaggctgtgttgggaggatttcttgaacacaggagggacaaggctgcagtgaactgtgttcatgccactgcactctagcctgggcaacagggcaagatgctgtttcaatatataaatatatatatatctttataagtctgcttatatatataaatatatataatataatatataaatatatattatatatgtaaaatatatatatattcactctgttctgccatatactctccatgtctgcccatatatatgagtgtatatatataacatatatatatatgacagctgtttctcagaagatgatcaaacagctacagattacccacaacagctcagagtctaccccagctcattctaatattttatataaaatattagacatgaacatatatatacatatatacacatgtgtatatataatacacatgcacacatatatatatatatacacacacacatatatatatataaatattagacatggaacgtgtatggcagaacagagtaaataaagccccaactttatttctggtcagagaaccaaaaagagtcccagggaagctgaaaattatcagggatatcaagaaagagggtgaagttagggaaaatgacttttaaagttttgtagaaactcctgggctcacctctgatctgggcatgaatagatctgaccctcaacagtatatacaaaacttgagaactaaactgcactgcaaagtctttgaaaactgaaatcatgttgggtcagtttaccaaaaagatccaacggtcctaaatgtatatgctcctattaggataattttaaagtacataagcaaaaatggacagaatggaaaagagaaatagacaaatccataattatagttgaagacatcaacagtcttctgtgagaaactgacagaacagacagaaacagatagatctgatggaaaatcagtaagagaaggaagtactgaacaccatctatcagctagatttaatttacatttatagaaccctccaaccaacagcagaatatacacttttttcaagtgcatggagcattcacccaggtagaccacatcctgggtcattaaaacaaacaaactaactaaatgtaaaagaacggaaaccatgcaaagtatgttccctgaccataatagaattagactaaaatttaataacagagagatagcaaggacatctctaaatgcttggaaggtaaacaatatgcttctaaataatccatcaaagaaaaagtttcaagggttattgtagatgtcctttatttggctgaagaagttaccttttattcctagtttgaatggatgttgaaattttgtcaaatgattctttgaactaaattaaagatattttaaattaaattaaaatgaaaatacatcaaaatttgtaggatgcaggtaaaacattgcttaggagggaaattctttaatataagcattaagagcttatatttataagagaaaggtttcacatcaataaactatgcttctactttaataatgtagagaaaagagaataaataaacccaaggaaggaatggataaagataaaagtagaaatcaatgataatgaaaacaggaaaacaatttaaaacaccaatagaaacaaaagctggttctttggaaaagtaaataaaattgataaacctttagcaagaccaacaaagatgaaaagagagaagacacaaattataaacatcaggagtaagaatactactgtagaccctttagactttaaaataatactaagaggacactacagacaactcttcatgaataaattcaacaacttagatgaaatgggccaattccttgaaaaatacaaattatcaacactcacccaacatgaagtaatttgaatatttccatgactattaaagaaattgacttcatagtttaaaaccttccaaaaaatcctagtgcaaataaatatattggtgaattattgcaaacattaaaaaaattctaaataatatcttccagaaaaaggaagaagatggaaaatccccaacacattttatgaggctagcattacctgacactaaaactagacaaagatagaatttttaaaaaagaaaaatataaactgatattccataaatatagatgtaaaaatcattaacaaaatattaacacaatatatctagcagtatataaaaagaaaagtcagtgggatttactgggaaagtgaggctgttttaatatttaaaaatcaatcaatacaatctactttattagcagtttaaggagaaagaccacatgattacatcaattgaggcacaagatcatttgacaaaatttcaacatccattcaaactaggaataaaaggtaacttcttcaaacaaataaagagcatctacaataaccctacagctaaaatcatatttaatagtaaaagactgaacacctttcccctaagatcaggaacaagacaaggatatccactttcaccactgttattcaatattgcactagcagacccagccaatgcaataaggcaagaaaaggaattaaaaggcatatagggtgaaaaggaaaaaaaatatggattctattcataaataacgtaattgtctacatagaaaatccaaagtaatacacacacaaaggtcagaggatacaaaatcaatactcagaagtcaattttatttttatatactatcagtgttcaattggaaactgaattgaaaaaagcaatactatttagattgctcaaaaattaaatacttagctgtaaatttattaaaatgcatacatgatcgatatgctgaaaactacaaaacattaatgaaaaaaagtctaagaatacctagaaggagagacatacaatgttcatgatcaacatagtaaagatgtcatttatttataaattgatttatagattaatacaattccaataaaaatttccacaggatattgatagatataaacaaactggttctaaatttatattgaaaggcaaaggaactagaagaggcagaacaattttcaaaaacaagaaagctacaggaatcacactttatttttttctttttttttgagacagagttttgctcttgttgctggggctggagtgcaatggcaccgtgttggatcactgcaacctccacctcccaggttcaagtgatcctcctgcctcagcaggagccaccaccatgcccagctaatttttgtatttttaatagagatggggtttcaccatgttggccaggctggtcttgaactcctgacctcaggtgatctgtccaccctggcctcccaaagtgctgggagtaatcacactttctaattaacagaaagcaatgtgttattagcaaaggcagagataatgaagcagaatagagagtccagaaatacacctaaataaatgtggctgactgatttttgacaatggtgctaaagcaattcatatgagaaggtataatcttttcaacatatttaaagagttaaaacagttaacccaattaaaattatataaaatgttttaacagatacttcaccagagaggatatatggatgtcaaataagaacacgaaaatgtgttcaacatcattaaccattagaagatgcaaataaaactgtgatgagatactgctacataacaattagaattgctaaaataaaaattactgctaataccttagtgttgatgaggatgcatatcatctagagctgtcatatagtactgatggaaatgccaaatgggccactctggaaagcagtttgtcaattgcttataaaactaaacagatgcttaccatatgaccctgtactcccactcttattctatagctacagaattaaaactgtacacaaatatttatagcagctctattcataatagcccccaaaatggaaacaactcaaagtccttcaacaggtgaataataaactgtgatatttctatacaatggaatactactcagcaattaaacagaagtactgatacacacaacttggatgcatgtcaaatgattttgctgaatgaaaggagcccaactcaaaatgtcacatactgtatcatcccatttgtattatgctcaaaaagacaaaattatggagacaaaaacaaagcagtagctgccaggggctaggggtggagggaggtgtgtgacttcatgagggagtttctgtggttgatggaaatgttatgtttcctgattgttgtgctagttccatagatctacacatgtcaaaatttataaaacagaacacagcaaaaagtcaatttcactgtaggttaatttaaaaccttaaaatatatttcaaagcttccctcttaatcctaatgtgctgtgcagcttgcgtaccacttctctggagcaactaccaatgctagacctctttatcaactctcctccaaaaagttagaacttattttggagaatcacagtaaagggcaagtaacttgcagcagaagatagacggtcatttcaaagcaagagcagtagagagtctgagagtcctttgttctgccaagtcaaacagaaaacataaatatttgtatagctttgtaacaaaagagcaatatgggttttggcagaaagacctcttaatcgcatttaagactttaaagtaatggagccctgctcctattatgtggaaattgcatgcagatgtagtgtacatcagggatcagggtcctgtctgagggagacaatgttaaaggtaaaacccagactgacaaggagggcaatctgtctacttgtgcagatatggtggagcccatttgctttttggcactggatcttgaggagattgcatgtgctacttagaagagtctctctctttctttctttcttttttttttttttttggatcactttgcagttgtgagttcatgactttctattttcagttgcacagatagccttttagttcaaggatggggtgttttgggatcaaagacagaaatattgagctatttggaataagtagagtggtgggcattgagggagactgggatttccagtactgcctcatccccacccatccaactgcaagtctcacatcctctctgcttccaaaagggagatatttgaccctaacttctctttccataggattcagtcaaatgctagtgcatatggttatgatataaggaaatgggtcaagtagaattattggggtgctagaagcaagaccaattttagattacttaaaaggaatgcaatggaaggataaggagtaacccagaatcaatgaaaaagctggtctcaaaaataataggaacctaggtggtaggaattatgtatgggcaatctctccagagaattatcttccagatcaaggaagaaatgacatacatttcccccattctcacttcactcaagattcagcattttcttagtatgagttgagtcgcatgcccactctttggccaggcaagaggagatcaccttgagtgacatacactggggaggggaaaagttctacaaaagtaaaccagtggtctcttgtcttcagcaggggttgggtatttgaaaggcagaaacaacagctttcagatcaccatggtgggttattctacattttaaactaaacacccctggagggtgtacagataagcaaagaaggggtacaggaaggagtggaaaaggtggtgggtattatggcagaaagagcaatagttttggaactagacctggaccagaactcccacagggattggccttcagctggcattacgaccccagggcaagtcagttactctgcctggagctttgctttcttcatctaaagactgaagaggctgaactagctgtcccctaatatccctttttgttacaaatcttaagaaatatatactttgggtctagggccataacttaatttcttagctgagtataaaactgtgttaaactcaataggattttttttttaatgcttatagcagtggtcttcaaatgttagagtgcgtaagaatcttatcaggattagataggtggaaaaaaaaatcccttgtaaaatgcagatttcagggccccatccccagagattctgatccattctttctgaacagaacccaagagtctgcatttttaaacaacgttgtcaggtaattccaatgcaggtgatcaaagctaaagacctgcacaccatctgtttgattcccagtccctagaaggaaaccccatccattggagctgcaagcacttagaaaatgtttaaagttgaacaactggacataccctttgaaagctccctcctaggctccctagatagtgtgaggatgcttggaatacagcagacaccagggtagccaggggctccaccgcctgcatattgggacacaacgtggagatcttgcattctctccttacacttgctcactcactctgactcaagtgtagccattcaataaacccaaagggtagagagtctgctgtgagtaccttgtgagttttccttattgttctgatcgtatgaagaccttaaatagaaccttttcaaattctatgtatttgggctcagcagtgcctgctttagtaaatttctggttgtaagaagtttaaccttcaggctaaacatttacactaaacacctctcatttggggagttacactgaagggagtgttgtccattgttttcttacgtgtagttatttgtgctctaccatgtatctggggatctccaagtgccttttaaaagtaatcagtttcgcatcaaggtgttccttacagacatgtggtttacaaatggtgaaggaatattttttatgtgtataaaatgcctgagtctttccctgtccactaccttgtatgatgctccattaaaatgtagcatggatgccaagagttccttggctttttgaggcaagatagaagagattggtcatttggcccagtatgtccttccaaatatatccagaggcctgaccaaatgaaagtgaattataacaagggtgaaagtaatttaaataatgtcacaacttatactcagttacatccaaggaaaccagttgtgtattaaaaccaataaatagtaatttaaaaagtaataattcaaggaggacattaccacaatgtttgaaataactatgcatattatatggtttacaatgtgcaacacactttcccatacattctcatttcatacaccctcttgtcttcgttgcgtccaaccttaggatagagagtgaatagggaaacttggtctatagcctctaacaacatgggcaaggcccattagggagaagaactctttgtagaggactgatcccctatttctttctgtgttctgtttaaaatgaaattgttgtctctgttcagaagcctgattggttgtgtacgtgctgtgcgtgtctctgtgtgtatatgtgtttaatggggaaacgaaggctaggaaaggagggagataaatttatgaaggatgaagtctacaggtttttattcttgctttatttttcactttctctaatactggggtggagaagctctgcatatactttggcttcatgaaatgttgacattcgagagaggaataaaagtgtttattctctagagttaaaaagaaactcaactcatcaagtgtgtgttctgttccacttggtcttataagtcatttgccagcaagatgagctttatatcgtctctctggtaaaacatcctcccatctcctgatcggcattcctccactcttttgcttcataaattagaagggaggatgccattgtaatacttgaccttataagggggaagagtggcccagccgttccttagctctgccctcctgtcagaactgtatacactctggaggccttttaagggaacgtggtgcgtgcagggaaaacatcccaaggcagaccatccattttctttgctactgcagagttggtgcctgcaagctctgtgtgactctgaagcataaatcataaggggttgctggtgccaagccggagggagggacatgtctgaggatcatgctcactgccaaatgcagccgacctcttagttttcactaaaatcccatctcaccactggccttctgacttttagtgaaaatttcacaagttgcacatcctgacattacttgtacttgcctccctgttgtgaattataatgatggctgcagagaagcaaccactgcctccttaaggtttcagtttatccttcctgcgctgtaccattcacttctgtacagtgaggctcgagtttggagagagagagagagagagctggctttgaaccacagggcttttttgtactagctctgaggccttggacaagtcatataacctctctgagtctcaatatcctctattaagaatggggaggataaaggtgataacatccttttatagtgtttagcacaatgcctaacacatagtaaatgctgaaatgttagctgttattattattattattactactagaagaaggctatagttttggtgtttgcagcaagtatttcctacagttccactatttcaatccagcacgctttttataaacaattttttataggcaaaacatatccagaaatacccatagaggtccctaagaacatcttggcatgattcagtgtacagagaatgggttctggaattggacaggacagggcctgactccctgcccggccacttaccagttcatagctttggacaaactatttaatctcttggtaattcagttttccagttagtagtctgaggatactggttgtttaaatacaggcatttgggttgccaggggcagaaacaaattaaattggagcaaagaaaaagaaagggtttgttgcaaacctatagaaatttcactgaaataaactatggtttattttacaagatggggaagagggaagaggaaaaggggctttgaggggaggaggggcttctacttgtaggcaaataggttgtcttctccagtagcttctaatcctagactcacttccttctttgaaatccacctttttgaagtatatttcccagtaaacaaaagtctgcaggagaggctaaaaatcacagaaatgtgacagtatgtgtcctccaaaggtatgaaccctctgttctgggacaggtctagcagtagcaacgctcttcccagggcacccaggtagccgagtcacccagggaggggttgtttggggagacacttagggaaggctgcgtgtagcctctcttgagacccctgcaccttcatgcacagcctgttcccacttagaggcttccacccagcacccaagagtcatgctaatttcattaacaaacctgcattaaccaggacctctcttctcttctcagttagctcaggggttctcaaactctttttctgtgtgcagccaaagtccacttgcagcaggagcaccacttgctacctgcagtgattttcaaagcagctggggctctgtatattagaatctcttcactcctgagtttttgataatccttcttacgcccattggaatatagtccagagatcattgttcaatcaataggcacccctcaagccctgttcattgccagaccctgaactgagttgatattcagagaaagacacagcccttgtcctcctgaagctgctggagatgcatgcaggggacagcatagtgtgaaaggtgttgtggcagaaatgctctaggtgctatgggacagcagattgtgggctgattgtgtctctctggggaaccccaggaggggcctctcattctagacttcttcacccacttgggctactatagtaaattaccatagactgagtggcttataaacaacagaaatgcatttctcacagttctggaggctgggaagtccaagatcaaggacccagcagattcagtgtgttgcaagggcctgcttcctggttcatagatggctgtctttttgctgtatcctcatgtggcagaagggtcgagggagctctctggagtctctaatgtaagggcactaatcccatttatgagggcttcaccttcatgaactaatcacctcccaaagcctacctcctaataatatcacgttgggggttaagatttaacatatgaatttggagtggacacagacctttagtctatagccctggggctctagctttgcttcccagaagctgagactgaaaggacaattaagactcagctagccgaagtgagggaagcagcatcaccaagccctggagggcaaaaagaatggcttgtctgggaattgcaagcctttggagtccctggaaagtaaaattgaggagtatttcctcaagagaggagagattcttttcctcaaggtgaacttcagctatgggtgccctctgatggggaccccatggtcagagagctttcaactcacacaggcaccttcccctacccaaggtaaggatttctgcctgttaagtgatagctgcatttatggagtgtttatcatgtgtcgcaactgcccccatctctgcctatgagcacgtgaaggcttgtagaaaagcagtgacttacccaagtccccaaagctagtgaaaggtgggcatcaggatttgaacccaggtttgtctacccaaggagccagagcttgtttcactctactgcacagcctctttaatcttagatgcaggaactgaggataagagaggataaatgactggcttacaagtgtcgcagaattaatagtgtaagagtgcaacttcaaaccccagtctgtcagattttaaatccagtgagatgcttacagctatgggggtagggtggggaggacaattgctttgcttacatttaagagagatgtccaggggaggcaagagttggacctcagcctgctggggtttgaccagtatagtcagcatgctcacatggtagactctcataccagcaccaatgttcaatgtcagttcaagtgtgaaccccttttgaggacctcttaaacactgtatgatacatgaatcaaaattcagctattaaaattgtgaatagagatatacaattgcatatgttaattgatcattgtcatttgtgtacagtttgtcttaactattttaaacttgcctaaaaacaagaatctctagaaataaaaaataaaaacaaaaacaaaaacaaaacaaacaaaaaaaccactgcttttaagtactgacacctgggctctaaccaagacctgtaacccagaatattctagcaaagaggcccaggaattcacatttttaattagcaccccaggtggttcttattatcaagaaagtgtaaaaaactttaacctcttccgaaggtgaatgatcaagtacctccagctcccccaactcagaatgttttacagcttgccaaaaagagggggaaacactgtccaagcttgtttgctaggttaggcctttaaggccactatctgggaattccatatgtgtaatcatactgtaagtttaataaaagtttacatcatatgaagtaaatttgccacttttatttggattggatatgcacatttggtttcatgaggggggaaaaatccactgtcatatttcatccagctagaaaatatgttataagtgaaggatcatttctcttttctgactcttggaacattgtttcaagattttcagagaaactcagtcaatagcttagtgctgggttagtgtgctgggattgcatgtgtctgtatctcatattcgaaatctgcataattaactgcattggaaattgacagagaaaatgtgagctgactgagagaattctgggatggaatgttcggaaataaatttgtagaaccttatgaaagcaaaaacaagatatgcagaatattgtaggaatggtggaggattcttcctgaaaccttattgtgcgagaaataacctaaggtcctgctgagttaaactatccttctgtgtccccaaaatacacagccacctacccacttgaacatccatacacaaacacatacaagcatacacacacatacacacatgcattttatccctcattggcactttcaaccccttgcctaggactgttgatattcatgaacccacttaaagacctgaaaacaattataagctccaaaatgaagacatccgcaatgccaacacgattaactgcgtaattgaatatgtataaaataccacatgttgtcactttattcttaaatttaatattcaagaaatcactataacactttagaataatttgtaggatatattttcttcttttgaaaggtttccagagtgtgcgtgagcaatatcattgccaatagttaattaaatgagtgacttgtagcctcgtcatttcaaaagcaaaattataaaaattctttcaagttcttttggagcaaaagtagatttttatgtgagatgtggacatattttaatatttttggtatgatatgggatggggcctcataaacacacattcagagagtttaccaccaccgaatgcttttgcacagggcacacaattggaaaaaataaaatatgccattcaaagttgggtctttaacagctcaaagatggtgaaaggctttcagggcctctctccattgtgtgactgtctctgaagggtgtagtctacttcctgctacaccagaattgtccttagggaacttgaggacagtagattctactctgcctgaattcaggtgaggccaatggtgagctgctgcatccagttgcataggatgtgcactgtgtaagggcaccacataccaagggggcattattcccattgcaaacaccctacacttgaatatttattatgacagcgcttcagcagatggcattaaagtgttctgttctgagaaactcagtgtgctacaatactttttaatagccataaattactggatcttgaagaagggatacctttagcacaaaaggcacagcttgggcttcagccctggcctgacagagagagaggtattcctcctgctccattcacctttatctccctccactgtaggctgtgggattttgacctaaagggactgctcaccaaccccctgccccaccacaagactgtgcccctgaagcagttccaagctcagaagccctggagtcttccattcctaccagccctttgcccttctaccaccagcaggcttgcttgttttctggcagttagtccctgaagtaaaagctccctgcccttctcttagtaggaagtttctcctaagcaccaagagcccctacacggaatggaaccacgcagaccaacatggcccttgcctcagtctccagagaaggggggagggtcagttaagtggccttctcatctccctggggagtctctgcttctccagttgatctcaggaacttcctgttctcaccaacctattttggtctctgtctcccatagacgactagaacctctgagagaggatcggtctcagtgcaggtagcactgcacgggtgatcctgaatgcaaacagctgctgttcccatctccttcctcttcccctaccacatcctctggatctgaaccccagaacaagactgctcaggggaacagagaacatgtcactcagataccaaacagacgtactgtcagccacattcactagccatgccttcagctgtccccactaggctagtcccagagtggatgctaaggcagggctgcccttccctgctgagttcagagcttagtgcaaactaggacctggaggaggggtatctctgcttccaaggcatcaccttccaacatctcctttctcaaggctctttggacaagacatcttgctgggaatccttgatgtgagttaaaagcatttaacatagtccttcttctcccttgctcttcaaaagtgttcagtaggagtaaattcccttggaccccaccactatcatagtcctatgaagaaaatattggttggtaaatcttagccagcattttcccatgtgtgctgaatgaaaccaccaactccacaaggtgctctgtgtaaatgtgagaaatgtatactctaccctctttgtgaagttttacaatgaaatgagcatttggttttgaaatatcctgccaaagtagagagtccacttttaccatagtctcttaccttttcataataaatttatagcactggacttggtaaattaacatataaggttattaaccttttcagccaaccctttgtatgtaattcctttggaaattcatccaccatcgcttaattttatcttaaactttctggtttggttttgttttttgagacagggtcttgctgctgcccaggctggagtacagtggcataattatagctaactgcagccttgaactcctgggctcaagcaatcctcccatctcagcctcccaagtagatgagactacaggtgcacaccaccacagctggctaattttagtattttttctttttttgagccaggagttttgcctagggtggtctcaaactcctgggctcaagctatcccccctccttggcctcccaaagtgttgggattacaggggtgaacatgctgtaatctccctccttatctcaaactttcaatcatcccatgtatttgcttccactggtattttaagaccaagttctggaagcacctttatattaatgtaggaggagtccatgttctgatgggccccatgaagtttgcatgaaatgagcaagtgtctttaagcacttaccttcaagagactaacggattagagaaggagttaggtgtcccagcatctaaggcaatatcctgtgctgagtgtctaactcctggggtttgcagtggcagtacaaagagaggactggccagataaacctggaaagtaaggaagcggcctaagtccaggagggggtggatgaagagtgtactggtgtctttcattttccttcaagacctccactccatctctttctctctgctccccgtcctgtagactgacctatagggactatcaagagatccccacccttccctccagattttagttgggcttgggcaattgggagcactgcagttactagacagaaggaggagaatgcaagcagggatttctttctctccctataggatttccataggctggaaacatgactcttctgaaggtcaaggttcctgccaagcagccctatccacacagatctgtccctggatttcagtaatgaatctagggatgggacgctggtagccctgatgttacttgccctctccactagccacacctgtgtaaacagttcctgtattaaactctcaaactactcagttttgagtgtgccatcaattctgttggggacctcattgatacaaggagtatccctacctaagtgaacgatgtgtgcaaagaactgaagtggcctggtgcttgaagggggctccatctcaaaaatagtttgttatggcaggatgatgccgcagtaggagagttcatgaggccgatcactcttgccgatgcccacggagtgctctggggatccagggctcccaggcctcatcgcatttagtccccactgagtaaggagacatattatcattccattttgtaggtaaaagatccaggcttatggaggttaagtaacttggccaaggttgcactgcaagaaggggtggagctgcgtggggactgagagtccctactctcctccgtgctaagacattaaactggattccacaggcagcgcatgtttgcctgcctttcctgctcactcagccttagcttttgctgtaaaactctcacgtcccacaaaagaacattgacctttccaatattccctttcctcgtaactatgtgtcattaaactgaagtgtttctttaaaagacattagagcagaattagtatggcatgacctttccttatgcttcctgataaaattaaactcaaacctgggtgaccgaaggaaaccctgggaaggtaaatgcagtcttgaagatggttcctttcaggcagggtggctgcctgtgcatcccttgatatatgctcgtcttctcggaaccatgcagagagagctgcctgtgacctgatttggcttcataggaaacagcaacctgcgtcatccattgggtcacagatcagagttacacgatgaaatgaaacaggtggaatgtggtgttcaatccatggtattctgaacccaccatggacagctgacactcacattcccaaagggaatgcaaagttttgcatgttgccctgctcagggcatctccgcctggaatcggtagagttttggccctgagagatattaatctattgtccaaaaaacaggaactccctaaagagagccaaaaataagaaccatacccaggactgatgaattcttttctgtgatattggtggacaggttagcaggagaaaaggaaggggaaatgttcatagtacacaaagtataagcatcatctcttagttaaaaaaaaaaaaaaacaggaaaggttttgagttctattcatgtaaataaaaggcactaagaatcttgggaaatgtccaggctaattaattacagttggcttcaggagcatgcacagacttgccttctgccatcagaggcatagttatcggggagggtagatcttccaagttcctccacagccctggtggcattggtgggttctggctgcttctctgagccaggtggtggtgtgtctcttcatttagtctcattaattcttcagtgttgcaaatatctgaaacctgttattaaagagctggaacgatatcccactaggttttcaatatggactattgatgaagaaacagtaattggaatagcaggggtctgagataatattgcaagacaaaagaacatacaatttcttttttgtggctcttttgcattctataatttggtggccttggactatggctgtttgtcgctgtagaaataaactacagcttgtctagtgcctttctgatggataataggttgcttctgatttagctctatttctctttcacatatagtgtggtaataaacatccttgaacctcatcttcttgtgcgcgtgtgttcaagtttctctaggaaagataccagagaggggtttgctggattatagggcatgatcaagtctactaggaattctcaaacaactctgagtgtaaagtgagtgtaccaacttataatcttgctgtctttttttttcttttctgttttcccatgatacttcaccaacatttggtattagattttttctttttttttctttttttttgggggtgggggggtggcaggagggacagagtctcgctgtgtcacccaggctgaagtgcagtggcgagatcttggctcactgcaatctccgcctcccaggttcacaccattctcctgcttcagcctcccgagtagctgggactacaggtgcctgccaccacgcctggctaatttttttttttttttgtatttttagtagagatggggtttcaccccatcagccaggatggtctcgatctcctgacgtcatgagccgcccgccttggcctcccaaagtgctgggattacatgcaagagcactgtgccctgtccttttttttttttttttttttccttgaaacagaatattactctgtcacccaggctggagtacaatggtgcaatctcggctcactgcagcctccacttcccgggttcaagtgattctcctgcctcaacctcccaagtagctaggattacaggagcccaccaccatgcctggctaattttttgtatttttagtagaaatggggttttgccatcttggccaggctggttttgaactcctgaactcaggtgatctaccctcctcggcctcccaaagtgctgtgattacaggcgtgagccactgtgcccagcctctttttttcttatttggctaatgtgatgcatgtgacatgatacctggctgttattttaattttcatttccctgatttactatatattttcatattggccaatcagtcttcttcttctgtgacttgcttaggtcatctgagtttttcttatcagtttgtaggacttcttcatttagattagccattaatcctttgattttatgcattgcaactatcttctctcaatctatggcttacttcttttttttagtgtctttgacaaatagaaattttataatttttaatgtgattacgtttatcaatctttttcttatatttagacccaacttatagaatattctgcccattctttattcccccctcatagaacatgggacagacagtgaggtccctgtggccttgctgaaacagaatccaatatgaaataccatagcaaggaacaggtatttgctttgggaacactgataatgccattgtatttcagtggatacccatgcctcacagaattactctgttactcatagagtagtgaagcagcattatacaaatactagtcttctctgttctttcttcttcttttagagtgagtatccatttatagttgctgtatattcatttaatgtccagtgcctagatgtgtcctttccctcatgtcttatgacatagattcaataagatttctataatactatctaagaaaacatgctaattggatatagaaaagagaacaaacaaaaatagtttaagagacataaaaagctttgttttacagaaatgctttatctcctgggttggagctgtcatgtcagtaattatcacttttagtttataggagtgaatgaactgattttaaatcttccaagagtattatataagtcatttttttttaagcttcagtaagaggtctgtataacttggaaaatacaaagcaaagcaaaacaaaacaaacagataagaagatgattcatgtcttgctagtctgggaacaatctcatggaagcctgaaggatagctgacaattagctcttgactatctctcaacttagctggagcacttgagacttaaaattccccagccctagaccctcggcaatgtattttctttgaaaataaccagagccaggaacagcttacattaaagtgctcaagcatcaaggctgtaaacacagacagttgttaattccccagatgtaggggtccagattatttaacagttgaagagagtgaacctgtggtagtttcaattttacattttttttttcttggatctttggtcaatttcctaaagccaagtttttcttctttcaattaaagttaggattttcagaaatctgcctgcctatgttgcctaacaaaatttaagatctaactgggaagagtcctcttcttttccccatgacacctacctaaaatgaaagtggagaagcttctaggtaaagcggcaaaggcccatggggttggggtccacctttatttgttttataattggtcaaactctagaagtttagagatactatgagacatgcagttatcttttgctttttcttttaaatattctttaaatgatatatttagttccctttggtttaagtgaaatgtccagtactaagagcagtgataatatcgcaactctgtaggccattttgcaaaattatatactatcccatttgaacctcacaacctctctgataagacaggcaaggcaggggttatttaatatgtggattttgaagtttagaccaggctgaaataatggaggccccaggattgaatagcactgtgctaaaatttatatatatggttgaaaaacttttgtagttatcttattttgatagcctcatgttttatgttcattttattaatacctgaaagtgtgagttgttccatccaaaaaatgggtttaagagtagattttaagattgctattagaaaaccaggtttagctgaactctgcctcattcatatatgaaccaggtaggctttcttgaaaaggcttttaaagtgcaaactcatataagccttttaccatacagcagccccagccagcagtgctagacatcaaagaagggatctgggagtgaactcatcaatgtgaaaatattgaagagctaacttgagggctgttgtgtttaatgtctgttagacattaaccagcatatccaggatgctattaaactccatcttcagtagtttgtttcttgggattgtgtaaacatcactaattcaaacatgcacttagtcataaacactgcagagagctttttcttttaaatatacttttaattgaagtataatggacatacagaaaaggcacaactcataaatgtttacttcaaggaatttttcaccaaatgaacacacccgtgtaactaccatctggatcaagaaacagaatagcacctgaagcttccttgttccccattctgatcatttattctctctcctcctgagacgtaaccactattctgacttttcccatcaatgatgagttttgtctatttttgaatggtacataaatgaaatcatagagtgtatattcctctgggtctggcttattttactcaatgttatgagtatgacattcattcttgttgtttcatctaatggcaggcagttcatttttgttgttctatggtactcctttgtgtgaatacaccacattaaataaatacaccacagttggtactaatttgcatcccttcaacagtacattagggctccacatctttaccagcacttggccgtaccactctttccagctagtcttgtggatacatagtaatatttcactgtggttttaatttgcatttccctgatctctagtgatgttgcatttccctgatctctagtgatcttttcatatgctaattgttatttgaatatggtcttttgtaaagtgcctgttcaaaacttttgcctatttttttaaggttatctgcctttaaaaaaaactaatttataagagtttttaaaatataaactgcatgtaagtcctttgttagatatatacgatgcaaatatctttttctaatctgtgtatttgagggtcttaaaaggggtctgagagttcagtgtgtagaaaatagtaccatgggcccttcttggctcttaagaaagtggacatttgaagatagaggaatggaagagagacctggatcttgtgctctttaaatctatcacaactttcttgaagtaggattccaagagcagctggatatgcctcacacacttgatatgatcagtctgtgtttttttggctactctcttgcaaggtaaacagagccatcaatatatgatattctggtagactcttatcatacataatgatatagtgctttgggttaataaatatttgaatacctactatgagcaagcactggccaggacactggaggtgcaaaggtggatatgtcagcacccctgtgcttagtgagctttcagggcacttttaaggtacttttgtatctactatcctgtttgatcacataagggtagggtgaccatcagactggtcagataaaaataatgtatccttttgctcctcaaacctttgaggatcatttagtcactgcccctcattctgtaagaactgtctttctaagatatgcctttgccacatcctgatagcctcactaattcatacctggagaaattcttttttctcaaagtgactaatttagataaagcatgcagaaatgactttatattttaaagaaagctacaagagtcaaagaccataaaatagatttacttagtcccctgctatttaacagcccttttaacaactccttaaataatatttattagtcaactgaaatcatatagcatttattgagggcaagtctggagaggcactgttttattctagacattgaaggagccatgaagacatacaagatgcaattcctgcgctcatggaagttctagcacattggtggtggtgatagtgtttgtgtgtggagggaaagtgttcagtaagcacacagcatattcaagaacaatgtgaacataaagacccataccacggaagctccgcagcaggaagggtcacgttggattgatttcagtgatgaggaaaggactatactcattaagatagtgtcgctgctactataaaaatatccccaagatgtataaccactcaaacacataaaaaggtgttttcaatcccctaaagttaaaaacaggtgttcctgattcatagttgactctgttccaaatggtgattcagagatccaggtcctcccctctcgtgggtcagccgccttcaacacatggcttttaagattgctgggcttgtccacatcaagctggcagaaggagaaagaacatggaaaatggaaagatcttataaccagatctgaaagaggagttccattggctagaacttgagtttcattggctagaactcagtcacatggccacagctaatttcaagggaggttgagaactacagtccacctgtgtgtctgaaaagatgagatggattgttgaccacgtagcagtcgttgccacaggttttgttatggtctggatgtttttgtcactttcaatattcatgttggaacttcagtccctccaaaattcaggtgttgccaatgtgatagtattcagagatagggcctttaagaggtgttcaggccaggagggctccttcctcattaatggcattaagacccttataaaaaaagcctttacacagcatttggctagcttttcctgctgcctttgccatgtgcagcaagaaggccttcaccacaccagatgctggtgccttgatctcagacttcctaacctctagaactgtgggaaataaatttctattttttataaattatctagtatcagctatcccattataagagcacaaaatggaataacaggctttatgctggaaaagcatttaaggtaggtcttcaggcaacttgaagtattctgacagacgtgggaaaggaggattaatccaggaaaaatgaatagcataaagaaggactgggcagtatacaacaacaaaatttaagggcatatttggaaaataggaaatcattcatcttgttagcagcatagaatacatagggagtagtgtgggagaaactgttggaaagctaggttgatgcaatttccaacctacgtcacattttaggaggttttaaaattctgactaaagagttatatccagcatagttttcaggctccttctcactcgcaggaaaaaatgtggcccaggttacctttctttttttcccttcacactctggcctttcctaggaagtgagttctcatgtttatctccccgacacaatggcaagcagttagggagaagggttcagcccctcagcatgggcagcttcgttttcagcttttgtactagagaatttcagagattccaggggctttctgccaaaaacccatctaatgcatggtatctgctgaatgctgtgtttgggatgaatcccaagttcaggagagggaggagagagggaaattcctttttgaccctaggacacaattaactcatacccaggatcctggaatttgattacccatattgttattttggcttggatagctgcaactgtggctcatagttataaaagtatccggtcctttaaaatccagccgcagctttcagcttgatgacctcctgactgattaattggaaagggtgggagctggggaaatccttttccctcccttcagacctgccaacttggctttgaacctacaagaatgttttggtcagagaacatacatccccacaccccgtaccctccctctcaccctcacctctgccccatgttgcgcattttatttgttatccatatgcattcatctttgttgaattaactttgacccaggcttgactatgtgctgccccagaaggcttctgtgtgacttattctctcttccttgagtttctgatgatgaaattcatgttattctgaccttccatagccttctgaccatgaaaataatgttattataaaggtaaatgaaaatttacctttgctgtatagtttgtgggtggtttctttcattgttcctaccagaatgtaagcatgattctatatctttcttaaaccattgaaaaagagagaagacggaatatttgaagtaacagctgaccacctgaaaagtgcttttcaatgcaaactggaagaggcagcccacagtttttcagtcctgagcacattcattgtatttggggtttgtgaaaagggaggtgttcaccttcccatggcaagagtttctagatgttttttttttttttccttatttgaccacaaagccaacctaaaggaatcattactatgcggcgtattttatcctgtgtttgtctttcttcctcttctttctcaagaccctcattgatcccactctacggtcatcccctgcactcacagccttcaaataactaaatcttgctgttcgtaggcatttggtgtttttctctttcagttgctagctctggggaagatgaaactcttcaggccaatgtctgtggtaccagctcattccctagcctgctttgagatctacatccttcatgaagcactaagacatttgaagagacaggatggtgtaatggaatggaacatgaggagaaattaagcagatctgggtcccaattctagcactgccccttacctctgtgaaactttgaacaaaaacttgacttctctgagcctgaaacttgacagcattgataagttttcgctgttttttaattttatctaagtggaacaatacagtatatacacctttgttactgatttcttttacttaatacagatgctctttgacttaagatggcattgcatcctgataaacccatcttaagtcaaaaatattgttaagtcaaaaatgcatttaatgctggcaatacagcagacagtctctgacatatgacggttcaacttaagaattttgactttatgatggtgcaaaagtaatagccattcagtagaaaccacaaccccaccataagtcataggagctcctcaacttacgatgggattgtatctggataaaccaatcataaaggggaaaaattgtaagtcaaaccatcataagccagatcctgtctgggttatatttatgagattcattcaaattgttgcatgcggcaatagtttgcacaataggatttatggtattacattgtatatcacaaattatttgtccattctactttgatggacatttggattgtttcagttattacaaattgtgattctatgatcatacttgtaaaatcttatatatacaccctgttgagcaacattgcacactaggttccccaggaagcagctctaagagatatttgctttcaggaagtttattcctttctgcctttaagatcaaagttgcattcaagatcaaaacttataggggagtgaggaaggaggattgaacacagagaagttggattgaaatgcagtcacaacaaaggcctcagccaacttgtggggagctctggagctgaaatggccctctagagttgtgcaaaatttgggcaaggaggccaggcctttatatatccctttataccagtcattgcatgtggattaacccaggcatgggaacatgatttggggtgacacatttctctttggcagagaacaggggccacatctgcgagctgtcagcaatcagccttcctagtagctggtagaatgcatatttttatcctaaaatgtctaaagtgtgtgtgtgtgtgcacacgtgtgtctaaggggtagtaggtgagtgggtgggggtaaatctgagcagtgcatcacagttcatctttagtagatactgttaaacaatattcccaagtgtttatgcccaaataccctcttaatttagattctgatatccccacatggactctttccaaaaagataaagaaaaatgtatagaagtgaaacaaatgtaaaaaatattctgtatattaacttattattttctatatggtggagaaagcaaaattgagaaccattgaaatgggttgtttattattttctaacttatggcttgatatcctgaaatctgtcaacactacccaggttgttctgaaatctagctatggatttagtagatcctaaagacttcctactgtgctgagaaaaaaaaacagaaaatgaaatatatgaattgacttttctcaaatttcatttttcagagtggccaaatcaatgaaggtccctgtatatgagaccccagctggatggagattcttctcaaatctgatggactcaggacgttgcaatctgtgtggggaagagagctttggcactggtaggctttgttgggttgatattactggggagggcggctgcagccttttgtgatctcagtttggagatctgtgaactttctgtgaattacagaggaacagttaagtagaggcaaaaaatcagagaaacctagtagagtatgtgctgtgatatgcttacctcttttgtccattttgtttcttctttttagaaatttctctttctttaaaaatttctattatggaaatctttaaagtgtataagagtagagagaatatcgcattgaatccccatgttactgtcactcccatttcaaccaccataaacttgtgatcaatcttcctttatctctaccctcatccgcaggggaacactcctccctgattattgtgaagcaatcctctgtagctcattgttttatccgtaagcatttcaagatgaatctttaaatataagggctcttgttcagaaaaaccacataaccacagtaccattatcacacctaaaatgttaaaaacgttttctttttttacatactttaaatacttcatccagttgttttctggcttgcatcatgtccaagaagtcggatttaatttttatgtttattcctctatgtaaagtactctgtgtaaagtaccccccagtctcctgcctttggctgacttcaatattttttaatctttgattgtcaaaagtctaatcatattaataatgtgtctaggggtgtatgcatgtatgtatttaaccctatgtgggattctcttgaattcttggctctgttgtttgttgttgttcattaattttaggaaatgctcagctattattttttcaaatatttctccttccccattctttgtctcttgtccttctgaggctccaattacacatgtgttagataatttgtgatgacaaatgagctcttacattcatttttctgatttatttctccccttttttcttcttgtgtttcagtttagatcgtctctattggaacatctttaagttcactgattctttccttagctgtgtccaatctgctgatgagcctgttgaaggaattcttcttctccgatactgtgtgttttttttttttttttagcatttctctttgactcttttaaaatagtttttagttctctgaaattccccatctgtttatgtaattgtttatctttttcattagatcatttaacatattagacatggttgttttaaacaccctgtctgatagttccaatctctggttcatctctgactttggttcagctgattgctttatctcttgacaatggtttgggttttcctgttttttgtagatctcataaatttttattgaatgctgaataatatgtggataagaacagtagatattcaggtcaattgtatttatgcctagaaatgggtacaacccttttttggggcaattagtgtggaaggttaagttaacctagtcaagcggtgatctgggtttgggttttactgtttctgttttaaccttcagtgtaccacaggcctcaaattcccccagcagtggcatatttttactgggtactggaactggggaagggtactggagaggtttttaagtgttcctgtttctccctcagttttcagtagtgactgcaagtctgtaacacaaaatacagttctatctccagggtcttaaactttccctggtagcagagacctctgactagtattggtgcaggattctgagcacaagttttcctaccctctccccagaggcagaagagtttttacttttgcccgtctctcagagacaatagatctctttctggacctggggatgagaaggtttttagcgtgtacacctaggaacataaagcatttgtttcatgtaagagaagggtttgggggagcagaagggcttcatccttgtctcccagtgacagctgatcgtcgcttgcatacctgtaccaccaagtttccttctttgttcctaattttttgtgaggacccagtggaaatctgtggaaaagaacttaaaaatgtgccccttgtatctggaaccccaggtgattttaaagtaatgtaaaggcctatactaggcctttaagaattttttaaactcttacatgatttcttattatctggtttttatggcagcctcctctttctcctatgctttgccaaagctgagagaattttcaggatctgtctctccttggagtggctctttggaattcacttgactgtgtggtcatctcagatctctgagttcaagaaaacttaccatgtttgagatttcctggccttttaccattgctaggatgggaatagctttctcttactgatttgcatatcctaaagagaagtacacaagtggaactctaaaagtaatttcttaataatttcctctatcctcattttccccctccccattaacagtttgttctaattggatctaaaagatcttacactgtaattggctgatatgtctcttaagtctcttttaatctacgtttctcttctttacattttgcccttattatttattcattgaagaaactgggtcatatttcctatagagctttaaaattgctttgattttgatgctgctgtcctaattttcctttctaatttgcttaatgtttatatgaagagaagctattgattaatatgctttttctctggtttgcaacttccttagttgcaattatagtaattattaatttaattatcatattaattgtagtggattttttttccaaaaactctatattctcttgggattttaaaatatataatcacataatctatgaataaaatattttttgtgtttttcccctaaaacctacaacccaccctcccttccttccttccttcctttctttcttggctcaggtgcacatgtgaatgtttgttacatgagcaaactcatgtcacaggggtttgtggtacagattatttcatcacccaggaattaagcccagtacccaataattgtcgtttctgctcctctccttcctcccaccctactcctcaagaagacccggtgtctgttgtttccttctttgtgttcataaattctcatcatttcgctcccacttataactgagaacatcatgcttatatagactattgttcccattcctagttacttagagtcttatatattgtatacaataattctgccactagttagtcaaataaatctagcaactggaatgaaaactggtaagtacaggttatcccttttctctgtctttataagcatttattaagtgtttacaatatattatagacttttagtttccaattaaaggggtaaatattccatgtgtaagccatgttacgcttttagtaataagtatttgcctatttcaattcaataaacatttactcagtgctgacagagtaccaggcattgtgttggatggtgtgtagaatacaaaatgctcaacaccacacccttcagaattttctaataatttcctctatcctcattttccccctccccgttaacagtttgttctaattggttctaaaagatcttacactgtaattggctgatatgtctcttaagtctcttttaatctacgtttctcttctttacattttgcccttattatttattcattgaagaaactgggtcatatttcctatagagctttaaaattgccttttaccattgctaggatgggaatagctttctcttactgattttcatatcctaaagagaagtacacaagtggaactctaaaagtaatttcttaattgctttggagatggactcttgctctgtcacccaggctggagtgtagtggcactatctcagctcactgcaacctctgcttcctgggttcaggtgattctcatgcctcagcctcccaagtagcaggaccacaggcgtgtgccatcactccctgactaatatttgtatttttaggagagacaggatttcaccatattggccaggctggtctaaaactcctggcctcaagtgatccgcccaccttggcctccgaaagtgctgggatggcaggcatgaaccgccatgccggccactattactttttactatgtgttctttaaaaactaatgtcaatagtcatacaaatttgccaactaaaatcaagcgatgtaacaatgtttattatttccaagaaagtactctgttgagtctttcacagaaataatagtgttttttaaaaaaaaaatgagcacttagtatgtaccttttgtatgtattcatctttttctagaaatttggaattgaatccagagctgctggcattagcatgagttgtccatacttgtcacaccaaatttttccactgtgaactctgaagtacagcctggtgctcttgaagttgactgttttcatatgtgcccaatttctagcacaagaaggggccctgagtgtgtgtgtattctgtgtcacaaggactcttgagtatctttccagtcttttgaggtttgctggatgcttccatgcatggattccatgccaatattgtaaatgccctgaagacagggcccatgtctatctttctcagctctatttctttgatgaatggtaggccctaagtaaatgcttgtaggatgggtggaaagataaaaggatgaatgggagaagggaaggaaggttggaaagatgaaaggaagataggtgggtggaaggaaagtacaaagaattttcgttttgttatctcttccttgtattattagtagttatctttttgtcatccttaaatggatgtatttctgaagatctgggtatttgggtatcccaagatttgggaagatttataaaacaaaatcacacaaatacagaccatttggaaagggatggggagagatgttatgaatgataacaaaattagaattatataaaatataatctttaaatattttcaatcatcataattattagcacaaactaatagctaacaacatgcttctagggagatctcccttcctggaactagtgttaataaacagattttaaattatttataatttattatgttaacttgtttatttcttatgcctgtagttgttgacaataacagaaatagccatgttcaacagtgggctaggttccagctttagtgatcttttgtatgcaccaaattcttactgactttagcatagtcattttgtgctctgttgtcttatggtttatgttatcattctccagttactttgtgaatgagcactttatttcccctgagagttgtagagtttgtaacatgtttagggccatgcctctttcttcatttatatttcacatatgaatgatgtatatcctaactgaagattgggttcacaatagtgctgttgcacaaatactgagtaagtttaactgtctcttatttatacaattattacatttactattttatattcctcaaaaggtaaaatataggaaaactttagtccattccctatctggatggttattccctctacatttgtctcttttcgcatctgccgattctagtctctaggagagagaaagaggccatatatccatgcatttcagattactgaggtcctactgcacttctttttcttatttgtggccagtgtgtataaatttggctgggttgcagatgtgcggtgtggaggccatgatgacagcattatcagtgctagatgagcagtttctctgtggggctatttgaaacaggctgagtgcatgtgtgcatttcaatctaggctgggccagagcacagaggtgctatgattgacacccccgtgagccttcttataaagccagaaaattgaaactcccttctgggtcctctgtgaatgatcaacccctgtgccgggaaacagaactctcacttagcattggaagaatgtctccatcactaagatccttttcttggaatctcaatggtcccagttccattgatccttctattaatcctccaagctaatgaaaagtggtaagagggagtgttgtgtgacacctaagggtggagcaaaaacaaaggaatggggcttctgaaaccacatctgtactgaccagagtatcctgggactgactgggagtcctgagacatcatggctcttagtcagagactgaagacttccaaacagactaaggggttcttttcccagtgtctagtaagggacttttaacaaggagaactgtcccttgggatttaaaatacaatccctaaagttgtgcttcgaggcttcccaatctgcattctaggagactactggttgctaggtggccccactgagaacacagtacagtgactgtagaagtgacaggtcttcaaccttaaaagccactggagagatttttgattcagtgtatgacctgtcaagaaacaattcttaaacaggttatggtggtttgtgcctatgtgggaagctgaggcaggaggattgcctgaggccaggagttcaaggccagcctggtcaacacaaaaagaccctgtctcttaaaaaaaaaaaaaaaaagagagactcggtgcagtggctcatgcctgtaatcccagcactttgggaagccaaggcgggtgaactcctgaggtcaggagttcaagaccagcctggccaacatggtgaaaccttgtctctattaacaatacaaaaattagccggatgtggtggcgggtgcctgtaatcccagctactcgggaggttgaggcaggagaatcacttgaacccaggagatggaggttgtgatgagccaagatcgtgctactgcactccagcctgggtgacagggtgagactccatctcaaaaaaaaaggacaattcttagagtcctattgttcctatctgccttggtgacaaaaaaaaaaaaaaatgagttgggatgtatgagttaggagcatgctggtatgctctgtgagggaagcatgtcagctggctggccatgatatggttaatgtgctccctgctctgggatggatggcttgatgcctcctaagtgatagacacaattcctagtgcctcctgtactttattttagagtcttcttcacaatgatggtatagagaccctaatgaccccattttgttgatgaagtcgttgaggtttagggaggaatgtcaagccgctggccaaagtcacactggctgagccacaattcaaacccaaccttgctggcttcacagtgtctgctgctgatgttttcagttcatgctgatgagtcatttcccaccctccccaaccccctcctggttattcttttggatgaaggtagaaggaatgccaggggacttgggagaatggtctcatgtaaacagcatggcatgagaagttgagggacccagcttccatcttgactccccctctcttagacaaatagcttagcttctctgtgactcaatttcctcattgcgagacaacttcgtctgaggggatgatctgtaggtttcttccatcatgatatttcaggttgcttctaactagctacccttagtgaggagcaaacctgatgaattatatgcactacatactaaagaggcattcatttattcattcagtgaacatttactgcacaccttctatgagccagcccagggtagagtgcgagtaatttcagacacaggcccttccctcagggagtttatagggtgttgctatggtcaggatatcagccttgtgtgaaacactatttattactattttacttattaaatgtgttgtgacacagaattattcactgggagccacattgcccacagcacaggatgtgtcctttgctgctgtctgactcttctgcgcttgcacctggctctgacttacatgcaggagagctttgttctctaattgatgaacattaggtacatttaagaatatttttttaagcatagaaaggtgacttttttttcagtgagccttgctttttcacctgatgttaaagatctgaacataagtggtttgagaaatgaaaatcaatctatctatcagtctaccgatcgatcgatcgatctccatcacaattctgtagcatgttctcaaatctcagatccacccaaaaagagtgaccccactttaacctcataactccactatttttcaaagacaaatctttatcttgagtagctgaaaaaaggatgagaaggctgcaaattaatgaaaaccatttctaaatgaaaaaaggtaaactggagaaataaagggaaaatttgcagcttgtcctttagaaagcctgccccagctctcaccacataggatgctttacccgctttcttgcaactcctgagggccacagcattgctgggataatccagtggcagttaagtccataggctttggagccaaattgcccagcttggaaccttctttttaccacttagtagctgtgtggcctcatacagatgacctaagctcaatctcttatttgtaaaagggggctatcaaattgtggaaattaaataatagatgcataaaatcccctagcgcagtgcctggtgccttgctgctttcttcttagaatggaatttatcctccttgtgattgtgcttcaaaaataatcaggaacctctttgagtgagtggcctctcttattgtatgaccaacaatcctggtttgtccaggactaagaagtttcatgagatgtgggactttatgtgctaaaagtgggaaaatcccatgcaaaccaggataagttggtcactccaaagctggcaaagtcctcagttttccagatgaaaatggcaaggagaaatcttgatactgaagctgactccagtgagaacccccccatgtgagcaaggccagggccgtgaattaaatgagagacccatggctgctttcccttagcaccacattcaagcaaaaagaggaagaggcctcactcactacccccaggcattctgccccaaacatgagactgcatacggtgcctttctgctgaagcaagtgactttcaagcccggctgcctgtgaaaatcacccaaggagtttttaaaaaagaaataccaatgcctgggccccatcattaaaagtttttattttattggctcagggtgagacctgagcatttgtatttttttaaaatctccttgggtgattctaatgtgcagtgcagggttgaaaattgccaacatatgttacaacttggagttggcaacaggtgcaaattgacttatagttttcctaattgacaaatttagaatttccttatctgagtttcagctgtaatggcttgatctgttagtaatgcatgggatgctttattgagctgatgtgtccatactggtgtttccatgtgaagaaaacatctttaagatgattgagcattctctttatttttcccttttcttttgtgagggcaatatacttattagtgtcctgcctagctcaagtagcatggttttgaagattgagaaaattcaaagtttaatttgagtggagggggaacagtgatatttctctagaaaaaaaaaaaggccttcttttttgtaccagtttttgctggagtcatggcagagaagagctgagcgccctccttctggtatgtggatggagatggctgcttctcagggctgctcagagtaagattgcgtgggctttgggctgggctaggttggatgagaaaggcaaggtgagtggtacttacagctttggaaatatgggtatattctccctgcaatgtcctgagccaggcagcaagcttcaaaaattgtgctggtgttattcaatgctaaaaagacactcactctcaagccataaaaagacatgaaggaaccataaatgcatattattaagcaaaagaagacaataaaaaaatacatactagatgagcccaactatatgactctagaaaaggcatgttttaaatgtgaatttctatgcaccattgacaactttgtttactttatttttatttattgttttttttgagacggagtttcactcttcttgcccaggctggagtgcagtggtgtgatctcagctcactgcaacctctaccttctgggttcaaatgattctcttgcctcagcttcccaagtagcagggattacatggatgtgtctgccatcatgcctggctaattttttttttttttttttttttgtatttttagtagagacgaggtttcaccatgttggccaggctggtctcaaactcctgacctcaggtgattcccccaccttggcctcccaaagtgctgtgattacaggtgtgagccaccgtgcctggctaacaactttaaaaatttatttttttcttatgaaataatacgttgttattgcgaaaatatttaaaaggaaagagaggaaaagcatctgcagttctaccacttcagagataataaccatgttaagagtttggtgtatattcttctgtttacttgtgtacacacatatatacatatctatattttttataaaaatatactgaatattcttttttagtaaactgatttttcatttattaaaattgaatgcacaattacctattggatacaatgttttctatttaagtgatgagtacactaaaagccactaggcaatatatccatgtaataaaactggacttgtacctcctgaaactataaaaataaaataaaatgaaaagaattgaataaacatggttttctgtgttactaaagattcttgtttgatttattttgtctacccacaaggttttgaatgaattttgtgcaatgatcctattgttcaacaattaagcctgggcaacacagtgagaccccatctctaaaaaagtaaataaataaattagccaggcatggtggtgtgcaccttgagtcccagctactcgagaggctgaagtgggaggatcacttgagcctgggaggtcgcggctgcagtgagccatgattgaacccctgtactccagcctgggtgacagagcaagaccctgtctcagaaaaatcaaaacaatatttttccaatttttctttattctcttatctacttcattgaatgtcctatgacttaaggttaagaaataaaatagctgggtcgaaagctgcatgatatttttaaagactgttgatcattattgccaagttaactcttcccccgtcaaacctttgctaacctgacaggccccagatggtatcccattttacacacttttctttgaccacagtgagggtgaacatttgttccaatgttgactattattattttcctctgacaattgcatgcttgtgccttttcattccattgtccattgaggtttctctttttcttattgacctatgaaaacattaaaaaaatatccagcctattatccctgtcatatatatagtgtgaacatttctactcccatttttactctgtttatagtggggttttagaaaaccatttgatacctttgtgctttctggaatttcttgtttaatctgcctgtcactgatacagcatagcgttcacttgcctgaaagcctttttaaaaggagagttatagcccccaaatccactccaaagtacactataatcatccagtggaaacatctgtgtaattgaagcatcattaatgtctctgtcccaaactcaaagaactataaagggcattgttaattttacttcatcatcagccccttattaatcttggcaaatgtttaacttgtaggcaaggatgtccaagccaactcacaatttactatgcaattggctacaaatgttgaggtgggtttttttgtttatccacctaaaagaactttatgtccctctagcactaaattatgacatcttatctcacagatttaacagcatctaatggttctatctctaggtaatgtaatccagctggagttcgaaggtatgcaaagcccatgttttagaacaaaagggtatttttctctagccagtaaataaaagtgattttttttttcagctgtaaaaggacaaaaggttttgaagtgatcccactgggcagggtttcctaaacttgttttttggcagttggccatggagctaactcagtcttccaaacttcttccatttttgtagcagtgtaaagaattcactggataagactaaagacacttcatggtgtgatgattaatgcccagggtcctgttaacccagaggcaaccacaactggacatccaacagtgccattagcagaccgttgatcagtgtgtaggaagaactaaaaacctgaccctttttcttattgattttagtaccttcacagcccccctcaggtttgcatgttttccttattgagaaaaaaagtttaacatttaacaccataaatgtcacaagtacggtaaatggtctgtagctttagttagaagttgtcaaagatgtttgacttaagtattgtttgatcccattttcaggggttaaacagctctgtggcgttgcgtctcccttgttggttttccatgtatgttttgtagttctgaaacccaagaatactgttgtccattctcattgccctgctgcaagaaggtccactctgtggacccagtcctgtttcttaagacattactattgctagagtgagaggataaaattacatgaataaccaagaacaatttctgaaagcaggtattgaggaatcagcaccttgcagtaattcacacagctttattaaaattaccaacaacaagatcaacagcaaagatatgtgatatcccagccactgttctgaacatctgggcatatttagttgcttaatcctgacagtaaccccatggggtaggggctgttattgtccatagattacagatgagtaccgcaaacaaaggtaaatggctgagccaggattagaacatgagaaatctaactctagagcttgtcctcttaacttgattaagttgatacaacaacaatgccgcaaaatgggtgatggggtccccattttacaaatgagaagctgaggctcaggggaattaatgactttgtaataactttccacacatctgtgaagtagcagtttggcttaagccctaattctaaagccttccccaggataccacatgtctcgtactacaacacatttctttacatacagggctttattcacttcagagagagcttataactggctaacagacagatacccaaatgggcctgtgacacactcttctgggttctcattgcacaggaagctggtcatttagactgcagtcttcatttgtgtgcctgatgcaataagaactgcctccaactctttctatatgaatagctgtaggatataccttctctattcattcctgcctcaggaactttgctttttctgtgccctagcttggaatacgtcatccccagatcttggcatgtctgacttcttctcaggggttagctcagatgccattgcctcagtgggggcagaccctaactatctgtattaatctcctagggctgtcataacaaatcaccaccaactgggtggcttaaagcagtagaaatgtattctcttatagttctggaggccagaagtctaaaaccaaggtgtaggcaggaccacccttccttggaaggctgtagaggaggattccccttgcctctttcagtttctggtggctccacatgttccatgacttgtggcggcacaactgtaatctctgcctctgtctgcacatagcttgcccctctgtatttctcctcttctgtgtcttctcctcttcttataagaatgtttatcattggatttaggtgcttgagataatctcacctcaagattcctaacttaattgtatctgcaaagagcatttcccaaaataaggtcacattcacaggttccaggtggacatatctgttgggtcggggaaccaccagccaaccttaggtcaagcagcttttggtgctgttatgctctgtgacatcatcacctctttattttcttcaaagcacttgtccttatttgatgcatcttgttctcttatctacttttctttgcctgtctccacctaactccatctacttggattcaaactttatgagtaaagaactatcttgttcactgctttaccccaagacgtagaacaatgcctgatatattgtaggggtcactaaatatttactgaataaatgaataatctcattgggctaatgagatgtcaacttggctctctgatcccttcagaaatttccaagttttattttttttactattttatttgaatttcagttggatatttttcagaaatgcaaatgtattaggagacatatatttaatataatgggtaaatgatccaatcatttctacataacattcaatcactaactggtcttcttaattcatttagcttttgctttgctcccacaaatgaatgctcagcagaatttttctttcacctttaggctctgaccacctccgagagaaggatggcctgtgggctgtcttggtctggctctccattattgctgcccggaagcagagtgtggaggaaattgtccgagatcactgggccaaatttggccgccactactattgcaggtgaggagaaggggaagggtctctgtatggaccctgaagaactactcctagaacaggtttctaaaactgatgggctagaaccttaaaaaggaggcatcaggccgggcgcggtggctcacgcctgtaatcccagcactttgggaggccgaggtgggcggatcacgaggtcaggagatcgagaccatcccggctaaaacggtgaaaccccgtctctactaaaaatacaaaaaattagctgggcgtagtggcgggcgcctgtagtcccagctacttgggaggctgaggcaggagaatggcgtgaacccggaaggcggagccgagatcccgccactgcactccagcctgggcgacagagcgagactccgtctcaaaaaaaaaaaaaaaaaaaggaggcatcttcccagaagatctgaggaacacagaggctggagctgaatcaccccttatagatagttgggggtggtgtcaaaggctaccaagctggaaggcaccaatttcctttcccctgatgacatcactctttaatcttttcatcaatgcctataaggtaggtggccctctcaagaggaactctgaactgcagagctttgaaaagttatttggtaactatcatggctgtgagagccgtgcagtcaaaccagaggcatttcttgttggttttccattcatatttatcaagtaaaaaaggcagacacagaagctgtgacaggttggtatgctttcataatcctctctctacctctttcttacctcctcaccaataatcagattcagtgtccaagatgcctgagctggcaccccttgaaggaacctcatggttcaagagccccagatattgttaaagttttgtcctcatgaaaagaggtacaggccaggtgtggtggctcacgcctgtaataccagcactttgggaggccgaggcaggcggatcacctgaggtcaggagtttgagaccaggctgaccaacatggtgaaactctgtctctactaaaaatacaaaaattagctgggtttggtggtgcacacctgtagctactagggaggctgaggcaggagaatcgcttgaacctgggaggcagaagttgcagtgagtggagatcgtgccactgcactacagcctgggcaacagagtgagactccatctcaaaaaaaaaaacaaaacaaaacaaaacaaaaaaacagggaaaaagaagtacagaaaaggaaaccattattttggaaggaagaaaaggaaagatcagtgggtaggagcttagggttgggggtctatatcactttcccgttgtttaagtaaatgaaagtaagagtattctggaagtgtggttacttgctaggagtgtgaacctaggtatgctagatatgtgtacataacaagaacgaagccatgggttaggaggagggagtaggaaacgatgttaactgtaaagaacttggaggtggggcaagggaatccttgggtagtctcagagactctgtattaaaagcagaaagattgtgactcattttgctttgtttatgaatagttaactactttgaatgtttggttgtgtttcaagagcttaagggacagaaagagagctttagactttcctcataaggtgattatttcttctgttaagaagacttttacttagatatgtatcagagaataaggaagcccatgactgtactcgttaaaatcaaagagattacaaccttctgggagatgtaaacaacaacaacatcatattcttagttcccatttagtcaagaaagctggggatgtgatagcttgcaaaacaactcgaattattcagtgtatcataaaaaatgaattctcaggacaggtagaaacttggtttactcattatttctaacaagtaccaaaaccccctgattcatgtgtgttttcttttcctggcataccaagagttaattggcacatgacattcttctattgcatgaagctgttccaaaacgtccaacctgacaaaatatattatgattgacaacctctggcctagtgagatcgctttgagtcagagatgtgttcctcataatttgtggaatgattatctaggtttctgctggtgtcttgaataattggtgttatggtaactgtatttataatgtagtttattttttgtggccaagagcttacatgataattacttcttcataacaaataccatatttgaaaataatatgcaatacagatttaatttcttctaggacattgagttatgtttcagatttctttccaaaaagatcacagagataaagaaaaagggaggagaaaatacatagaatgaaaggtaaacatttccttcaacccccagcaaatggcaaattagaaggtgcttgtgaaatgtaattattcctagcttgacaattttcttggcaggctgaaaataataaaacaatttcactttaactaatactgagcctgaatatctgagaaaatcttccagattatttttcttgtatgagtagaccccagaaggaatcttccatttaaagatttcttccttgaaaagtgtgttgttattggtggtgatcagacggggatttgggggtggaaggcagtgctagatcctgcttgtatatgaaggtgaacgtttgggcaaacagatctgatgattctcaaccctagactgaacgtgatctatcatattagtggatttttttcaactcctgaatctctttcaatgcctctctgtctcctgctagactctcttctcctgtcttcctgcccctttctccttggttgggtctttaccttctccaaatgtctacctttaaagtgactgcagtctcagaatatatgccctgctgaaaaagaatgttctgagggagttccttttttttccctctgaggctgagaaaaaaacaccttgtgtaggaggaagagaataaaagaaagggatgtagatgcaggggacccattgctagacatggtattattccatattttgcatcttggctaatatgctgatgtttactggatgtcttaaagatcttgagtggaaaaaagtagtaacaactattcagagcttccttcttccagttcactctgagaactcacatcctttctctatgctacaggaagcccaaatgtaagatcctccaagtgacttgggtgcagctgcccctcctatggcttccttcttaaacagacagtcctaggtgtgccattaggtctcagccaagaccatctgacattgtaaaatatagtttatttatggtggtgatggcaaataaaagttgttagctgtttttaagcacaagtgcctggcactgtgccaactcttggtatacatcatcatattttaaaccccacaatgacaaatgcaattggtattatttttagtcttttattttattttttctaatcgacttccagccccattgttacatttaatacgcttggctaggaggacttttttgaatggaacaattgtgatatttcttccaagtttccaagagttctatattgtgctcagttccccttctccctttctttttaccttccttgatttttctctctttccttccttcctttcctttctcccatttttcattccattctacttacatagaacttactatgtactagaaatagcagagagcaagacagttcctggagctcacgttctggtggccaaagacaggcaatgaataggtaaacaaatatacaaacaagatacatacagtttgggataactaccaaaagaaaatatgaagggtgatgagagaagaagacgagtggggaagctgccttagatagatggtcagagaaggtcacattctaatggtgacagtgggtttgaaaatggaaggaaagaacgagcctggtatttgaagagctggcagaagaatgtacaaggtagagggaacacacagctagcgcaagggcccagaggcaggaaagggtgcaatgtcaatgcacactggagaagagaccagtgtggctggagccagtgaacaatgataaaaagacagaacaaagttgagtcaaagaggtgggccagggcagatcccacagtgcctgatagaccaaggttaaagtgttgagttttgttctcaatgtgatgggaatttatagagggatttaatagaaagaaagtggcatgatttgatttttacaagattactctggccgctgtatggggaatggactgtaagggtcagatgaaagaggggagatgagttgaaggtgcatttctgtgctgtccttccctggaaacagaaccaatgattaaataactgtaagtgggccacccagttgctggttctctgattaggtttctgttcctcctgtgtcctcaccaggtttgactatgaggggttggatcccaagacgacatattatatcatgagggacctggaggccctggtcacagacaaatccttcattggccagcagtttgctgtggggagccatgtctacagcgtggcgaagacggatagttttgaatacgtggaccctgtggatggcactgtgaccaagaaacaggtacttgctaggaaatcactacaacgggttatcaggcagaaccagtggccaaaatgtcctagaactggagaggtccttagggatgatctaaggtgacctcattttatagatgagaactgtgcagccaggaaagaggaaagcccttgatgaaggacacctaacaagttagtgcacagggtagattagaacatgggctttctgtggccaggcacagtggctcatacttgttatcccagcattttgggaggccaaggtgggagggtcacttttgagctcaggagttcaaaaccagcgtgggcaacaaagtgagacccccatctctaccaaaaaaaaaaaaaaaaaatagctgggcatggtggcacacaattgtagtcccagccacttaggaggctaaggtgggaggatcgcttgagcccaagaggtcaagtctgcagtgactcatgatcacaccattgcacttcagcgtgggagacaaagtgagaccatgtctcaaacacacacacacacacacacacacacacacacacacaaaacaaaacaaacaaaaaacaaaaaaaaaaacaaaagaacatgggtactctatgtccagtatttgtcccacttggtaatggatagaccaatatgtcaaataaatacagacccaacatttccttatgaaatgtttgtagcctgcaggtgctcatatgtggtggccattattggtgacagattcagaaaagttaccaagaactaaagatccctgtccttggggcctcagtgagtcagtccttggaattgtaaagtcaggagctcagctggcatctttgagcccccgtgccctggataggtcttttccagttttggaccacattcccacttccattttacaaacttttcttagattcaagtctcattttgatgtagaattcaagagatataaaataatgtgccttttaaagtatccttgggatatttttgctcaccgacaaggaaggctcggaaaccattccttcaagggaatggtctaatccgcactcagttatggattttatctacttgcaagaagcttgtctgttgagcttatttgttttgctgttaatgcagtattcctctaccttatatcttcctcagtgtactcagtgcttggataccttttccttagattttctttaactgttcacatcaggccagttctgcaactgtatctcaagttcatctatttatttcatttcccctccccctccataactctgactgttggttttcatttttacactggaatgtgtttgatagggtttggctgtgtccccacccaaatctcatcttgaactgtagctcccataatccccacgtgtcatgggagggaccaggtgggaggtaattgaatcatgggggtgggtttttcctgtgcagtcttgtggtagtgaataagtctcatgagatctgatgtttttataaagggcacttcccctgcacatgctttcttgcctgctgccatgtaagacatgtgtttgctcctccctcgccttccaccattattgtgagtccattaaacctcttttccgctataaattacccagtctttggtaattcttcatagcagtatgaaaatggactaatacagtattgatttcccccaacctcttctacactcttctgtctgagctcaattgtagctataaatggatacatgctgccaggatctgctcttgggaatttttctggtaaagaaagaaggaagttttttgttccttttcccagattccaggacccaggtgatatcttcattggctggtggtcctgagacacactagagcttctttgcaggtctgggtttagctcaaggggggtgatgagagaccagttacttaatacttagcagcatccccattgttggcaagttacagatggttcctttgctgccgttggtcctgttgggtagaggtggaatccctgcatagcagtgttgttgagaccctctcaggatgtcaacatgcatcagcattcagccccagggatagttgagtctggggtacactttaggtaacatagtgcaaaataagcatacttttcaaactatagacatctgaaagacatatttgaatttaaataaactagtattctaaaataaccattaagtaccttggtgcattcattcagtggatatttattgagagcctaccaaatgcataatttgttttttttcatggtacagttttaaaatataaatatatagtatctttattgatatataattcatataccagatggttctctcatttaaagggcacacttcaacagtttctagtatatttacagaattgtgcagttatcaccacaaccaattcagaacactttcatcaccccagaaaagaaatgttgtgctctttagctgtcatcttcctcccaacatccctccaacccacagcccctggcaacccctgatctttctgtctctatggattcgcctatttgggacattttgtataaatggaatcatataatacaaggtcctttatgactagcttctttcacttattgtaatattttcagggttcatccactttgtaccatatatcagtacttattccttttattaccaagtaatattctatcacgtggatgtaccacagtttgtttatccatccatttgctgttggatgtgtgaggtatttccactttttgactataatgctgctgtggacatccatctacaagtttttgtgcagagataggttttcaattctcctgggtacatacttaggagcggaattgctgggtcaaatggtatctctatgtttaacccttaaaggaactgccatatggtcttcgtaagcaattgcaccacttgacattcctgccaacagtatatgagggttccagtttctccacacctttgctaacccttgttattatgtctttgtgatttaaaaatactgttattttaaaacaacctactatattatggattatttttaaattaagatagaaggagatttgatttctataaggagaaacagaactatatctctctgttagcaaagctcagaggagacataatactgccaagtgtctgcttcctacaggaggcaggttgttgtggttctcttcagtattctcttgtgttggagtcagatagacacaggattgaaagctggccttgtcactgcctagatttgtgattttaggcatattatttaacttctttgaacctcatcttgaggggaggagctagtgataattatcacacatgcatcatggggaaagtttgaagagaaagtcatgtgaagcctcaggtacagcggcaagtacctaattgatgctcaagaaatatcagttccctccccttgaccagaatccttaatttgattgaatatcagttcaagaaaaggatacaactattctctctctctctctctctgtgtcacacgcacatacacacacacacacacacacacacacacacacacaaatcaggtgtatatttttaaaagtaataatcagtgtgccctagggttagaaaaccctcacccaactcttctatttattctattttaaaagtactttgcagtaaaatttgaggctcagattgatgatcccaaggtagtgggagattcccagttgtctcttgtttgggttaaattctacttacttaaaaaaaaagtagatagcagaaataattttcaacaatgaattgttaaaatttgtgctgttcccgttttatacagaaattctcttcaagagcagctttctgctccagagcacccaaggcaaccttggtgccattgtaaatcgtgtgagcaatggttgggtgtgcaggcttgaagtcagaaagttttgggtttgagcctcaactctgccacctccttgctgggttatcttaggcaagctattcaacccccctacacctgcatttttaaaatctgtgaaataggaataataattgtggctgtctcatataagcgtttgggagaattaagtgagatgacacttataaaatcctggcacataacaaatgataacaattggttaaataaaattatttatgttttaaaaaaagcatccttgggaaagactgtagcattgaatgaaccagatatgataagaaaagcagaaaaaaaacacacaattttgcagtgtcacataaagatttgagaaggccccttcagtttctaagtcatctgggaattgattcaaactcatatttctccccctctcccatcccccagcacacacactctgctttagaaagcgaaaggttttttaaggcagcttggtctcctttatgtccttgacctgaggtcagagtcaggaaataaaccatggaaaaaaatcctgtttcacatacatctccagagataaagtagaaatgcttctccatccaaaatgaaattaaaatcctgttctggtgataaccaccccactactgccaaccctgctgctgtggaaacgttcagtgaaggctatcctgcctggctttatgggaccattcaaggagcaagaaggaaaccctgaagttctcaacccctgacatgatttcccagggacctccctggcctcaatgtggcatgtttggtttcatgggatttactatggctgcctccaagtgtctgatgcatgtgtgacctcggatgccaagagaaaaattgatgtgtgctttccactatacagggcccaagagagactctgtttgatttagaaagcattttcatgaggcatggttcaacaactgcagttcttccttctatcttcatgaggatatgtcactattttcaagtgaaatctagtcacatgaaggactgactgatgctattttcttcaaatataagtggaaaaaaataagcctatagctacaatgagaataggggagcactttgatcaaatggctaagtagttaaaggagttcccagtttataccttctaaagagataggacagagaggagttgtgtgattcatgtgggttgcagggtgagccactctttcttcaggggcgacttcattgtgcaaacatcgagggtttccatccatcatgctaggtgagctctttcttcccttcaccatcgataccctaaagaatattatcaagattgtctcttactatgatcttttctccatctctaacatgtggcctaagtcctggaatctccactcagtgccacagttgtgagactcccccagctctgatagaaggaatactccaatcctggtattgtgagtgaaggacagtgtgacagaaatggctccacattgagagacagcatatttccactatggtgggtatcaatccagaaccatgacctatattttgaaaactggatttgaaatgagaaaccttgacacttcaggagcaaaatttaagcaactgagtctctttttatgactcatcctaatcctatgttgttgttgttgttgttgttgttttcttttttctttttcttttctttttttttttttttagacagagtctggctctgtcgcccaggctggagtgcagtggtgtgatcttggctcactgtgacctctgctcccgggttcaagcgattcttgtgcctcagcctcctgagtagctggggctacaggcgtgcaccaccacgcccagctaatttttttatacccttagtagagacagggttttaccatgttggccagtctgatctcaaactcctgacctcaagtgatccgcccacctcggcctcccaaaccaactcctatatttctaacaagctcaaaaatcatgaaactcttccagtgctgaagtcatttgcaagtcacagttcagctgatggttaaaaagctgatgtaaataaatgcataccagttaggtgatgtggaaaaccaaatccaatttgattatgtcaggctaactctgagctgattaatacctcttcaagttaagcaggctatgtggaaacattttgatgttgtccttaacctggaaaaaaagaaccgtttgaatttagttcagagaaaaagcacactttgaagactgattttgaagtcagttttcttttagcgttgttattttaatttgcaagaaggtgtctgctctttttaatttcagtgtttagaaatagtaaattggcaatctcaaagtcacattttatttccagcatgtggtgttttaatatgtacctcgatgcaacaaacccctggtcagcaaatatgaagcagctcactaaggtgttgtccccagcactgtataaaagcaactgaatcatatcaactggagaatctgaagctttaagattgagttcttctctcttcagagttagctagtcaaatttcagcttcaactttttgtttttgttttttgttgttgttttgttttttgttttttgagacggagtctcgctctgtcaccaggctggagtgcagtggcatgatcttggctcactgcaacactgcaacctccacctcctgggttcaagagattctcctgcctcagccccccgagtagctgggattacaggcatgcgccaccatacccggctaatttttgtatttttagtaaagacagggtttcaccatgttggtcaggctagtctcaaactcctgacctcaggtgatctgcttgcctcgggctcccaaagtgctgggactacaggcgtgagccactgcgcctgacctcaacttcaactttgatcacattctaatcaatgaactaattgagagactataattgtaacaatttatccttgtcccttttgctggagtgccatttgctggagtgtggtttgcgcatctggaagtagagcctcagaaatcattttagtcacactgattaacccacctatagaatttagttaaatctgaaaattagcatacccacaaatagcacttctacactgagtcacagaactgtttaagtgaatgggctattatcacatttagtttattgtgattcgatgtgggtttaaaaaaacctttttctttgaaaattgtgatgttgaaaagaatctctgcaataaacatatattcctttcctaacttagtctaatatggtgaaggttgttagaggctgattcatttacaacttcatctattcagtgagtatttaccaaacacctactagacgccagtcagctcattagcaccgaggatacaacagtattcaggacagttgagattcctgtctgctgcttaaaatctagcagggaagataaattgatattaaactttaattactgtagagtttgttgaacggtattacagaggaagaacttatttggtgtgcatagcgggggaaactagactagggctctagaaagttctccatagagaggtgatatctaagttgtactctgaagaatgggtagaaggcagcccaggtgaaaccattttatcagactctttgcttttcttcagtccaatgtggttgttatatggttgtttagctctccagataaagagctaaggtttcctataggcattctcaatgggatgctacgataactgtgattaggattctcaacttcagtgctcactctacaacactgtagttggggaaaataaagacagtcgggctctgtattgcactatggcttgtgctaggacattttgaaaaccataggtttaaaaaaataatttctactagccacttttcctgtgattttcctatttgtcctctgaaggccaaacgcatattcagtactttataatgacctgtcagctgatttgaaaataaaatgggaagctgggtgcaatggcttatgcctgtagtcccagctacttgggaggctgagacaggaggattgcttgagtccaggagtccaagatcaccctgggcaacacagcgagacctcatctcaaatttttaaaaaagcgagaaagaaaatagaatgagggagaccctgtttctggttagtcgggaagttctcatctccctgtttctggttaactggagtattgttataaagaattaccttctcctggcataagttgattgctttagaactattgtctaaagtgtcagtagtaaaattgtcctaaaatgtgtagcaagcgtgtaagcattatcgaatgacaacacagttactttctattggaatactaatgtctctgtgttgtcgggtggatgagcttcaccaggaaatataaatataaaagagaaaagctgcaaatgatcacaggaactaagggaggaagctatgccgttgtctgggtaaagtgtgcctgaatccaaaatatcccagaactggggtggatattgtgtgaacagggatcagcagtcattggccaaagaaatggggaaatagaaggtgcatgattttgttccattgttccagttttgagagttggaatttggatgaggaatagctttcaagtcttcgccctccagcagccctctcatcacctagcatggcttttctaggtgagtgctttaaaagagcgtgtaaggagtcacttgaccttgatttccccagatagttctttgcaattgttagcccccaagaaggctggttggtttttaaaagaggctgggtgagaactgctcccaagagcagggcagctgagtatggctgtgcagtcagcacactgcacaatggtacccagcctaatggggaaggagaagctgaagtccaagccagccgaaggaaggatggttttctgcaatttatccatgctgggggtagaggggggcacctgtttttaactcacacaaaagcaccatatggagtaactgctgccttgctcaaccacttttggactcatgctcacagctaactctatgaattattaaacaaagaaaaatgggtaattctaggtgggtttttttagtgtgtgtggaaagatacgtctgttcaatccaaatctcctgctttctaggctgcatgcccacttctacaaaatatggttcagatgttacgaagcagtatcttcaccttgacgctttccagataaatcgttgtgatttcctgtgggagataagatctgagttaggctcgcagagtctctctcttccaaggctgtcctgtctccaggttcacatgcctgctgtggccaactgactatatatgcgacactgtaccagattgcagggccatatgctgttttcccctggaattcatcccaagtcagtatttgactaggtccaatgctgccaaataactgttggtaatgtacagttcacccttccctgcctggctacaacatgtcctacagtctccaaactaatatctggcagctctgtgtgtatttagcaacttacagatttccctgtattgatttacacaagggtttatttttaaaattaaaaaaatagtaaaaaccctaacatttatttatcaaacatttatcagatacctactctacataaggctctgtgtcagctttgggaaaaatacaaaacataagatattgttcagatatttcgcatgagaagcaatgtgtgaatatcagtagttgcatatggttcaacctcagattgtaagcctagagtcagaagacctaaatggaagtaaatgaagctcctccatttactaaatacgttaccttgagcaagtgttttaacttctttcttttcaataaaaagagagattggcaagaatgactctaagatccttctttcaggatgttaagatctgacactcacaacaacccaataagctaggctgtattatttttcaactgctttttaggaaactaaggcttagagagcttaagtgactcaagaccaccagctaaaaaagtggccaagccagcattctagcctgagtttatccagttgctattcttgtatcatttccaaactgactcttcataaacagcaaatcaaagagggggcaaatccagggagaaaaagagatgctacagtgataactggaagcacactgaaggatttttgtgtggagatagctgcatatggacaagggttatgaaatcctttatcaatcattcttcactgggacaaagctaaggtgagcagaactcgactgtcatcattaaagctcacaaccacaggcactgaaaagtaaggaaaacactaagctggaactgaagtgctcttttgatacccacactcctccccaccacataattaacattgtcttctaataaaggagagcatatttttcccttttttgagtgtgtggctatgtgtcatcctggatattccggctactctagctgctgtggctagtgagatatcatgaattctttcacagttgctccaggaattcctacgaagactgtgctaaaaaaaaaaaataataatgtcagatggttcaagaggtggttctgctgctgacaaggccccagggggaagctttcaggattcagtggcatgaagttgttttattagcctcactgtgttaacagccctcctacagtcccagcccagtgagagcctatgtatgaaaccttaaatcctaaagggaccttccttataagggacatgtagcacagtccagtcacttgatagatgaggcaagtgacccagaaaaaagaggttattgcaattagttactgcacattagaatcacccagaaagcttttaaaatcctaattcccaagtaacaccccaaaagaattaaatcacaatgtttggggtgaaagccaggcaccaccattttttaaagacctcccactgatttcaatatgtagcattttgcaattaatgagctaatggtttgcctaaggtcatacatctggggacaagaacctaccatggttcaactccattgtttttagccaaaactggcccttgtcttaagacatcttgagaaatggtggaggaataaacagtcaagccctgccatgatgatgctatgccaggcactttcttagtttatcttttgcaaccactcttcaaggtagatacatcagctctagttcaccatgaagaacgtgcatgtgttttcatgtagcctgtggatccttgctaaatgcgaaggcaggctctctgagactgcctcagggggactgcagtggtgctcactttagttgtcgaacgtgcagtgacattcattcaacaagtgtttatggaaggtctacagtgtgccaggcattgtcctaggctatgtggataaaatgatgatgaatgaggtatataaggctctgtcctcccagagcttgttagctaatgaagaacccaaagtcataactcagcaagtccaaaattttaaggttaacactgcggtggaaacttgttttattcattttcactgagccttgtttcttcaagacttgtggcggcaaaaacacacataatgaagttgttagaatataaataagaaacataaatcaagactagggaatatataagtaagagtagagtcaagaacagaagaagaaaaatttatagtcatgcaagtcatgaggatccacttgggctgaacctcaaatttggcattaagtatcctggcagccatatcgaaaagggaaatgtggttagttacaaagttcttattgtcagaaagaaaaagaatacaagttccttagggaaggaaaggctttcctaatacttggctcttgaaggaatgtctcaggcagagcttcatacagcctctaacaatatttctactagtgactacaaaagtggattttataagacatagcttgtagcatcctgcagtaaaagtgagaacataaaactaaagtgcaatttaataaattcatttatgttaggagtaggtggtgagaggtaagttgatttgagccaaatacaggttcaggtgaacctatgactagaagctggaacaccagggaatggagggattttatatccttataacaatctacataaacataatttctctctactgagattttgataattcaaatggttatattttctatcttatgctgtagggataaaaggcaagtattctatgttgtgaataatgtaatgccttataccaggggtcagcaaacattttctgtaaagggctaggtagtaaatattttataccttgggggctagatggtctctgccacaactattcatctctgccactgcagcacaaaagcagccatagacaagatataaatgaatggacacgactgtgccccagtacaacttgtttcataaaagtaggtggcaggtcaacttcttacctacaggctacatagtgccaacccctagtataacctaaaaaataaatgcgattattggtattctttcattgaaattcaggaacaattggaaactttgcaagtcttggtcagtggtaactttggcttcatagtttaaatgctattgggtgatgacacatgatggaaagaacatggctcgtgtctgggttgcaaattcattaagttcgttgaaagaacatgcagatcccaaagcaatccaatacagctattcacacataaaagggggcctcagcagacatggtgctgggattgttgcagcacagaactaggctggctctaaagaaacccttacattccatgtggagaaggagaattaatgatgttcctcacctggaatggtcttgaaaagcaacatggattctcagttaagatctcatggttagtttcctaggaaagagggaagatgctggaccatttccagtaggctgatgcatgctattcacatctttgtcatctttccaagtgagaaatctattccaggctaccagacataggttctaacaatcttctaggcatgtagcatgtagtatagtcaaagacattataattaacctcaggggaaaacaataacattatttcatttttaaaaggcttagttatgagcagataacacatgtttatagtttgttatgacctgaattcttaaatttcccctcactggccaaaaatgaatctgagaatgttaattgtttaatgggaggtacttcaaagggttgagtctgggggctcatcagaagaggtaatcccaagtgacttggaatctgcaacaggtgggttaggacctcatccttagatattgctttaaccaatttatgggtaagccatagttctgagcagagtcacgtgctcacgcgccccacgtgtagtgacaacgggaatgtaggcttaaacataggtaacagcttcaaaagagtttgtaaaaacaaggctgtgaatatcaatataattgtgagacttttggggatttattgtaggtttgaacgtaacttgaaatacagtgatttgtagacagtcagtaattgcttcacttgctccatttggaattttgtaactattcacttctccagcagcataaggtggttaagaagacagtttctgttcgttgtaaaaaattactccaggcttaaggaggacaactattgtgtctttatattcatatacccaggatttagcacagtgcctaatccataagggccacactaaaatgtttgcccagtgaataaatcctggataatatcatcctgtctgcaaagccagtattacagagtgattggttgccagtaggggagatagctccctttggttacacaaattgtggcagacattgaaccactccaaaagaaactaaagctatttatttggggattgaaacaaaaaagcctacacaacttgaaaaaagcataaagacactcagatggaaccatagtgtctcccagcagatatcaccagatgggggtgggggtaaataattgcagtcacatatgcagcaggtatatatatttttactaatggcttattcttaaacaggacttgaggccagagaaatttcaaggataaattgctttgggagaatgcctgatatcaatgtctcctgagacatagaagttttccaaaataacaaatcaccagatatattattttgttgcctcctcttccttcccctggcccctgccaatatgcttatttacaagagttaccttatcagttgtcttaggagaacacatttccttcaacagaagtcacagtatcatcttatggtcataattttacaatatccctgcctctactgagaagagatacatagcgaatggagatgtgctgagccaatgaggaattaatcctaggcagcactagtagatgtggccacagctctggccccaccccactctggtggtcaggccaaaaaagaagtcaggtaagaagtgtgaaaggaaattcaatcttgggacccccaaactcattaagccacagggaaaattcaagctgggaactgggtcacgcaaacatgcctcccccttttggttcctaaataagatggctacaagatgaaaagctacatgcctcccccatattttgcccacaagggaattcccagtgagctgctagatctttacactaaaggtgtttctattaaaatttcaccatggcaatataaattgatagtttatagatgcagtcacccctggcccaccagacacaaatgcatatctgattgttcccctggcccagttttgtctgttatcttatataaaatgcagattccctgcaattttcctctgcctcatttgtctgtgtcatcttatgttaaaaaaaaatgcagattcactgagccagacaaaggcatgaatgactgtttttccctacccacctcttacatgaaaattgtgtacttctcaatatcctgccctttcccctttaaatttggagccttcaaaatcatctttggagaaaggcatagacctgtctcctaggtgtgcatccttaactttggcaaataaacctcctaaaataattgagacttgtcatttttctcgattgacagaagaaaagacagagccaagaggatggcagtgtacttggctacccccagagcctagctgaggctccagccctgggcacttcactggagcattcccttgccagcagaggaacctgcagcctaacctcatgctggggtaaccttaatgtgggcaatccgtcttactgtaatagacaaattgcctgctttcacttaatccacagatttacaagggacaaactttggccctaggaatatttattgaatatcatttcatccctgtgacttccacttctttctgattcccatatcaccagcccaagagaacttgagtatctgttcacagctttgctcctctttccccacattaaccacaaagcaacggaaatagaataaagagacaaatgggtaactctaagtaggttcatcacattcattacatgccctgtatccagagccaatataaatggtcttgattctgattgtgttgaggtataaaaacatgctgatttctgtggcaggtattaatgattattacttgtgtattcatttgctcactgctccattctggatgttcttggtctcagggcctaaggatcattttctcggatgcatcacggctcatcttccggctcagttcctccagtggtgtgcgggccaccctcagactgtacgcagagagctacgagagggatcccagcggccatgaccaggagccacaggtacagaaacagctgtgctcccagcagtgtgtctcgcagctcctggcaaatttagagagctccatgggcctttagtggggctattttacctcctggaaaggtacatgataatttcagctggaggacaagctcagggcaactccaagcaagtttaattcgttcattacagtgtttgaaacagaaaaattgctctctcgcatctatttgtaatccgtttagaccagcatttcccaaacaactgtcctctcttgactgttgagtggtttgttaattggggtaaagaaaaagcaccttttatagacaaggaaatttagcgttagagtcaaactggtgaaactctcagagccttgactacgcttatgtaacttttgaatctccagacatttggaccatgaccttgaggtgccaatacagatgggctttgtctctgagattgctacattgtccactctgagaggagaggatataggtggccttttaagttaaggaagcacattgacaaggctaagccagactgtttggcaaagtctcctcatgttttcaacaataaggctaattaagaactcagaaaaatcataaataacacaaccataagcctctccactcccacattcattaaagctccagccaacattaattaataccagaaatgactcactttaatgttgggtacttcaagctatacagctggctgctcctgtcttcttggtgtcttcaatctgggttttgaagcaaggtccttgataagatgattttttcagatgaaaacattggttctacctgccatacttcctttgtggaaaagtagagaaacagagaaatactcactgctactcattttagaggtgctcagaatttctagctataatttgccctgatggagtaagatacctggcaggcttttctttctttgtcagtagtttaggggtttttttgttttgttttgttttgttttgtttttttcatggtctgtttctttggagagtctcaaagaacttggcaataatgggtgctacagatccttacacctgaccctacagccagaagatctgtctggagtaaaatcatcctagatgggacaggagaggctggaggaggctgagagctattctcagggttaccaagagcatgagtgggcaaagcaggtggccagcatgaagcccttggctcttcctctcaggatcatagcctttccatgcaggggatgggacacactctgccaaaataattggttagtgcgtacatttctcccaagatagtaccaaatcatgcaagaatttggggcttaccctgtctttccaaataaaacactattctacatctcatgttggggagggagattaaagcaggggcctaaaagtccagagctacgtacgtgaggaatgatattcctggcctcaccaactctgactcactctgactccgggctattttttcctcaacattcttttccctatttgcacagggcaagtggctgtgatatttgcttatttttatttaccctccgcactggactgagaccaggccattagacaagtgtcacaacaatcctatacacacaagagtctctccctgaggcagtccacaaaagcagtgctttttttttttcttttcccaaggcttcctttgaagctgaaagtctccatcagcctactcttagaaggtcatgtgagtaaaggaaacataagtcatgctggttttggtccccatgactgcacatttctcatcctgttggtggaaagaatttgccactttgaagggttggcgaatcccttcactgacgttgctgttggaatttctgatttcccctcccttctcctcagaagcaagagttttcctagacctggctcgatgggcccccgagtatgtagcacatgatctagctaaaagttttacattaaaatagaactccttgttaaaataccatacatcattgactcaccaacttaagccctattgcataatacatttgagtcaggatataacatagagtaagattttaaaagaaatctaaccacctaggggaaagcaagaagattctctcagcaggccaacctgtcttaattactgctgaactctacctaagcctttaagtgggagcattttgagggctccttacagggttgctttccaggaccacctgcttctgccttctaaaaagcctttgattaactgttgaacagagataaaagtaagatgtactcctgaagctgctagtgttattcctgatcagggcctgactggaaagacctgcttgtgttgctttctcagctaccaaaagaaccccttccaccttctctaatctgcagagattccattgctgatcttgttccaattcaacaggtagtttttgatgttttacccactctaacccaatagccatctacacttaaattattttgcaagagaacagagagttcccttcaactggcttattaatatctggctattttactttggccatggatagtttcttttccagacattttgaacacatgtgaacagagcatgttttaagcatttacactgattgccttgcagacatactcataacaatcctagtgatgcaattaggaaaacttgtgatataatctatatgcatttagaccatactcacatgtagattttccatttgcatccttttgtagaacagtgattatgctatttaagttaatatcaatttcttatctacatcaaaaatattttttaaaaattatatccatatgtgcctacgaattggtggtaaggagaggatgggccggggagggccctgatgagatgggcaggttcttgccctgatcccactctgtgtccttggtaaatcaggaaggaaagcttccaaaggcttgttgctggaagactacctagttttttaaaatacaagtttattttaattttaccagcaatcagtaggccttcaatgagccctcaaaccagctggtaatcatttggaaaaaggaatgagccaaaagggtttaaaatcacaggtaaccagaaacagtacaattgtttccgttttctttcccatccaatttattagcagggctgctattattagcttctcgttgaccttcttcccttgtccctttcagcctgtgggtggagtagttaaggaacaatagaagatccaaaaggaaaaggaaggagaagttttgttaagggctaggaaaatcacagactgataatcagcccgtggctaatcaacccttggctttagtactttcaaggcagaatacagtcacacccgatctcaccccagtccttgggaggggcctgattttcccccagtcttcctgaaaattgaggaatttaagtatttgtttgtttgtttgtttgtttgttttttgagaggaagtctcactctgtggcccaggttgaagtgcagtggcatgatctcagctcactgtaacctccacctcttggattcaagggattctcctgcctcagccccccgagtagcggggattacaggtgaccgccaccatccctggctgattttgtatttttagtaaggacagggttttaccatgttggccaggctggtctcaaactcctgacctcaagtgatccacccgcctcggcctcccaaagtgctgagattacaggtgtgaaccaccacatccggctttaagtatgtatttttgataaactgtacctagaaggctttaacaactaatacctaagaaccaggtccctcatatttattcacctgtcaaaccaaaggtcatctgtcattttgttctacctgttcttaataagactttgtaatccagaaataaagtatagagccattttgttttacataggaagaacatatgatttgtcatctaaaccagaatacagatgctcctagatttacaacagggttacaccccaataaacccatcataagttgaaaatgcattgaatacacctagactgcagaacatcacagcttagcttagcctaccttgaacaaactcagaacacttacattaacctatggttggggaagatcatctaacacaaccccattttataataaagtgttgaatatctcatgaaatgaatactgtactgaaagtgaaaaaatcggtgtatggggactcacagtatggtttctactgaatgtgtatctctttcacaccatcataaggttgaaaaatcattaagtcgatccagccaaagttggggatctgtacttttgtgagcgaaagataataattgtaattatgtttagattgtccccaataaaccaggagacatgattactctagctaccagcctgcatcctctcttagaaccgcatctctttggagatggctttctaagaaaactagcaatgaaacctggaaggaaagagggaacatacagaaatgagaagagtcagctcagaggttctcaacccaggcaggctgcacatcagaaccactcaggcagcttggtgaaagtacccatgctttggccccagtcctagagattctactttaattgttttgaggtgggacctgtagtttttaaaaaatttcccagatgatattaattagacaagtgcatctcaaactaattaccggccaatcaccttgggaatgtgttaaaatgtggattctgactcaggtatgaggagggccagagattttgcatttctaacaagctcccaggcaatactgtgctgctggtccaggagccacccattgaatagcaaagagctaggtgaactgtgaagtgctagcagcaggaccttgaattctttaaaactgtagaatgagcagcacctgtttttaataccattccacacatcgatctctgtcttctagacttctatttctgttgcttattggattccacctgaatgtcttatagacatcaccaacttgacatgtgcaacactgatttcccgccagcctcctgtgcactcctccaaaacaaactccagcatgctgtttctttcattcttctccatctcagtaaatggcagttcctaaaacatgttagaccacctcatagctctgatagaatcctcccctccacctcatttagagaagagcccaaacccttaccatgatcttgaatgacatactggaaatggcccccttctccctctgacctcatttcctatctcttttcctgcttctttctccactccaaccgctgtttggtgaacatgacgagaatgctctgcctcgtgttagttacgatggctgttccctctgcctgaaatgcttttccttctgacatctgcatagcttgtctccttacttctcagtaagggtgtccctggccacctaatataaaatagccctcacatgcaggtacttcttacttccctaccctgctttgctttctccatggcatttatcctcatcatatatatatatatttattttattttattatctgtctccacccagtagaatggaagcaccaggaggctgggactttgtcagattatttccctgtatccccagtgcacctggtacatggtaaatgcccaacgcagttttgccaaattattgcaatattgaccattaattactttggaatctctcagcccaattatatcacacaggaagctgaaatattctgtactcaggatgaatgttggtgctatcatcaggtttcctcctatgactgaggtcttgaataaaataaatgccatttttaaggtccctacaacatgcaggctccattctaaatacatcctttatcttattcatcgttccagtggcctcatggcagaattatcctgctttgcttttgcaggaaaggagactgagtcaggaagcaattcagattcatggagtaggtaatttctggattggaggtttaaactaagtctttcttataacaaaatccacattgtccatgttaacgttgaaggcccagaagagaatttctttttatttgtgcttgagtccaaggctacctctggagcctcagtacagtgttattgagaggttttttcctcagatcaatcaattctgtgattccctgacaccaactgggtgcaacaattctattcaagtcagttctgacattatctggatttagcccagaccccacaagttaagggctcagtctcacaagattgctcctactaggaatgccagctgcaaatggggtgcacaggctacccacatttttgccttgccaactacaaatttagggttttctacaatcccccttcagatttaataattcactagaatgactcactgacctcagaaaagtgcttcgcttagcattactggtttattataaaggctagaacccagaaccagccaaatggaagaaatgcttagggccaggtgtggagaaggagtgtggagcttccatgccctctctgggtaagacagcctccagcaccttgatgtgttcaccagcctggaagctcttcaaaccctgttgctgaagtgttcttatggagttttcactaggtaattatggttgattaaatcattggcccttggcggttggatttggtctccagccctgctcccctccctataggtcacggggtggggctgaacattcaaaccctctaaccacctgtttggttcctctggcagccagccctccacctgaaactatgttggggcccaccaagagtcacccactagcataaagtctgctgtggctgaaataataacaaagactcctatcattcaggaagttccaaaggttttaggagctctgtgccagaaattgaggacaaacaccacatgtatttgttattccacactgttaaaagaagtttagcctaaagctgcctccttacataatttaagtttggcctaaaggtttttccatacatagtgaactatgacctaactggatgtgtaaacagactgtaacctactcttgtgacaagtagctgagtctcagccaatcacagtggctgagtttcagccaattacaggcagccactttttcaaaatatgttcaaataaggcaaaaactgagctgtaaccaatccagctatctctggacctcacttctgctttctgtacttcacttttctttttctgttcataaatgttatctgacgtcgtggcagctccaagttgctctgaacctatctggttctgaaggctgcctgattcaagaatcgtcctttgctcagttaaactcttaagtttaatttgtttaaggtttttcctttaacaacagttgtaaaagtgaatagcgtcttaaaaacaaccagttttctgtactaattttgaattagcaatgaataggattcagaaacattatgaaaataataatgttctaaatacatattggatatcttttctagttcataagggatctagagtgagtagtcaaaaacttggagaataaagtagaaatggatataatacatatgatgtgaaagagaaacagaatggagttcagaagtgatgcaaatccacattcacttagccattcactttcatgacaagacaaagatttttgtatatgtatatgtgtgtacatgcatgtgtgtatgagagcaagatttggggatcatactaggtatatatgatttaaagagctaaaagttgtgcctcggtcctggttttgggtcaagtttggattacagtttatagccccccaaaccctgaaaaaaattatatttcctctccttactttcccatatgtagttaaaaatgaaaacaaattcaattttaaaaataaataaaagatgttgttatttaaaaagaaaacctgagcaaggatatattaatagccatatatatgagggaaaacatgaggaaatacctcattttatttttctcctcagaatttggtcggtattgctgcactttggaactatgggggagggcaaagtgttgaagagagagttgagaagagaaacacttggtgaagagttgggctctaaactctatgaccaagttaaggagctggctcattccacttagacgagaggcgtgacttggaggtcttcaggaatttaaggaataatgtgaggcgggaaagatgaccagctgttctccataactaatgaatatgtaatttgaggaaataaactcaagctgaactggaagggattcacgttgactgttagaacaatttctcaactgtcaagactcctgcccaattaggatggctagtttgtgcttttctaagtctctttgcctacatatattcaaataattttaaaacaggggcaagagtagaaagtattgagcaggataatgtctcaaagtatgtgtcagccttaaaattttagttctgtaattataattttttttttttttttaagaaacaagaaacaagttctggtcaggtgggttagatttccctctagtggtgttgaaaggaatttagtatggctgtgttttcataactggctcttggggcggaattaaacttggaaagatgcaaagatgtataggtttttttctatttctgcttagatgagtactttctggaaaggcagacaaaacgccagggcaaacagtccttctttttcttccttagatattgaaatctggactcatactctgccgttactacatattgttttccctggagctgagaacactccttgggagggttggtcatctgatggcatgtgaaaaactcccttggttgggaatctgggagattccctcagggcctagtgtctatcatagaccagggctttttacagttttgatgacaataagcctttttcttggccaaacattgtgatcagatctcctttcaaggtactgagtatgtgaagccctgtgtatccacactccacatggtctaggacttgtgggaaactatggactgccaccgtgaaccactcatgttaatcccacagacagagcccatctcaaatctctctttgtggcaatatatacaaaagaggcccttaattccaaatcttgcaagaataccggcattgccagcttatcccgagaaccagtggtcttaagaacagaccactgaagagccaaaaggcatgccttgatcctggctttaggtcaagcttggattacagtttagaaagcctggaccctaaaaaaaattatatttctcctttctactttcctatatgttgtttaaaataaaaaacaaaattagctttaaaaataaatataaggaaacctaaaaatgttttgatttttttccttataatgctattctaatttctaaaatattaaatatcaacttcttaccaaaatatcttttgttttggtgccagttttaccatgtctaaagcacatgcttaaccagctattggttaacccagtgatgtttatatccacaaatcaccaagtcttgctggatcttgtttactcagcctgaaaaaggagcatgaatgaatttgcagcggtcacacaagtccagaggtcactggtcatcacttctcttgccagatggatgggtttgacaagctgtgtccagcacaatctgcctttcccagcagcctttttgttctagcccagatgcacagcacaaccacatttccgtgcctttcaggagaaagctacccaggtctcatgaactggtggtgattcaggttttctttgaagtggtgtccttccttggtgtacagtaaataatttgctttgcttatataataaacaagagtgtatcttaacaaatggggactgacagtgaacctggaggttgcctgtggccttcagaaggaagctctggactagtgtgtgcaattagccagcatctggaagcagcttttcctgggcttcccaacacggtcatgcttcattcacatggggaatacaggatctgagctgttaaggggagaatgtggctgtttttgctctcccgtctactcttggctgaatttaagtttgatgccctaatcccagaacgagaactcctgttcaagatgcaggtgagggagtttcccatcccttgtttttgactcccaggaacgctggcaggcctgacaaactccagggaggagcatctcaaagccagaatgcttaggccttgggcaggagggaaagctgttaaaggtttatacaattctggtatcgtgtttgtgtttttggttttacttttgagcatttttgttggtacaaatcatcacttgggacatactttggcaggttgggcctgtgtactataccatcatgatatgagatggaaggtagatgaggctgacagagtggcttgaaatgtagacttcattattattcaggtatggggaggccaacagatgatgagatgacggccattgaagagatagtttgttactcacagttcccaagaggaggggacccaacacgccacacagggccacgcagggaagcgccagcgtcggacaggaggcagcatgagcaaagggaaaatgtgggtgaagcctttttggagattctctgggaaaggtaaggtaaagcatgatgagaaggtttaggattagcttgtttgaataatttcagcaggctctggggcacagggactgtccctaatttgctggtacctagccttggggtggttagggcagagaaatagtggcccaagtgtgagagccctgtgagggtctgagaaaggaagtgtttggtttgcatctgaaaggcaagctccagggtgtgttgtttgctgtctctaagaattagctaaccctgggaagaacaaaaccttccagagtcagccaggccccaagatgtcaaagcattagaataaaaacaccagcttaacagccagaggaaaagataaaaccactgtcactttctcaggtgggtaaaattgttagggagcaccccaacaagattttgtttttttcacataccatcaaagctggatggcctctgatacaaaggttgggctttgaaatcagcatttttttttttttttttttttttgagacagagcctcgctctgtcactcaggctggagtgcagtggcgcaatctcagctcactgcaagctccgcctcctgggttcacgcccttctcctgcctcagcctcccaagtagctgggactacacgcacccgccaccacgcccggctaaatttttgtatttttagtagagatgggctttcaccatgttagtcaggatggtctcgatctcctgacctcgtgatccgcccacctcagcctcccaaagtgctgggattacaggcttgagccaccgtgcctggccgaaatcagttatttttgttttgagtcctagttctgccattttccagttttgtgatcttgggcaacttaatatcagtcaaattgagatagatatacttcttattttatattgttgtaatgattaaatcagataattcatatatgtaaagagttttgtacaatgcctgtgtaaatcaaagaaaatgaccaagatgagtctcaatcgttttagaggtttactttgccaggttaaaggtcatggcctgtgacacagcctcaggaggtcctgagaacatgtgcccaaggtggttgggttacacttggttttatacattttaggaagataaaagttacaggcaaagacacaagcaacacatgtaaagtatatattggcctggcccagaaaaacaggacatgtcaaagaaggggaggcttccaggtcataggtggattcaaagattttctgattggcaattggttgaaaaatctaagctttgtctgaagaggtaaagtcagtataaacaaatgcttgagttaagataaagaaagttgtggaagctgaggttcttgttatgtggatgaagcctctaagtagcaggcttcagagagaatagaaggtaaatgtctcttattagacctcaaaaggtgtcagactctccagagaagatctagcaagggaaggggattctctacagaaggccgatttcccccacaaaagatggctttgtagagccattccaaattacgtcaaagaaatatattttggggtaagatgctttgatttccttcagtgcctgttatctgtcatctgatgctatatcagggtcaggttggaatttggtatcttactgctacaaagagtctgttctgtcagtcctagaatctctaaatgtcaacagctaagctccagagaggaggatatattgaggcatatgctacgcccttttcctgttatggcctgaactagttttcgggatccttttggccaatgattaggggcagggaggagatgtccattcagtcagtttggggcttagaattatatttttggtttatacctgacatgtgaataaatgttcaataaatgttgattgtcactaatgttattgtttttgcctttttttttttttttttttttttttagatggagtctcactctgtcaccaggctggagtgcagtggtgcaatctcagctcactgcaacctccacctcccaggttcaagcaattctcctgcctcagcttcctgagcagctgggactacaggcatgcgtcaccatgcctggctaatttttgtatttttagtagagaaggggtttcaccaccattatttttattaataatggtattgactcattttcttatcacatgaggataaaagattcccagattacttagcaatttgttttataatgcaattgacttgtccttttccctcccattaacatctcagagaccaaactggatctatgagaaatgtcccaagagaactgacagcttctaaaaacctaggtcttctctgagagctcccagggctctcatgacatggcattttagatgtaccatgctttgtcagaaggttcaaggatgaagtggagtttctctacttgtctctccattcatggaacaaattcactgccctcctggcttggagtaagaggtagtgagtaggggttgttcaatgatttcatttcatccaaataatgtgcaatctgttggttgttccaagctcttttaccagagagaaagggcttgaacactggagtgggtgtgtgatgaaaggcaggttcattgaagaaaggatgcctgaagtttctttgactagccaggaggcatgtgctctctggcttcaagggattaaacagaaaaactggtcccttggagcaggagtcaagttttttctgaataggcccagagagtaaatagtttaggctttgctagctgtattagtttgctagggctgatataacaaagtaccacaaactgggtggcttacaaagcaagaacttgtttcttattctggaggttagaagtctgagatgagtgtgttgacagagctggttccctctgagggctgtgagggaaggatctgttgatctgttccatgcctctctttttggctcatagatggctgtcttttccctgtatctcttcattatcatcttccttcttgtgtgtctctgggtccaaatttccccttttaataaggacaccagtcatattggattagacctcaccctaatgatctcattttaacatgagtacctctgtaaaggccccgtcttaaaataatgtcacattctgaggtattggcaattaggacctcaacgtatgcacttatggaagacaaattcaacccataatattagtcgtatggtctgtgttacaacttctcaactgccactgttgcacaaaagccgccacaggtaatacataaatgaattagtgaagctatattccaataaaactataggcactgtaattgacttaagataattttaacatgtcacaaaatcttatttttttcccaaccattaaacataaaaaccatttttatggctgcaccaaaaccaggtggtggccagggtttggcctaaggcctataatttgttgatccttgccttataggtttctgaatatgacacgttatttacaatttctgattacattcagtacagcatgtatcaacatgagtttgggtaaaccatacacactataaatttcaaaattacatttgtatttgtgtatatttgtatacatagatgaattgtgaagttttagggaaaaaaatatcaaatctctctggaaatctccagcatgaggcttctgaggttgaactccatagcttttgattgcaaccaaacatgaaagggaaatgattatgtttgtattcatgaaatcaaattcctttttcaggtcttttgtttcttgtcagaagggttcttcatttttctttttaaagcaattgcttacacatgattttcagaagagcagcactatgtcagaagaaaagggaaaaacgttaagaaataaatgggatgaaaaaagaaaagtatgaatatgagccctggtgaattcttacaaagaaagggaagcaaacacgtgacattcagtagtgaccccaagccagggagtgctgtgacattgcatgtccctgtgaatggggcttccgggagctgataacaaggttctagtgcatttcagtcacattaacagtgatcctcaaacccagtctccaaggaacctcaccccatttccctaggaagtagcaattctgttgtttttattctttctttctttgcttttaattatattcttgggaattacagtcaggacagtcagtgtggtgtttaacaaaagctaagatactttgatgatatactgagatttcccagttatacattttagactgtctttgaccatgtaagtgtttctatattgttgaatcaagccgctggctctgactcatatcagcccatgtttttcagaatttgcagtcattatgaattcactttccttttaatggataagatttgataaaaagcttaaaagaaagtacttttacactgtttttaacagcgctttatacttttgctacactaaaggtagttcttggactagcagcatcaacatcacctggttgctacttagaaatgcagaatctcgggccccaacccagatctactgactcagattctgtattttaacaagctcctcaggtgattcatgtgcacattaaagtttgagaagtcctaatgctgggcgtggtggcattagcctataaagtgccatctactcaggaggctgaggtggggaggatcccttgtgcttaggagttgaagaccagcatgggcaacttaaggaggccctatctctaaaaaaagaaaactgatgctggctgtactggcttaaacctccaatcccagcactttgggaggctgagacgggtgaatcacctgaggtcaggagttcgagaccagcctggccaacatggtgaaaccccttctctactaaaaatataaaaattggctgggcatggtggcaggtgcctgtaatcccagctactcaggaggctgaggcaggagaatcgcttgaacctgggaggcggtggaggttgtggtgaaccaagattgcaccactgcactccagcttgtgtgacagagtgagactccatctcaaaaaaacaagcaaacaaacaacaacaacaacaaaactggagggaaaaaagggcaagaagtcctgtgatggatgacctttgggatccttatttccacctctgcttagcaggactgacattgtctccacaccagacaaaccctctaatgccaaactaaataggatgcatttataggggtgcctggcctctatttcttcctcatttaggaaaatcataaagcatgcagaaaataacccagacaaatgtgccaagatccttgaagacttgttcctgcttctcaggtcaattaacaaaaaaagaaacaagaaaatcagtttcaagttgcatctccatagaaaccctttctcaatatcaactcagcagtgttagacagttttcttcacacaattatactagttgagctgagagattcaaaataacagtggatgaggtaaagaaagttctaatttgattttgccaaggcacaaagccttgctaaaattgtgggtagacagtctagcacacttcaattactaggaaaaggtcaattatttaaaacactttaaatatgttaggttaaatggcagctgagtctaaaggcaaaggccataaaagaacatgttcctttgtccaaactgcattcataaagtgtgcattaaccatccattaatttcactaatagtctttctattgtggggaagagtctctcctcgtttacagggctcatttccatgtttttagtgcctggtgttaatgactgtcccactactgcctcctccgtaagactcaggtggccctcacggcagaagttctcttctagtttgcttctgctactcaactctgccactcagctttgctcaatgtggaagtccttgctaacttctttagaatctgatacacccttaaggaatgtgttccaaaagctatgatgtctgttccttctgttgtcaacatcaccttacgcaactgcaatctgattgtactctctctggctggatatatagggcctgttgcacacaaacagaaatgcaggcaagctttcccccactgggtgtgtcactgaccctcttgctgacacagagagatgttgcctctgatttgagtggctttctcactccaagagctgggaacaccccaacattcttaatctctttttattttatcttttatcaaaaagataacatgaactttattttatgggcaaataaacttaagctagaagggttgttgactatctaccaaaggtcagcttattgggactggtatgctggtccactcacctgtagcctacttttctattaatagcaagtcaggcttctgtcttcaatgatgatgataatggtaataataataataacaatagtatcaagtgcttgccccgtatgggggctaggcagaatgctatgtgttttgtgtgtgttatatctcattctcaccacaatccaatgctataggtagtcatgctatccatccatgttttacaaataagaaaactttggccctgagaatttgaacaatctactgtttctaaacagtgtccctggtatttgaacctagatttgggcctcagagcccaagaccttaactaaggtccttattatgtgccatcaaaaaatatgggggtgctcacccacctataaaaagtaaattggagtagaccagcattcccatcttcaatctggcatagttaacacacctcaatccatcctctaggaatgttctagaggcagtcctcaagccccacaattccagactagtagaaggtgtggtctctctttcagtcctcctattcccttttatgtcctcagatcctttcccaagggctagccctttcttagaaggctgtaccctctggaagctggagaatgccactgtgctgcttgtaactggttacctcaagtaggctgtggggtggcagttaggcgaagtacagagagactgtgaactcttctcccggagaagcagcatcaccacctggggtgaacctcaccatgggtgggcctgagaggaggtagtggggtgggcctccaccatctggccactgaggtccctgcctgggccttggcagtccctcaacatgggagggggaagagcacacactctcaggactccactcagccaggagttctccttgccaaagtgggcctggggtctcagcctctttgctttgtgacgtccaccacacagctgctttgccagctctagtgtgctcctaggagggctgggttgagtggagacagttcctggatttcatgtttatatagttctgtttttttgttttgttttgttttttgttttttgttttgagacagagtttcgctcttgttgcccaggctggagtgcaatggcgcggtctcggctcactgcaacctccgcctcctgggttcaaacaattctcctgcctcagcttcctgagaagccgggactacaggcatgcaccaccacgcccggctaattttttgtctttttttttttttttaaatagagacggggtttctccatattggtcagactggcctcaaattcccgacttcaggtgatctgcccgcctcggcctaccaaaatgctgggattacaggcctgagccactgcgcctagcctagttctgtgttgtagtcatgagcagttgagtccatgctgagagtttgcatctcagggcataggcataataggggacggggaggactgcagtacctttactccccaaatggttgctgggctcttacgcaaatctgccagccctccgcagtagtcttcaaggccctcataatacaaaaatctctatttcagaaaaagagaaaatttaaattagaatgccccagattcctggatatgtaactatccaggtaaaatttatacttattaatattaaaattatttcactgcctctagtgtactattgcttgttcagtggtagcaaattcagtcacccaccaacacaggcagtaagtcctagattggggccaatttaagacaatagagcatggtgggcactctggtgatgctcagctgtctttaattattgcattgttaatatgtgagctcaaggttgccaggttttctgattttaaaaggagcaagatatctggactttcaaatgaaatttgatttttaaatattggcaggaaaatgattacaaaacaacacaaatcccatatgaaggacttctaacttttagtagtggtggactaggtgattcaaactaaccttccctctgtaaagagctgaaagaaatatattaaagcatcttattaaaagcatggttgaccaatgacctaataaaacagtaacaagaacaggaaaagggttggcactcaggaaaatgagccaaagctctttctgtcctagggaatttgtccatctaggagaggtactaaagaagaggtgcttttgatgactggcacagggtaaaggtgaccggcatcaggtccaggtggaggaggatctggtctattacagtctgcctctgctaaccaggagactaaccaaagaggcagcaaagaggcagacctgtgtggcattttcgtgtggccaaaagaaatatggttagttaagtacacatcaaaggcagagatcctggcttaacaatccctgctctagggtgtaaacttgaagaagaccattccaaaggtggtatacagactgtactccagaggattataaatccatggctctgatcttctggctccctgaggagtctcatgaaaggaaatgaaggaaactaacaatattctaggtctccagttatttctataagcaatttttcaaacaaaatgggcaccaaacaataaaagattataaagcacttggatacacaaagcaacacataccagaatcaacagaaacaacataccacagaaaaagatctatagatactggaatttattcaatacacactgtaaaatagttattttcactatgttcatggaaataaagcactgaatgtaaaaacatcagcaaataactgaaaactataaaaatacaccaagatgttgaaattaaagagctgagaaagataaccaaaattaagaacataaatggatttaacagcagctgaagaatatcagtgaacttaaaatatttcagaagaaactatgcatctgatttttcagtttagtccttatgatttgcagaacaaagaatataagattgctgcctttggaagatgaaagatcatattcggaaaaatacagaatagagggtaagagacacaaaggatacagtgagaagtgctaacataatttagttggagtctcaaaagaggagacagaaacttgggtataggcaacactggaaaaaatgataggtgaagatttcccagaaccaatgaaggaggtcagcccactgattctagaaagccaagcaggatatataaaaataaattcacatctagacacatcaggctaaaattgcagaaaatcaaaggcaaagaatagtttgattgacaactaatttttctttatcaacactaaaaataaggagactgatggcttagaactcttaatctagtgaaactttccttctaaaatgaaagcgaaataaacacatcttcagataaacaaaagctgagagagtatctacacaaaaagaaattctcaaggatattcttcaggaagaaggaaaattatcccagatagatatttggaataaaatgcagcaaggaataaaagaaatgttaaaaataggagttggtataaatgaacattggctgtataaaatattaataattgctgaaatatgtatattaattaatatggagaattaaattatacaaccacagtaactaaacaccatgagcataattgtagttaaggtaagatccttgaatatattggaagaaaataaaggtatagataaatactagactttgataggtcaaggattcatgttgtagtttctaggtaacgattaaaaaaaatagaaggaaattacataacttcttaagagaggaaaacataggaactttaaaaaattgagaaagaaaaacagctaggtcaatttcatccatgtatacatatgtaactaacctgcacaatgtgcacatgtaccctaaaacttaaagtataataaaaaaaaattaaaaaaaaaaagaaaaacagctaggtcaagtaaaaagcacataaggtggtggatttaaacttgaatttactggttattactttaaatataagtgaactaactgctgtaggaaaaagacaatgtaatggtgattcatacctgtaatcccagcactttcagaggccaaggtggtaggattgcttaagcctgggagtttgagaccagcctgggcaacataaggagaccttgtctttacaataaataaataaataaataaataaataaataaataaataaaattagccaggtgtgatggtgtgcacttgtagtcctagctaattgggaggctgaggtgagaggattgctcaagcctgggaaattgatgatgcagtcagccatgatcataccactgcgctccagcttgagtgacagagtgagaccctgtctcaaaaaaaaaaaaaagacaactataagctcgttataaaaaatacatcttttatacataaaaatacagaaaatttgaaagttaaaagacggaaaaagatatacaaatgataacctaaaactagctctattatttcagataaaatagactttaaggtcaaaagcattgctaaagataaagagagactcttcaaactgataaaagagttaaatcccccaggaagacacagtagttttaaatttataaagaaaaaaaaaagagggagagagagatgaaaatgtaagaagaaaataaatccacagttgcccttgagtattttagcacccctctcagtaattattagaataagtatacaattagtaaagaacatagaatatttaaacaacttagttaacacacctgacttaataggcacatatagatattacaccacgcaacatcaactcaacgtgtaaattcttttcatgccacaggggacacgtataaaaattacctatatgctgaggaatgaaagaatacagagtattataagggcaactgaattcgaaaatgaaaacaaaattgacacaaaaaaagcttttgataaaatgtatcatctcttcatgataaaaattctgtgaataggaatcaaagggaagtcctttaatatcataaaacggtattgctaaagaaaaaacctggacgtaggctatatgtgctgacagtatgctaacaagggagaacgacttgatgggttcatttagaactcaaataggctttgtcttcagaaggacaagcatcagttttacatataattagagtatgttaaattgtttgcatttccctgtgattgttatatttaataatccttaaaaaggtaattttcaaatagtgtgcctagaaacagggaaacttttggcattaagacaaatatatttataaactttcagaaaatgaaaacttttccctcagtataagggcagtctagatagtgagatacagcctagctttgaggttaaaaatcacagtactgagtaggttcagagctcagctttgccacttgattgccatgtgactgcacaagttatgtaatgagtccaagcctcagtttcctcatctgtaaaatgagaataataccacctacctcatagactgtttagagattaattcaatacatgaatttggaatagcacttggcacattttgggtactcagtgccagctattacaaaattactaaagaatcaaaacttagaatccaaggcacaaagtatataaaatggcagtgaggactgagaacactgatcgtggcttccgaagtcttttggagaagaaagggaggaaaaggaggaaaatggagaatggagagagtcctttgagtaacaaactggagaggcaaaggtccttttgtttttttaacctcggtttcaatcttgaagttttatttctgctaaccatttggtaaaggcagaggagatcctaatttccctttgacctagcaagtgtattccatgtgaaagaaacctggaagcctagtgtggatatacccaatgaagagaaatgtgaagacatgtgagggacatttgggagggatggggatctgaaccaattagtaattccccatccttttacaatgttttggtggcagaaggtgaggggagaggtggatagaaagaaagaagagaggaacagggaaaccatggccagggaaacagtcctaacaatttaaactgacaactcttgcaggtaggtttgtagtattcagcagcacagtgaaagggctcagagattgtgcctaaagcctctcagctgctcctacagacagcggccagtgctcttgctctctccccttctccatccacacagggcatggagccaattagagctcacatttgaataagaatatcgggcctggcacagtggctcacacctgtaatcccagcactttgggaggccaagacaggtggatcacctgaggtctggagttcaaggccggcctggcccacatggagaaatcctgtctttactaaaaatacaaaaattaggtgggtgtggtggtgtgcacctgtaatcccagctactcaggaggctggggcagtagaattgcttgaacccaagaggcaaaagttgcagtgagccatctgagccttttatatcaggggctcacatgaacaagtctcttgtaaaaagaagctctctctgatgaaactgagaacagatagcagactcacgcaagctccggatggtggggcagtgtgttaaggaaacaatggggatgagaatgaggaagtagatggggagaaatagaatcagagggtttggcaactgcttggatgtacaggaaagggagaaggacccaccaacaagtacttccagctgagcagattgagagttcagagggacctgctcctagcaggaaagagaaggtggaaccatggactggcgtagcgaggaagttaattttggtttgcaagatgttacatttcatattttgggtttgttggtggtagaatactggaccatgatggtacctccaaacaatctaagagaaacacattttgagtgtttatcttattaattgtgattttattttaatttgcttaaaatttttgattttaatacgcaaagagaccaaagttagctcaagaaagtcaagagtagggtctgtcacatgtccaaatctcagagactagacctggagtatggttaccacctcaggccttcctattgggaggtaatggatctttagagataattgggagtcatgccattgttttctctctaccaactcctttattatttccttctgctctctttaattcttctcctggtttcaccctgctttcttataattttttgtcacctttctcagagtctctgctttctcataatccaggattaccatggagtcttatgccctcatggttaattaattataacctcgtgatttagttcccactactaactgtccgttctttcattacttacagttcaaatccccgaggcaaataatctgctaggctaggtgaagtttttgccccaggctctattgtaggttgctagccagcctctctattggctgcctgtaggtcagacagccacttctggtccaatcagctgcagccagggagtgggatcatgtgatgcaaacaatgcagcctgggtttgggctggagcaaagcatttgacaggcacaataattagagtaccttagagcagtggtcctcagagtgtggctcctggaccaacagcatcctgggaagctgttggaaatgtcagttcttgggccccaacccagaccccttgaatcagacactcaggatgaggggtgctgcagtctccactttaacagacccaccaggggatactggtgcatgttcaagttcaagaaccactcccttagactatgcaaaagcatattgactaaaaatgaatgtttgcatgaaatctggagagaaagcctggcattcaggtttagcaggttttaaacaaagtgggagtgttgttagttgatcctagggatcaggagaaagtagcatttgttataaatctctattttatggatgccagaatgtcagtgttttctgttgttggatgacctacctgcatttctggtttgtattgcctgccccgaaagatgaactatggtaattatcgtcatccacacctattcactctccacccatggctccaatccttccccgactgtacaaatgcacattcctcatagagaccagcccagcactaggttccctccacagattctgacaaatcttgcttgataagtgattatgattctggttagggtattgttttcctccgaaaaatcagttaactatttactttgagtcttgtgacattcagatcatttacatccttcctgtctattgcttgtcccagagtaagaagttcagtttgttagggttgttttttttttaatggatctaatttacatgaaagtggattataacaatgacataaagcaaaagagaagatgggagagaaagtaaaaagagaaactctgtctttccagggagtatggacaagttaaaacctaatctaggatttatgtgggctaggattaatgtgaggttaactgggtgcaaaatttaagtgggtgtggatgccaaaatactcagtaatcaagataaatatcgtagtgcaatttttaaaaaatcaaaatcaatgtccaaaaaattcatgataaacatagtgtcaaaactttaaatagagagaggatccaataccccctgtagcctgtctacattaatggacagcaaacatccagaaaaccctgcaaggtggcagaagatgccatcttgaaaggatgcaaggcctgcttggtttggagcaagataagcgttcactgcttcctactgttgactgtagaagaaatatgttaggcactctaaaaaacactggaattagaaaaaacaatgctatactctaacataattgattaaagtctccattaatttatttcctttattcacaaagggttattttggagtttccaggacattcacataacccacataactgagaacacctcttctcccactgtctgcctggttttggtcagggaggaagactggtcagtcctacccaactcctcatctgatgtgggactcatctggtccaatagggttgcaatcccatgatttccctgctcctccccattcagtgcattttgtctttctctctttatccttgtcactctcagatcttatatgcagaactgtatgatggaaaatgcagtagaggagcccactgtatgttcttatcccagctcagccaccaaacagatgtgtgaccgtgggtcaatcctgtgtcgcactgggctttagtgtcttcatctgtgccatgaagaaatcaaatgacaccaatccacattcctctctgcttttgaaattctgtgcttccagctccatgttagaaaactcacatccacagttcataacccctctttttgctcctcattccaactgcctctccaattgccccaggaaaattaactcccacccaccatgaggcatggtcgatgacatgagagaagagtttggggtttacgtgtatcagaggagtgatttctaaagaaaaacatgagtaaaaacccggcactgttgaccctcccacatgcacacaatgtcctccaggaatgcccacaggagtctctatttgccttatcatcttttcatcaaatatatcattcatttactccacaaagatgtattgagtatctcctaagcagtagatactttccttagccctgaataagacaaagtttctgccctcatcatgtggccactcattctagcacatatatactgtcatgcacggcgtagtgatatctctgtcaacaacagaccacatattccatggtggccccataggattggaatggagcatgtatagaaacctgctacatggcacttgatattgatgttgcgaatcaactaggggaaatgattgatatttagtgatggtgctgggacatttggtttcccatatgaaaaacaatatataaataaaaagatatataccatctaggtttgtgtaagtacactctataatgtttgcacaaggatgaaattgcctaacgatgcatttctcagaatgtatccccatcattaagtgatacatgactgtttaatttatacactcagggaagaaaaaatatattagtttattagccttaaaaatgggagcttgccgggcgtggtggctcacgcctattatcccagcactttgggaggccgaggcgggcaaatcacgaggtcaggagatcaagaccgtcctggctaacactgtgaaacctcatctctactaaaaatacaaaaaattatccgagcatggtggcaggcacctgtagtcccagctactcaggaggctgagacaggagaatggcgtgaacccgggaggcggagcttgcagtgagccaagatcgcgccactgcactccagcctgggcgacagagtgagactccttctcaaaaaaaaaaaagaaagaaagaaaaaaaaggagcttaacttgaagtttcctttccagaaagctggcaaaaaattcaatcttgggtatttttagggacttcttcccaggccttcctggggtcatacaaaatctaaagaagttctgtggttcctggaaaatggctgaaaagactgaacatcagtgaggtggtcttcttcccaaacactcatatttcccggaaggcagatgactccatggcatctgtgccggattagcccaggctcttggctcaggatgggagtcctcatatttaggagtttcctcatgtggcattttcttcccttcagcttgcataagcaccacggaagccctcttctctgacatgaacagaagaagggacaagtgcttggttgatgaatccagaaacagagttaagtaggtccactatacacatagatatcctattacatttgtatcataaaacatataaatgtacatgcatttgccagtattttgattttggcccaagacctgttctttaatatgagcatactgtttgccattgtgatcctctttcttcaaaagattcccactcataattcatcatctataatatctgtctttgattcctttatattacagcgggaacttaaggacaattgtgaagcaacctgaaaaaataattcttctataattttaaaatttctccctaatattttgtagtatctcacccacatctaatttgacaggattagctaatcaccattatctgttctttccaaaacactcaacttaattttcatagaaaaaaagtcttcttatttgcattcacgtttcattggtttacatataattaaattgcatagtctcaataattagtacaataggcattaacatattgggaacaaacttaactgactcctgataaacacagaactcaactgctgaagggagaagtaggtgagcatattagaaagtgatcttttggtcacggacatctagtgagctacggacgtgagtcaggatgttttactgaagaagtggaaagcacgcgttagtttgtagagttaagtggagatcagaaaagagaacttctctggtgtttacagtatttgttaaaacttgcttccccgcccttttgccaataggtaccaccacttaaagatgtggagtcaaaaaatcttgaaatttacaatgatgtaaaactgaatatgttttaatcctttagttccgtaaggttcaaattcattttcattgcattttcttaaaataataggatagtatatgtttatctttattcaccctctaaaacctcagctaaagtgattgagtttaacttcactctctttttctgtctgagtttaacttctttgataggtgttaatgaagaattacataaccaaaaagggggagcaggaaagagggaagagaagacaggaagaggagcaaaaactaataattgaatttctgtacaaaatgggcactttgctcctaaagaatagagatccctctatcttggcatcacatgggatatgtcctggcaaaatgtgccagtgtaaaatgtttctgggcaccaacagggttattaagaggaaaagaatcccttctgtttttacgaatcaagatgatcaacacggaaccggaggaaagtgccactttcttgtgttctagattttcatttttcttccagcttccaggagtctatgtgagcttgtccatctagccatcttcatagagtaagataatttaatacatgtaaccataaattgctgccagatcaatatttccaaagcacagctgtgatgtcacctttcagcccaaaacacttcaatgcctccccttgcctaatgaattaaaaccttacacctcactctagcatttaggtccctcccaacaagactggctcacatctctcaggattcttctgtatctacatgccactcaggacacaatggattgcttgtgatgtcttgtaccttgtgcatttccttgtgttcctgttgtgtggattggaatgtgtgcactccctttatgcatgggaataggttagggcccacaaggaactgaattcctctccccctcccaaaatgcaagccttcttttcctgaattacagaatttttgtttcttccattatcctaatattacccaaacttcttttctatcagtatctctatattaataggtgtctttattttttattttatttttattttttctttttagagacaggcagggtctcactttgtcacccaggttggaatgcagttatgcaatcatagttcactgtaaccttgaacttctgggctcaagccatcctcccatctcagcctaccgagtagctaggactataggcacacaccactgcactcagctaattcttattttttgtagagatgcggtctatgttgttcaggctggtattaaactcctggctcaagtgatcctctgcctcagccttccaaaatattgggattacaggcatgagccaccacgcgtggccaatatttgtctttaaattgactcactttgtttttacctcaatctacttatttattataaaagtactctacatggaaaaaacaataccacttgataaatataagcacatcatgaacatgaattcaataaaaacattcagtgacattacattctagctgggtaactcctgaggcatgcactatcttggttaaattgttaaagattggcagcaaacagagtttctccttgatgaaatcagaaggattgaagaacggaaaatagactgattttctcactgttttattagcaataccatatccatgcaccactgaaaatcattgtgagtgttgcatgctccacacctcggaaaacaatgcctcaatcccatgaaacaataagaaagaaatgagtcttcctccttctcatgtccttcaacttcccaagaacctattccttaggcttctaaagcatgcccacctcctccagaaaacccactgaggtgcctcataagcccagtgttacgtaatgggaaggcatgatcagtcatttctgcaacgttggccaatgaattggtctgtcatttcagaaacatcaggattgtgggttctttaaatccatggccctaggatgaagaatgagcttttattctcgtgtgtgtgtgtgtgtgtgtgtgtgtgtgtgtgtgtgtgtgtgtgtggtgaggatgagggtgtagcagcagaagactggagtttttctgaactcccttaattcacaatgctgtcttcatacagtgctctcatgtttggtagttgggttgtacattttcctattatagataaatttcttttgaagctggttaagactttggagatcaccttctccccctactctcctgccctgcccattccaactaccattggtggaggaggaagcaaatgtcctgctcatgaagactgcctgtaaacagtgaattggaatctgagtccagatgcttatggtagaaatccatcagaatgccccaaaatgtaactgacttgagttgttcacagactttccttttccttttgcaggcagtgctgagccctctcatagccatcgcactgaaaatatcccagattcatgagagaactggccggaggggacccactgtcatcacctgaatagaggaaagatcactcaccagggccaaagagagtgctcagcgggagatgcttcactgatgccttcttgctacctgtttgtgcctcttatgactttggaaaaacaaaagatattttgcttttgggggatagagggtgggtgggaaaagaaaaaaaatccatttggttttggttttgtcctattcctccaaatgcagcagggcctttagttgtctgttaaagctgcactataatttggtatctacattttatcacacaaaggaacctccccttttgacaacaactgggctaggcagctgttaatcacaacatttgtgcatcacttgtgccaagtgagaaaatgttctaaaatcacaagagagaacagtgccagaatgaaactgaccctaagtcccaggtgcccctgggcaggcagaaggagacactcccagcatggaggagggtttatcttttcatcctaggtcaggtctacaatgggggaaggttttattatagaactcccaacagcccacctcactcctgccacccacccgatggccctgcctcccccatcccatccccaacatccctgtaccaccttctctcacatcttctaaagctttgtacaaatcacaatggtgcacttccaacaaaatatatcaataggtgttttcctctcttattttgtaaatagtattattttagctattaagctggataccttctttcaaattcagccattcagttgtaaagttgggaagaagtttcttgacaagactctgcaattaaatgcttaaaatttggaggggatccttccttgattacatcaagtatgttggtacatgggtttatacaagttcctcttgagaaggcaaaaagaccaccatgtgtgagagctctttgacttggccaataggggcctatcttaatgcacttgtttggacacatttctgatcttatttgtaaaggctgcaaaaggagaggatgaaatgctgtaaaagtaggaaatgaagtggaagctggaagaaaatgtaattggtggtacagctatgggccagatggtggaggggagggtggggacccctgccggcaagcagagtgtcacagctggctttcctcacttgggaaaagggtactgccggtctagcagcctcctctgtactcagccaggacacccagcgcgtgggacctgtttgtgtctgttttgcttccttgggaacggcacagtcactcaccctgccatttgcggaaatgacctggtgcactttgactgttaagcaatgcgttattgctgtagtcaaggttagtgcaagcaaggaaacattcccagtaaggtatttgtttccattttctgtctgtgcttctgtcagaaacttgctaggacatttagtggccaataaaaaagaaattcctaatttcaacctta

SEQ ID NO: 687 - DNA, 4286 bp, Homo sapiens
ttaagaaacagctcatttaatattttgtgtttgaaccatcttgaaggcaaatattacagtcattttccttttacatagaaaaaatacatatcatgaaaataaaataatacaaaataacattcatgggttccgagggcatatctcccaggatgtgaagtactgcctcactctggtagtatggtcagctggaggtaactaggaaacaagctaacaaaacaaaaggctgaacaatcaataaattaaacaacaaaccttcgctttgagattactaggtgatatagaacaggaaggcatgtggctgtcctgacaaccagcatctattcctccctggctggagttgaggtgatgggagggaaattgagtgacagcagaaagaatctctgtaagcagagctctcagagtgacacctttggggacccaaggccagccggggttaagattagtgtgaatgctctgaaatgtctgcttggtgttggccacacccttccagggcccctggcctgccctgccctggcatggccagttatgtctggaattcagggctgtcatcccctccccaagctctcttgtggggtccctggtgtggcttttcctcccacagtccctcgtttgcctttattatcagtagctgctccccacagtggtggcatcatgagtgctggagagctttctctgcctcagcactcttggcctcgcctctgggcgtcctctgagattgctgtcaccaccaggccggctatggactctctataagatggtggggcctctgggtgggagtcatttccatcctggaattccaggcccgtctctgtatatagaggtggaggaatgccagaggcctctctctctgcaggacagctctgcttttccacctcaaggctctcttcataagctggagggtaaaagtctggcctaggggacaaaacagcataaacatgcgtgcgttatttaggcattaatgccaaagaggcagacggctgcctctctcagctcaaattgtgcgaagctaaactgttaagaaacatggatttttgaaacagatgtacttcttcctggcatcaccagttttttaaaaatgtgctgctcttccaaaagaacctttttatcagccacaggatgcctgcctctagtcacatttttttcccagtgggttatgccaagctattccttctctattgctcattcactcatgaaaacagggccattcagtgtgagatccttgtcaacattagaggaggtgggggctttggatagggaacttctctctaccgagtacttagtccatccacatccttgctccctttctcgcatggcatcatcccctcaattgcactcactttctctgatcatcacagccaacaaaataatgaatgaaaaccaactctgtgctgatccctgaactataccagatgccatgtctctatcctaacaccctttcgagactcagtagctagtttcaaagaaaatatacaaacatattcatttctcaaatgatatcaactgacaactttacacagatttcagttgtagccctttctatgccagtaggctaaagcagccattcattcgggggctgatgtactcattggtcatcttgcctggcatttctaattgctaaatcctcctggcttctccatcatgaatgaatttgggggaaggggagaggggaggaagagagaccggtgagcttggctgagttgtgtatttatagagtgatccttccagtgcctacagggagtgtttatggtgtgtaaccacaacagaacagggactgccatttgtagccacaactccattccaaatgttaccaggcccaaagccagtagctgaagaagctgtctactataaggcataaatctcagccttcgctcagaatagccaaggctgagtcacggggcacatgtgtaaaggcattttacacagaaaggtgagatgttccctggagtgatgtgaaaggttccaggatgactgctgcctgccccaaatcccagctacctctcccaaccccaccctccttcaactgccatccatattcccagtcccctgaattccatcatcggagacccatttgctttgatatctcaacctgggtatccattttgagtgcaaatgctttggagaaatgtgacttcccaggctgacttgccagccattctgcgtgggataagcatcttattacatgcagcgagaagaggcagtaaaatgggggtgttacgatgtccataatttactttcaaacatttcagtatactgtaatattatgcagtgttagtcaatttaagctatatcctaaaggcaatcagttacatttatcagaaattcacactctagaggtagtcctctaacatttatacaaaaagaaatcatcactctagaggcatcttctacaatcacttcatttctcttaatttttaatcaaacccagaaactctgctggttagtataacattggaaataagttttggttttcataattattatcttattaattagcataaaggatgccaaaagtggatgctcatgggtaagattacttatattcaagatacatggagtagctaaaatattttagatactttctactcttgcacgaagagggcaaaataattatagtcttgtagcctgtatcttgagaatgatgcctagggtgttatccctaaatggtcctgtggctagccaagaattaggaggtttcttgttgcctgatactgactataagattaactgaatcttttttttcttgtggtaaaatatatatgacataaaatttactgtttttaagtgtatagctcagtggcactaaatacactcatattgctctacaaccatcaccttaaaactctctactcattaaacaataggtccccagtctctccttccaccagcccctgggaccactgttctactttctgtgtctgtgaatttgactacgctaagtactcatgtaagtggaattatacaatatttgccctttgtaactgacttgtttcacttagcataatgttttcaacttcatccaagtggtggcatgtgccaggatttccttcctttttaaggctaatattccattgcatgtatataccacattttgtttatctactcacctgttgatggacatttgggctattatgaataaatgttgctacaagcattggtgtacaaacatccatttgaatccctgctttcagttcctttgtgtataaactcagaatgtagaattgccagatcaaacagtaattcaatatttaatgtatagaggagtctccacactgttttccacagtggttgcaccattttaacattcccaccagcaatgcacagcgttccaatttattgacatcctcaccaacactagctgtttggttttgttttttgatgataactatcctaatgtatgagatggcgagaaagaatgaatcttgcctctagaatattatcaccttcccctgaaggaatgttttatgcaaggtgagatcacaacacctaaaaggacagtaaactgggacttttctgagctcacagagattccaggactcattttatgcctgcttcttcatttgttgtgtggcagaatttggtctgggacttgctttccttagaacctcatagccaggttatgggaagtaactaaccatcacctgccactaattaatgacagctgccatgatataacaaaagagcctgggtttctaaattggcttaggtgggttttcactgggggtggtggtagggtttctctgagatgagttgcccctgcgtcatggttttccccaaagatggcgccactcttcctaataacaaccccagagtaattccctgacaataaagctttggttctagacagacagcccatgggacatgtaagtcgctccatagtaggatcagaaattactcagatcttacacaactcagcccatctcagcccttcttggtccctctgcctgtcagcacgtacctgtctactgtggccacgggcagggccccatgagcaaggtgttgtcggagcatgtgcctcaacactcctttgctttcagtcacctggcgatagttgctccagaaaattccactcagaaggatcacaaaccccagaggcagaagcaaataggccgcaatcaggctcccctgacagtcgaatatggagccccaggaaatgaagaaggcccccaggcagaccatcaggaaacccatcaggagggcaagagcacagagaatgaggccagttctgttctgcatccttgcaccttaggaacccagcaccctgaccctgctgctcctctgcttccctg

SEQ ID NO: 688 - DNA, 87257 bp, Homo sapiens
aaatgacgacaacggtgagggttctcgggcggggcctgggacaggcagctccggggtccgcggtttcacatcggaaacaaaacagcggctggtctggaaggaacctgagctacgagccgcggcggcagcggggcggcggggaagcgtatgtgcgtgatggggagtccgggcaagccaggaaggcaccgcggacatgggcggccgcgggcagggcccggccctttgtggccgcccgggccgcgaagccggtgtcctaaaagatgaggggcggggcgcggccggttggggctggggaaccccgtgtgggaaaccaggaggggcggcccgtttctcgggcttcgggcgcggccgggtggagagagattccggggagccttggtccggaaatgctgtttgctcgaagacgtctcagggcgcaggtgccttgggccgggattagtagccgtctgaactggagtggagtaggagaaagaggaagcgtcttgggctgggtctgcttgagcaactggtgaaactccgcgcctcacgccccgggtgtgtccttgtccaggggcgacgagcattctgggcgaagtccgcacgcctcttgttcgaggcggaagacggggtctgatgctttctccttggtcgggactgtctcgaggcatgcatgtccagtgactcttgtgtttgctgctgcttccctctcagattcttctcaccgttgtggtcagctctgctttaggcatattaatccatagtggaggctgggatgggtgagagaattgaggtgacttttccataattcaggtgagatgtgattagagttcgatctgcggtggtggcagaggcttacaagaaacactaacgggacatgggaaccaattgaggatcagggaataaagtgtgaagttgactaggaggttttcagtttagaacatggcagagacattctcagaaataaggaagttaggaagaaagacctggtttagagaggagggcgaggaagtggtttggaagtgtcactttggaagtgccagcaggtgaaaatgccctgtgaacaggactggagctgaaaacaggaatcaattccatagatttccagttgatgttggagcagtggagaagtctaagctaaggaaggggaagaggaggccaaggcaaacacttaggaacacttgcaacgagggggtggaagaagagcaaggagccagctgaggagaatgagtgtggttggagaaccaccacagcgcagggtcgccagagctgaggaaggggagggaagcttcaggaaggaaaaggttggcagggattttgagtgttaggcctggtgtagcagaaggaacagaagatttagagcagcgctagccaatagaaataaaatgtgaggcccggggcggtggctcacgcctgtaatcccagcactttgggaggccgcggggcggatccttgagctgaggagttcgagaccagacaacacggcgaaaccccggctctacaaaaaattagctgggcgtgggggcgcgcgcctgtagtcccagctgctcccaagcgaggctgaggcaggagaatcacttgaacccgggagaaggaggttgcagtaagccaagattatgccactgcactgcagcctgggcaaaagagtgagactgtctcaaaaaaaaaaaaaacctgttttgtttttcttttggagaaaaggcatacaaatttattagcatgcagactgggagaaccacaaggtgattatccctattttaaattttctaataaacatactattatttatttatttatttatttatttatttatttatttattttttgagacggagtctggctctgtcgcccaggctggagtgcagtggcgcgatctcagctcactgcaagctccgcctcccgggttcacgccattctcctgcctcatcctccccagcagctgggactacaggcgtccgccaccacgcccggctaatttttttgtatttttagtagacacggggtttcaccgtgttagccagtatggtctcgatctcctgacctcgtgatccgcccgcctcggcctcccagagtgctgcgattacaggcgtgagccaccctgcccggccggctatttatttttttagagatgggagcctcactatgttgcccaggctggtcttgaactcctggagtcaagtgatcctcccgccttggcctcccagagtggtgggatacaggcacaagccactgtgcctagccataaacacatttttaaaggtaaaaaaaggccgagcgcggtggctcacccctgtaatcccagcactttgggaggccgtggcgggcggatcatgaggtcaggagatcgagacatcctggctaacacggtgaaaccccatctctactaaaaaatacaaaaaaaaaaaaattagccgggcgtgatggcgggcgcctgtagtcccagctactcgggaggctgaggcaggagaatggcgtgaacccgggaggcggagcttgcagtgagcggagatcgcgccactgcactccagcctgggcgacagagccagactctgtcaagaaaaaaagaaaaaaaatgtaaaaagaggctgggtggccgggcgcagcggctcacgcctgtaaacccagcactttgggaggccgaggcgggtggataaccagatcaggagatggagaccatcctggctcacgcggtgaaaccccgtctctactaaaagtacaaaaaattagccagacatggtgccaggcacttgtagtcccagctactcgggaggctgaggcaggacaatggcgtgaacccaggaggcggagcttgcagtgagccgagatcgcgccactgcactccagcctgggcaacagagtgagacttcgttttttttttaaaaaaaggctgggcacagtggctcacacctgtaatctgccagcactttgggaggccgaggcaggtagatcacctgaggtcaggagttcgagaccagcctcgccaaaatggtgagaccctgtgtctactaaaaatacaaaaaattagccgggtgtgttggcgtgtacctgttatcccagctactcgggaggtgaggcaggagaatcgcttgaacccagaaggtggaggttgcagtgagccgagatcatgccactgcactccagactgggctacagagcgagactccataagaaaaaaagaaaaaaaaggggggcaaaaagaaacagatgaaaccaatgtgaataatttattttaacacaatatacctaacatatttttatttcaatatctaaccagtataaaaatttacttgttttgccctctagagatagtaagctccttaagtaaacagaagtaatacctgattaattagaattcccaaccctcatcaagtgtgtgcttatatagaagaaacccagtaaatgtttgttgattgaaagatattaatactcttgcttggatgagagtgaggaaaaaggtattagtattggcttttcacaacgccttgtacggtttcttgtttaagttgatcaaagcaaaagaaagactgcaggcaatgctaaatataacaagtgatttacaaattaattagacgtaaataatcatttttcattaaaaattagttgtattctgtccatttcctcagaattttagacaatgattttgaataatcatatctcccttatagagttattgaaattaaataacttattgggaaagattctttataattatacaaaggtatataggaccatagtctcatatccagagttctgaaatccgaaaactaaaaggtttttctttttttgctattcttttttttttttttttttttttttttgagacagagtctccctctgtcgcccaggctggagtgcagtggcacaatctcagctcactgcaacgtccgcctcccaggttcaagtgattcttctgcctcagcctcccgagtagctgggactacaggcgtgtgccaccacactgggctaatttttgtatttttagtagaggtggggtgtcaccatattggccaggctggtctcgaactcctgacctcgtgatccacccgcctcagcctcccaaagtgctgggattacaggtgcgagccactgcacctggccaaggttttttataactaatttaacagcaaaatctggcctagttatcgtctttattttctttttttaatgtgatttaaaactattcatttgtttcactatagcttaataatttgtttgcttttctgcttctaagaccctgtaggggcattatataacttctggcatttgcatagtacctttacaaaatccaaaaaaatctgaattctaaacacatttagtcctaaaagttacagataagggattctggacttgcgattctaagtctttgttcgtttttattgcattttctgagccaacataaccattatttaaaaacaagttgctatagtaactctacattacagacctcccccaaactcagcagttcagagcatgtattctcactcagggctctgcttccttgtaggtagatgtgtggatcggtgagggcagttcttatttgtatgccttattctggggcccaggctgaaggggcagtggctatccatgataagcttttctcaaggcaccagcagaagtacaagaagtcaaggccaactgcataagcatagttcaaatgtctggttatgccacatctgctaagattgcattgaccaaagcaagtcacatgatcatgcccaaagacttaggagtgggtagtagactgcaaccaccatgcagccaagcaaactacagagccaagcctataacatcactggagagaggtgtattcctcccttggccaggctgggggagggagtgaatattggctgaataataatctaatctaccacagatggttaacagaggtggagtgggatggaaggagaaaaaaaaaaaatcaccaaatgggatgtatcactacccttgctctttttagcgtctgctgctttcacaaagccttttatagggctggagaaatgatttgctcctagtctcttaaaaaccagaggagtcttttgaggatgtattcctaaagtttttaaattagtttaaaaattttttttattaatttcaattataggctgagcacagtggctcacgcctgtaatcccagctaaggtggtggatcacctgaggtcaggagttcgagaccagcctggccaacatgctaaatgaaacccccatctctactaaaaatacaaaaattagctgggcatggtggtgggcgtctgtaatcctagctactcaggaggctgaggcaggagaattgcttgaacccaggaggtggaagttgcagtgagccatgatcgtggcattgcattccagcctgggcgacaagagtgaaactacatcttggccgggtgccgtggctcacgcctgtaatcccagcactttgggaggcagaggctggcagatcacgaggtcaggagatcgagaccatcctggctaacacagtgaaaccccgtctctactaaaaatacaaaaaattagccaggcgtggtggcgggcacctgtagtcccagctacttgggaggctgaggcaggagaatggcctgaacctgggaggcggagcttgcagtgagctgagattgtgccactgcactccagcctgggcgacagagggagactccgtctcaaaaaaaaaaaaaagaaaagaaactacatctcaataataataataatttcaattataggttggaatttagagttcggttacatttactattggatgtgatcctttaaaaactcaagtagaggcttttccagcccattcataacattagaagttgggccgcctgtccagggagaagctttcaaagtaacactgaggctgattaaatacttttgtaaaataaagaataaatcacaagctcattggcacttgaaacttagcattgcagtgcagatgcagcagaaaatacttgtagcagttttctcagtgaaagagaaactagtcaagtagcttagagacattaaaacaagccacaagccctttgtgctagagatcatggttaaaagtcccctgaagatgtttttccacagtagaaattttgtttatatttatgtctgagagtgaaaaaagaaaatggaatcaataagtaaccatgttctgcaggagtttgaggttttgttgttacattgggatgtagtgagagaagaaaacgtattaattcttttctgttggtactttcttgaattacatttttaataaacttattgtgagattctgaacattgctcctgtgataatttctgaagtgctgatgagtagaaggttttctggttagacttctgttcagcacatctgagcttcgagattatttgtagttctcctggggcttttaaaatctctttgtatataatagataaatgctagtttcccatcagagaaggatttctttttccttttgtctgattgagcaagtgtcttgagattaagaaaatggatgtcagtgaattcaagtgttgtgctctgtcagtttgcagcaggtgaccagagagcaaaaacaccagagtagattctgtccctactcccacctactcctcaattcgggtcccatgaaagatcctcagatctgggtaactgttgttgtttttgttgttcacagggctaagaatgttcatggctaagaatgttaaaaagtctcctagtgtcttttgccacgctgcctgaacagtggggtcattgaccgccatgcaatcctcaattgttttcagctgatactggaccgaaatcaaatctagctttgcctgcccctttctttgtaccagtagcgcttgtttgttcaccaggcctgactgaagacctagccctgttgcctgcctctgcttcctaccgagccccctgtaaagagcagctctcccagggaggctcaccttgtagcattgtgatctttggaagcatcaagggaggcacaagatttctctgggtgaactggaaaagacttgggctgggcatcagaagacttgggttctgcaactggcattgtttacactctctctgtaactctgtgcaggcaaaatctttcaccttttctgagtttttttttacatgtcagtacagattcctttcctcatgaggtttctttaagactcaaatggaagaatagatgtgaaaagaactttgaagatagtattggaaaatgctaaagtgactgctgtgttattgatgatttttatgggatttgtctgagaaagctccagtgtgaccagtttgtaccagcttgtatggtttcttgtaataaccgaacagatcctgttagcatagggtaaaaatggaaactacttcttttaaaatgaccagtggctgcagtggctcaggcctgtaatcctggctagttgggagactgaagtggtagggttgcttgaggccaggcaagaccagcctgggcgatacagcaagaccctttctctaaataaaaaactagccacccatgtagtcccacctgcttgggaggctgaggtgggaggatcgactgaggccaggagttcaaggctgcagtgagctatgattgccactgtactccagcctgggtgacagagtgagaccttgtctcttaaaaaaaaaaaaaaaaaaaaaaaaaaagatttgcattatagcttatctttttttttttttttttttttttgagatggagtctcactctgtcacccaggcaggaatgcagtggcgtaatctcagctgactgcaacctctgcctcctgggttcaagcaattgtcctgcctcagcctcccgagtagctgggactacaggtgcacgtcaccatgcctggctaatttttgtattttttggtagagatcgggtttcaccatgttggccaggctggtctggaactcctgaccttgtgatctgcccaccttggcctcccaaagtgctgggattacaggcgtgagccactgcgcccagccagcttatccttttttaaaaaaacataaatactaggatattgagattattgaaaatgcttttggtgcttcagttttgaatttatacttagagcagtttttgaagtttaagatctcatttacttctaagtaatagatttactagtaatcaaaatcgcttcaaaataccgtaatcctcattgctgtaaactcctacggggcaggtttggagttttataaagaggcaatatagtgtactctgtgaattccaactcctcacttgccagatgtgaccttaagcaagtgaacttctgtgtgccacactgttttcatctgtaaaaggataaagggaatatcataaattagtttgttaagccttagtttaataatgtctctaagttttacatataagtagacagtgtctttcttgtttagtgaataatcattcttattatttaatagtatctctactaaatttattgtgtaagattatactaatcttgtttagtgcgtggtaatcacttctgctcatatttaacctataagcataatatagtttatttatataccatttatttattttattttattttttgagatgcagtcttgctctgtcacccaggctgcggtgcagtggcgcaatcttgcttcactgcaacctccacctcccaggttcaagcgattctcctgcctcagcctccttagtagctgggattacaggcacgagctaccatgcccagctaatttttgtatatttagtatggacagggcttcaccatgttggccaggctggtctcgaactcctggcctcaaatgatctgtgtgcctcagcctcccatagtgctgggattacaggcatgagccactgcgtccggcctacttaccttttatttttgcttgcattaccctttctttgccttgtttcatttggctaagactgtcttgtttacttgctttgcttctgagggattatatgagagttctatgggtttttccataatggagtgtacttttattattttattatttgtttttttgagacagggtctcactctgtcactcaggctggagtgtagtgatgcagtcactgctcactgcagctttgactttcttggctccagtgatccttccacctcagcctcctgagtagctggaaccacaggcacccaccacccacacccagccaattttttttgtatttttagtagaaacagggtttcaccatgttggccaggctagtcacgaactcctggcctcaagtagtaacacccatctcagcctcccacagtgctgggattacaggcatgagccaccgagcccggcctcatgcaatttattgactacttcactgaaagtgaacttgtatggatactcaaaaagtacagtttgtattgaatacatattgtttttgcatcatactaaagctgaacagttctaaactgaactgtcatcagggaccgtctgtattgtgaaatcttaattttgtccatattaaaagacaggaacagggctggttcgtggtggctcacacctgtaatcctagcactttgggaggctgaggtgggtggatcacttgtggtcaggagtttgagaccagcctggccaacatggtgaaacccagtctctactaaaaatacaaaaattagctggacatggtggtgcacacctgtaatcccagttattcggggggctgagacacgaaaattacttaaacccaggagttagaggttccagtgagcgagatcgtgccactacattgcagcctgggtgacagagcaagactgtgtctcaaaataaagacaggaacaaaggtatcgataactcttaagtataggttaaattcccacaaaaatctagttttaaaaaatctttttttttttttttttttttaaaaacagagtctcactctgttgcccaggctgagtacagtgacgagatcttggctcactgcagcctctaattcctggactcaagccatccccccacctcagcctcctgagcatttgggactacagatgcatcccacctgcacccagctaattatttttttgtagagatagtgttttcctatgttgcccaggctggagactgatctgcaactcctggccttaagctctttattttttaagcaaatttgcactgttttcaattaatatgaatttgcatttcgctgatctcatgctagctgacaatgggctgaaggtgaggggaggagaaagatggacatggtacataaaagcatgtatgataaagtggaatgtcaccttggttaaaaatgtgtaatgatttgaatgatacaaatataagtagttaagggttattttgaacttgatacctttgctggaggaaaaattactttatgcatttttgatgaaaaatcattagaagaaaaaaaatggaatatttagaggaaagagtatcctgatgttaaaagtgaaaatgaaataggacattgagaaaatttttttatgtaaatgtgtatatggtaatgtattaattagcgttaggtatgtacacggatttttgccttctatatttctgaaaaccttctgtgaaaaggaagagttgaaatcataaagaattggctgatggaaattaaggtagacaggcaaatgggaatgtggcccccctaggagggtgaactctgagagacacagtcatccctgtaaataaggctgcgccaagatcaaaggagaggtctgaggctgggagtcaggagtcagccattcttttttttttttttttctgcaacctccacctcctgggttcaagcttttctcctgcctcagcctcctgagtagctgggattacagatgcgcgccaccacacccggctaatttttgtatttttagtagagatggggtttcgccatgttggtcaggctggtttcgaactcctgacctcgtgatccgcccgccttggcctcccaaagtgctgggattacaggcatgagccaccgctcctggctgagtctgcgatttcttgccagctctacccagttgtgtcatcttaagcaagtcactgaacttctctggattcccttctccttttgtaaaataagcatgttatctgtccgtcctgccttgggcattgtgataaggataagatgacattatagaattttgcaaaattaaaagcgctagacaaatgattttatgaaaatataaagattaggttgaatttggtcagcatagaaaaaggaatgttgagaacattccttaagattactcagctccctttgctggaaatcagaagtcattaagtatctttgtggttgaaaatgtttggtgtctcaggcggttctacttattgctaaagaggtctaccttgagcttatagtaaatttgtcagttagttgaaagtcgtgacaaattaatacattcctggtttacaaattggtcttataagtatttgattggtttaaatgaatttactaggatttaactaacaatggatgacctggtgaaatcctatttcagacctaatctgggagcctgcaagtgacaacagcctttgcggtccttagacagcttggcctggaggagaacacatgaaagaaaggtttgtttctgcttaatgtaatctatgaaagtgttttttataacagtataattgtagtgcacaaagttctgtttttctttcccttttcagaacctcaagaggctttgttttctgtgaaacagtatttctatacagttgctccaatgacagagttacctgcaccgttgtcctacttccagaatgcacagatgtctgaggacaaccacctgagcaatactgtacgtagccaggtacagtgtcagtctctgaaactgcctttgccagactggattcacttatcatctcccctcacctctgagaaatgctgagggggctaggcaggctttctctactttaccacatttataatatatttggtgaacttcagctgattgctggaggacacagggctgtttaacacataggtgttgatacagttcctacctaattcacatatcaccacctcagttgaagccttctccagcttcccaaggtgtgcagcgcctcatagttcatgttgtttattattttacctatcttgctcttattcttctacggctgagtccattttatttactgtattcattacctaacagttccttttagtgctcagtaaatattcattatgattgtacaatgcaaggataagtgtagaagttctaagggttcaaaggagggattcaggaaaagaacgtaatctgtgctgtcggacaaagagattcctcaccagctacatacacagacatgaaatttgactgcaactctactagctaatcatcataaagtgagagcagaggccaggcacggtggctcatgcctgtaatcccagcactttgggaggctgaggcgggcagatcacctgaggttaggagttcaataccagcttggccaacatggagaaaccccatctctactaacaatacaaaaattagccgggcttggtggcaggtgcctgtaatcccagctactcaggaggctgagccaggagaatcgctggaacccaggaggtggaggttacagtgagctgacgtcgcgccattgcactccagcctgggcgacgagcgaaactccatctcaaaaataaataaataaacaataaataaatagagaaaaagaaagaaaagaaaagagagagagcatggatgtcctgtgagacagttggagtatctataggatttttagaggtggacccagaatagaggaaaacacaaggccaactataagctatccagttgcactaggtgtggggtcagattttcctctgttaggaccagagagcagagctaggaacagtggtggaagttaccaggcaataaggtctggatcaataaaaagaactttctcatagcctggcatggtggtgcatgcttgtagtcccagctactcaggaactcaggaggctgaggtacgaggattgcttgtctaagagtttgagtccagcatgggcaacatagagaggttctgtgtttttttttttttaattttcccacagttatggtacatctgggctgccttgtaggcttgtgtgtacatttcactacaaacagtcacaaaaggctgaaaggccactccagcaagatctgtagaggattagtccgtgaattccgcagttgaactagagcactgaatggcgtggaacttccttttacactctgaagatttaggattcttcacttttcccatcagtaaaattaggtaatttactagataatttgaaaattctttcccagctgggaagttttgatgtgcccagaagctaggatgggcagttgtccaggtttgtttaaaactagaggttctagaacacaggactttcagttttaaaattgggacagtcctgagcagtaggatcaagtcagttgtctaccagagtataatcaaattgaaataattttggatctgactaaccaagtcttattcaattagttgacattgttgtttaacttcgagtactattacagttctatattgttatagttcaaatagaagataacatctaaagcatttctcattccaaaggttaaatcttgcctttagcttcatttcttcaactctaagcaaatactgtgacgagctgctatagcctggaaaatagttttccttttgtgggctgctgtgcataatctcattcatagtaaagggatttgaagtttgatgacagaatagtcagagagctgaagttgtgtttgtttttttagcccaaatatttatttctcaagtttttgttgtgaaatgtttctagcacatacagaaagtatggcacataatgtaataggcacccatgtacctatcacccagctttattaaaccttaacatcttatttgctgtttttttgataagctttttttgcttctattgcttattgatcctacactaaatgaaatcctaactaaacaaaacaagattttgcatttaatttgaaaagagactagttatatgacaaaaaattgcagataaaattgaagtgctcctcccccattctttttcctcttttctcaggatagttactgtcctgaattgggtatttaccatgtttaataaaattgagtattaggcttactataatatttatgtacataaatcgtatcgcattatgtaatacacttggcatgttttaaaactttaggctgggtgtggtggctcacgcctgtaatcccagcaatttgggaggccgaggctggtggatcacaaggtcaggagttcaagaccagcctggccaacatggtgaaaccctgtctctactaaaaaaaaatgcaaaatttagccaggcgtgatggcaggcacctgtaatcccagctactccagaaactgaggcagagaattgcttgaactctggaggtggaggttgcagtgagccaagattgcaccactgcactccagcttgggcaacagagtaagactctgtctcaaaaaaaaaaaaaaaaaaaaaaaagccaggtgcggtggctcacgcctgtaatcccaacactttgggaggccgaggagggcggatcacgaggtcaagagacagaccatcctggtcaacatggtgaaaccccgtctctactaaaaaaatacaaaaattagctgggcgtggtgacacgcgcctgtagtcccagctacttgggaggctgaggcaggagaatggcatgaacctgggaggcggagcttgcagtgagccgagattgcaccactgcactccagcctgggcgacagagtgagactccatctaaaaaaaaaaacaaaaaaaaactttatgtggtttatgtctgaaagttgaagagaatttccacatatatgttagtatatgttgcaaaagagacattcctatgtagaattttgggcattcatgtatatgtagatgcatgtagctctagcatttgttttctcttgtgaatatataaaaataattctgtttacaaacatttggtaggttccagtttttcacaataactgacagtgctgcagtgacatactaattcattagtctgtgtgcacttgtgtgagtttctcaaagatagttgctgtgattggatatatggatcttagaactattttagagattgctaggattcttccaaagtgtatattgcaggccaggcatggtggttcacggctgtattacatctatctcagaaaaataagagaagaaaagcatgggtgatcttggtgatttccccctttcattttctaaatgttctataatacagttatttaataatttaaaaagctattttgaaaaagtaatctcacgctgtcaccaaagctggagtgcagtggtgcaatctaaactcactgcaacctcgacctccttgagaccagggtggtctcaagtgatcctgccacctcagcctcccaagtagctgggaccacaggctcatgccaccacacctggctaatttcttgtatttttggcagaaatgaggtttcaccgtgttgcacagtctggtcctgaactcctgagctcaagtgatccacatgtcttggcctcccaaagtgctgggattacaggtgtgagctactgcgcccaacctaaaatattttatatatatatatatatttttttttttttttttttttttttttttttttttgagacggagtctcgctctgttgcccaggctggagtgcagtggcacgatctcggctcactgcaagttctgcatcccgggttcacgccattctcctgcctcagcctcccaagtagctgggactacaggcgcccgccaccatgcctggctaattttttgtatttttcatagaggcggggtttcaccgtgttagccaggatggtctcggatctcctgacctcgtgattcgcccgtctcggcctcccaaagtttttttatattttttaatgtgaggaaaggtcacaaaagaatagtatgctacctgaggaatatctctggaaagggatcaagcattcgaggttttctgtgatgactgactaaagtcatggagttagaacagctgatacaaaagaaaccaaaaaaggccaggcatggtggctcacacatgtaatcccagcactttgggaggccgaggcaggtggtcaggagtttgagaccagcctggccaacatggtgaaaccccatttctactaagaaaaaaaaaaaaaaaaagtcaatgggtgtggtggcatgtacctgtagtcccagctactcaggagactgaagcacgagaattgcttgaacccaggactcagaggttgcagtgagctgagattgtgccactgcaccccagtgcagtgtgacagagtgaggctgtctcaaaaaaagaaaaaaaaaacccacaaaagctcggtagcatgagatctttgagagcattcttatgttcttattggtaattggagtttatattatgcccttgtcatcaataatagcttcagttatgtttcttagtctccatttgaaaaaagaaatattcgctgggcatggtggctcacgcctgtaatcccagcactttgggaggccaaggtgggtggattacttgaggccaggagttccagaccagcctggccatcacggtgaaaccctgtctctattaaaaatacaaaaattagccaggtgtggtggtgcgcccttgtaatcccagctacctgggaggctgaagcaagaggattggtttcaaggttcacctgggaggtcaaagctgcattcagccaagatcacaccattgtactccagcctaggtgacaaagtgataccctgtctcaaataaatacatagacaaaaagcaaacctatgagctatttaaaggaccttgaggagaaaaaaaataaatgaaatgggtgatctaaatttaaatagaatctgcagctctggttagcctttgacagtgttgttgtatcattatagttatgaatttgttttctcagttgtgttaaagtggagtaaggcaaaaaagaacttgaaatctcaacgacctccagagaaacatgctagcttttgcatgagtaaaatctcttaggcacaaatattaataatatgttaagaaactttaggcttaagcctaacataacagccccataagtgttcagtattatctctaaccagttatgtcaactgtttgtggaaatgacagcctttcttggcattagaggaatggttaaacctctgactccagggaatcacaaagcttggtcagatgctgaatggaattatgtgtgttgttggaagcatgttccctatgattaataaatgttttcaagttttccacttaacttgccagttctttggttaagccactcttctagtcctgtcctacagagcaggcttagagccccacatttgtcattgtagaaattcaaacaatatccattaagtcattttttttttttttgcccattaagtcttaaaggattaatacattttctttccttttttttttttttttgaaacggagcctccctctgtcgcccaggctggagttcagttgtgcgatctcggctcactgcagcctctgcctcccaggttcaagcgattctcctgccttagtctcccgagtagttgggattaacagggttgtgccaccacacctggctaattttagtattttagatagagatggggtttcaccatgttggtcaggctggtctcgaactcctgacctcaagtgatctgaccacctaggcctctcaaagtgttgggattacaggcatgaaccaccgtgcctgccaatacattttcttacaaatattaattattgaaaaaatgtattttaagtaaatattcagactataaatatatcagcataattgaatacattataaccacgtaggcatgttaactgcttacatgcgtgcatgaaatattaagggaaaagggcagaatataatatttgtaaacacaactatgtatacctgtgtgtatatattgaaaaacgttagcatttggggtgtcgtaaaaataagtttctgttttctttataaaattacctaaattcatattcaactacacacaattataaacttaattgcagagctaggtgtggtggctcatgtctgtattcctagtactttgggaggctgaggcaggaggatcccttgaggccaggagtttgagactagcttgggtaacatagcacgatcttgtctctacaaaaaaaaaagtgaaaattagtggggtgtggtagtgtgcttctatggtcccagctacttgggaagctgaggcaggaggattgcttgagactaggaggtcgaggctgcagtgagctgtaatcatgccactgcacttcaacctgggcagcaaagtgagaccctgcctcaaaaaaagaaaaaaatgtgtggcaaaaactgccatgaacaaagtccaaaacaaactaggacaaaggcttgaaatatatgacagatatatcccaatatacatagaattcttatgaaattaaaaggaacatgaacaacttaactcagtagcaaaggttacaagcaatatttatggagtaagaaatagaaatggcaataaatatatgaaaagcctagttgatcagccttactaatagggataaaaattaaaacttcacttcttacctatcagtgagttaaaattgatacactgctgctgaggttgtagggaaataggctttcttgtatgctgtgttctttggagttaagttagtatttatttggaggcaagctcttaattgaatctacagatacacatgccttttggaaataatttagcaattaaatctaacctaatctgatctcacctagcatttcacttctgaaagtttatcctataaaaatattaccatagaagtgccaagaatttttattgaagttttatttataacagtgagaatgtggcagtaatctcaatctttatcattaattgcttatggtttacccagttagtagtgtaaaggtactagttaacagtagggtctcttgactaaacagttggactttgaatctccattctagaacttcttagcattatgatctttggcaaattaactggcctcgctaaacttcagtttctttatctgttaaatgaagtttatagcaattaacttagagttttatttaaattaaatgagataaactgaatgattagtacactacctagcacatacttgttcaataaatattaacatttcttatcaaaattgccatatttaagaatgaggtatatttatatgtctagcatagaatcaaatatatattatcattattattttttttttgagacagggtctccttctatcacccaggctggagtatagtggtgtgatcatagctcagtgcagcctgtaagtcctgggctcaagtgattctcccatctcagccttgtgaatagctgggagtacaggtgtgtgccaccatgcctggctaattttttttgctgttagtttcactttttttgtagagctggggtctcgttatgttgcccaggccggtcttgaactcctgggctcaagcgattctcccgtctcggcctcctgaagcatacagattttttagggcagtgaatctattctgtatgatactgtaatcatggaaacctgtcattatctgtttatacaaacccatagactgtataacaccaaaaagtgaaccctaaggtaaactgtggactgtcaatgtaggttcatctgttgtaacggtttaccacagtggtgcaggatgttgatagaggctgttggaggggttatgtgggaactctgtgtactttctgctcagttttgctgtggatctaagtttgcatttaaaaatattttatggcttggtggctcatacttgtaatcctagcactttggaaggctgaggcgggtggatcacttgagttcaggagtttgagaccagcctgggcaacatggtgaaaccccatctctatgaaataaaaaaaaaagtaaataatactaatagtaattaactgggtgtggtggcatgtgcctatagtcccaggtacttgggaggctgaggtcggaggatgacttgagcctgtgaagtggaagttgcagtgagcagtgatcatgccactgcactccagcctgggcaacacagccagactcggtctcaaaaaataataataataaaataaataatataaataaaaataatattttgaaagaaaagagctatcaagccacaaatgcaaaaggcttcaagttcctatcttttagaaatacatactaaaatatttatgaaggaaatgatatatctaagatttgcctcaaaataatactggagtggcaaagtgagcgggggagtagatgaaacaagattagcatgagttcataattattgaagttgaataaattgcacatgggcttcattgtacatttctgacagtatttgtttgaactttttccataataaaaagttttgtttgtttttttttttgagatggagtcttgctctgtcacccaggctggagtgcagtggcatgatctcggctcactgcaagctccgcctcccaggttcacgccattctcctgcctcagcctccagagtagctgcgactacaggcgtccgccaccatgcccagctaattttttgtaattttagtagagatggggtttcactgtgttagccaggatgatctcgatctcctgaccttgtgatccgcccgcctgggactcccaaagtgctgggattacaggcatgagccaccacgcctggccttttttttaaaatggtcttacaggtaataccatgcatgcttaagtcatcattctcatatttagctaccaagatttttcctttcggaaatccctcagtattctagtaccactttcctctcatttgacacttttcaaagcacctacacactcccttgagaaagatacctttttttttttttgcgagggagtttcactcttttgttgcccaggctggagtgcagtggcatgatcttggctcactgcaacgtctgcctcctgggttcaagcgattctcctgcctcagcctcctgagtagctgggattacaggcacgcaccaccacacccagctaatttttttgtatacttttttttttttaagtacagatggggtttcaccgtgttggccaggctgggctcaaacttctgacttcagatgatccgcctgcctcgatctcccaaagtgctgggattacaggcgtgagtcaccacgcccagcccaagaaagatacatttttaaaaacagctttattgtggtataattgacgtaaaatgtacatacttaaagtatacagtgtgatgttttgatatatatgtatactcttgaaaccaccaccacagttaaaataatgaaaatgtccattacctccagaagtttcttcatgttttgttgtaatctctccttctcctccctgattcctccccatccccaggcaaccatgttttgtcaccgcgcgcagccatttactattatgatactattttatataaatagtatcatacaggccgggcacggtggctcatgcctgtaatcccagcactttgggaggtcgaggtgggcgatgacttgaggccacctggccaacatgaaaccccttctctattaaaaatgcaaaaattagccaggggtggtggcgtgcacctgtaatctcagctcctcaggaggctgagacatgaggattgcttgaacccaggaggcagaggttgcagtgagctgagattgtgccactgcactccagcctgggcaacagagtgagtctctgtctaaaaaaaaaacaaaacatacagactcttgtctggcttctttctttcagcataattattttgaaattcgtccatgttatgtggttcctttttattgctgagttgtataccacagtttttgatctatttacttgttggtagatatttggattttcagttctgaagcattacagatagtggctgttacggatattcatgtacagatctttctttgtatgggcatatgctttaatttatcttgggcaaatacctaggagtagaatatgatccaatatggtaggtgtatatttaacttttttttctatctatctatctatctatctatctatctatctatctatctatctatctatttttaagacggagttttgctccatctggagcaaaggctggagtgcagtggcatgatcttggctcactgcaacctctgcctcctgggttcaagtgattctcctgtcccagcctccccagtagctgggattacaggcgcctgccaccacacccagctaatttttgtatttgtagtagaggctaggtttcttcatgttggccaggctggtcttgaactactgatctcaagtgatctgcctcggccccccaaagtgttgggattacaggcgtgagccatcacacctggccagtttttatttatattttttatagaagatggagtcttcctatgtttcacaggctgatcttgaactccaggcctcaagtgatcctcccgccttggcttcccaaagtgctgggattataggcatgagcctctatgcccagccttatatttaactttttaaggtactaccaaagaactttccaaactggttgtataattttacatttctaccagcagtatgagttccagttcctccacatcctgtcagtacttgatactgtcagtcttttaaattttttagctcttataaaaaggtatatagttacatctcattttggttttaatttacatttctctattgagtaatgatgttgagtttcttttcatgtgcttgtcatcctgatatctttggtgacttgtctgttcaaatctcttgcccatttaaaaattgctttcttaatggattttaagaattatttacatagtctggatacaagtcctctgtaatatatataatttgcaagtgttttctcccagactgtggcttttctttttattaacagtgctttttgaagggcagatttttttttttttttttaaagagacagagtcttgccctgtcacccaggctggagtatagtggtgtgattatagctcactgcagcctcaaactcctgagctcaaagaattcttctgcctcattcttccaaacagctaggactacagatgtgtgccactgcacccagctaattccgtttgtatttcattgattgtgtttttggtgtcacatcttaagaaactttggcctacttcaagttctcaggagttttttcctgcattttcttctggaagctttatagtttcatgttttacattaggtctgtgatccttttgaagttgattgttatacgtggtccaaggtatggatcaaagttcatttttctgcatatggatattcaattgtttcagcactgttttttaaaaaagactattttctccactgaagtgcctttgtacctttgcaaaaatcagttgtccatatatgtgtcaatctgttccatcagtcatgggtcaaaggctgttctcatggggaggcttttgaatttgaaaaactgaaactctatactcattggacaactttatacccattgaacaactccccattttccatttctctcagcccgtggcaatatgctttctgtttctataacatggactacttgagtttttttcttttttttgatgacaagatctcactccgttgcccaggctagagtgcagtggcatgatcttggctcatggcagccttcacctcctgggctcaagctgtcttcccacctcagcctcctgagtaactggaactacaggtgcactctatcatgcctcgctaattttttaatttttttgtagagacgagttctcgccatattggccaggctgatctcaaactcctgggctcaagtaatcctcccactttggcctcccaaaatacagagattatgggtgtgagccatcatgcccagctggctagatatttcatgtaagtggaatcatacattatttctcttttagtgacttgcttattttgcttagcataatgtcctcaaggttcatctatattgtagcatgtgacaagatttcctttttaagggctgaataatattctgtgttatgtatataccacatatctgtgagtagacatttgggttacttccacttcgtggctatactgaataatgctatggtgaaagtggctatgcacatatctgtttgaggtcttgtttgtaattcagttcgtttttatatatactcattggtatttatataaatgggattgctgggtcatatggtagtttaattttttgaggaacctccatattgttttccatggtggctgcaccattttacattcccaccaacaatgcatagtggttccaatttcttcacaactttaccaccgcttgttactttctgttttttggtagtggccatcctaacgggtgtagtttttttttgcatttttctaatgattagtgatgttgagcatcttttcttttttccccccatattacacagatgtagagcatcttttcatgtgcttgttggctatttgtatatcttctttgaagaaatatctgttcaagtcctttgcccatctaaaaaaatctgatgatttgtttttttccaattgtttaattgtaggacttttttttttttttttttttttgagatggagtctcgctctgtcgcccatcctggaatgcagtggcgcgatcttggctcactgcaagctccacctgccgggttcatgctattgtaggactttttaatgtattctggatattaatctcttaccagatatatgatttgctttttttttttttttttttcgatacaaggttttactgtgtcacccaggctggagtaaagtagtgatgtaatctgggctcactgcaacttccgcctcccaggctcaagcagtccttccacctcagcctcctgagtagctggaactataggcactcgccaccatacccacctaatttttgtattttttgtagagacggagtttcaccatgttgcccaggctggccttgaactcccaggctcaagcaatccacctgccttagcctcccaaactgctggggttgtagatgtgagctaccacacccagcctgatttgcagatattttctccagttctgtaggttgccttttcactctgatgactgcttcctgtggtgtgtagaaatttggtgtaggcccatttgtctatttttgtttttgttctttaatttctcttagcaatattttgtaagtttcattgtacaggatatttggggatctgtaagacaaccctcaggttcagtaatttgctagaaagactcaactcagagaatgttttatactcaaattatagtttagtacattgaaatgatatggattaaatttagcaacagaaaaagacacatagggcagggtccaggagacaccccaggctcaagctgtcaatagtcctctcccagtggagttgtgcacacagtgcttaatttttccagcaacagtgtatgacaacacacgtggaatattggcaaccagggaagctggctgagccttggtgtccgggtcacacatggctgacctcagttctctggccccttcagaggccaagctgatactgtgtgacacaaggccctcaccgtagatcacattattagcggaaacttgttggcatgacccaatgcctcatgtaaacagcgcagtggctgtttataggccgggcgcagtggctcacgcctgtaatcccagcactttgggaggctgaggcgggcggatcacctgaggtcaggagtttgagaccagcctggctaacatggcgaaaccccgtttccactaaaaaaaaaaaaaaaaaaaaaaaatagaaaaagaaaccaaaccaggtgtggtgataagtgcctgtaatcccagctactcgggagactgaggcaggagaatcactctaacctgggaggccaaggttgcagtgagccaagattgcgccactgcactccagcctgggcaacaggagcaaaactccatctcaaaaaaaaaaaaaagttaaatagaaaaaggacataaatgaaaaagcactcaaccatcctgataataagagaaatagatattaaatttatgccaagattccatatttctcccatcagattggtaaaaatctaagcacttgctaacataaggtgttagcaacagtgtggtaaagtaggcaatctcttgcattgctgattctctaaattggtgcaatccacagggagggcaatttggcatgctctcgttctctctctcgctcgctcgcgcgctctctctctctctctccatgagaaggagagagagagagagagagagcacgcgaacaagcgattgagtgagagagagagcacgtatctgcagtctcagctgctcaggaggctgaggtgggaggattgcttgagcctaggaggtcaacgctgtggtaagctgttgactatgccactgcactgcagcctagtgacagagaatctgtctcaaagataagaagaatgaggatattctttatgtactgatgtgtagaaaaatctctaagatacatagttaagtggagaaaacaaaatgctgcatggtgcatttactgtactaccatttgtgtgaaaagggggagtaagagtatgtgtttgtatttgcttgcatatgtagaaagaaactttgaaaggattcaccaaataacagtagtaagcagggggattaggaaactaggtatatattaagagggagcttttgtactctataccttttaatactttctttgagaccatgtgaatgttttacctatgtatttatttatttttaatttttgctttgcctgcttttaaacaaataaattgtactttttttgaagagctctatttttatttcctttcgattatcatctgtagattcttatgtcacattttactttaacagcacatttagacagaatacagtctttaaatggaagccgacaattgatttccctggaaaatttttgaagtacaataacatttgattgattgaactttatttagtaagaattcttagcaaaattccctcccaggcacacctacatggtgcttcattttcagtgaactacaaatctctgaaacccaaaactgcaatctaaaagtacaagatggctggactcgatggctcatgcctgtaatcccagcacttcgggaggccaaggcaggaggattgcttgagcccagaagttcaagaccagcttgggcaacatggtgaaactttgtctctacaaaaaattagccgagcttcacaaacaatcttacaggagtcattcattaattaactcaacaaatatttatagagtacaggagacactagagatccagcaaaggtcaataacatgtgctgtcttagagaaaacttatattctaagaatagtcaagtgacaaacaggagctacatcaaataatcacaagtacacttcagagaattaaaaccagatcaacgtagagaaaggcttccttacattcgatagtcaggaaattctctctctaccaggagggaactgagtgacaaggaacagtcaggtgggagaagggcattccagatgaaccagccctgagcggggaactagaaggccagtttgagaaaaggaatggagagaggaggaacagtttgtggtcagagcaaggaccaaaccattttagacttcatgagcctaagaagttttgattttgttatgagcatgacaagaagccattgtaatcgagttttaaacaaaggaatgacatgatctcattttgtttaaaaaaaaaaaatcatcctggctgtagtgtggagaatggactaggggagcataaaagcagaaagaccaattggaagcctattaacagtaatccaaatgatagataatagtggtttgaaccacaaagattatggacatagaaagaagcagatagatccaggagatgttttggaggtattctggcagaatttgctggctgactagacagaggtactaaggaaaagaatcaagaataattcctagattcgggacttcctagaaactgggagaatggtgctgctgtttattgagataaatggagaagacagaggagaagcttagaatagagttctaggagaggtcagagatggagatcaacatttgggagacagaattttctaattccatagtgccgacgattttctattgatagactaaaaatgtctggaattttatatgcagtttcatctggacaataccctaagaggagatcagttataccttggcacctgctaatagccataggaatatgtatatgtagaataaatggtaaaactactgaatgcttaatatgtgccagacaccgtgagatacgtctttgaagtactatcccagtagaatttacaacaaccctatcaggagatactttttttatcaccattttacagatgaagacactgaagttcaaagaggttaaataactcgccccaaatcacactatatagaagagaaatctaaatcctggtagtctgaccccagaacttgggctaattaccactatataatacagtgtcactggggtaaacccaagatatgataacataagttagagacttttaaattccaaatttcacacactatgatttcacccataaaatgtagtgattcagccatagtcttctgattagttggagtaccctatgcaatactttaggaacttgcttcttttattttcatatatatatatgttcattcataaattaaatctggacagccagtgaatctgccatttttgtctctaaccaacacttctgtcacaaaattgtacttttttttgtttttttttgagacggagtctcattctgtcacccaggttggagtacagtggcacgatcttggctcactgcaacctctgcttcccgggttcaaacgattcgcctgcctcagcctcccaagtagctgagattacaggtgcccgccaccacactggctaatttttgtatttttaatagagacagggtttcaccatgttggccaggctggtcttgaactcctgacctcgggtgatccgcccgcctcagcctcccagagtgctgggattacaggcatgagccaccacgcccggcccaaactgtgctttttttaaataaagaaattaaaacagtatttttttccttaaagatggtgtctcactacattccctggctcaaacgattctggctcaaacgaattcctaggctcaaacgattctcctgcgttagcctcctgagtacctgggactataggtatgtgccactattcctgaaaacataatcagttttgaaggtagtgtctgggctgggcgcagtggctcacgccttcaatcccagcactttgggaggccgaggtgggcggatcacctgaggtcaggagttcgagaccagcctgaccaacatggataagactccatctctactaaaaatacaaaaaattagccaggcatggtggcgcatgcctgtaatcccagctactcaggaggctgaggcaggagaattgcttgaacctaggaagcagaggctgtggtgagccgagatcgcaccattgcactccagcctgggcaacaagagtgaaactccgtcttaaaaaaaaaaaaaaaaaggtagtgtgtggccgggcgcggtggctcacgcctgtaatcccagcattttgtgaggccaaggtgggcggatcatgaggtcaggagttcgagaccagcctggccaacatggtgaaaccctgtctctactaaaaatacaaacattaagccggcgcagtggtggatgccgataatcccagctcctcgggaggctgacgcgggagaattgcttgaacctgagaggcagaggttgcagtgagccaagattgtgccactactaggcgacagaatgagactctgtctccaaaataataataataataataataaaataaaaataaaagtagtatccagcgtactacaaagaggaagagtttgtgaatgtgtatgttactgttaagttaaacagtgttctagtatccatctcattatcagccttgggcagggcagggttgagttggctaatgttcattataaaccagatcatccagttggggactctgaatgagcatatgattgcccctttcatgctagacttagctaattaaactgttcatatgacctaaaaggatggctgtggtgccatagaaagaaaacaagttttgaggcaagagactttagtttgattcctacctctgctgttttctggttgtgagatttttggatcagttgcttttgtgttcatttaccaaaacttctcaagacaaaaagaataaatgagataatgtgacagtgccttgtaaataccaaatactatatagagatagctattattacttgtatgtttattgtgaacattaatcagccaatcaagttgttcagacttgtactgctgaacatcaattgcagatataacattcttggcagatgacttagtcacctccttctgtggaagaatagaagatagacagctccttgctgtctatcacagtatgttctggtcccgttggcctcaccttccatataatcatttccattctactgggctttagccactctggtgacttgagttcagcaaaaataatctttcttgatgggtggtatatatatttctaccttttatgctttagaatagtttcctttccatttctcatagggtttggatcttcataactgtttgaagagaaatcctgacctccagactgaaggaaagcacaccatgcctttataacgccagcctcggtcttttttttgttcccctctgtcttagttccttttgtattgctataacagaataccgcagactgggtgatttatttatttatttattttgttgttgtcatttgttttcttcttttttgtatcttttgaaattcttttcattgttgttgttgttttgagactgggtgatttgtttattcagctcatggttcttgaggctggaaagcccaagagtatatggtaccagcagcacctgattatgccatggtggatagacagaacggcaagagagagcttgcttttgtaacaaagtcactcccatgataactaacctactcctgtgataacgacattgcaggttcagtatccctgatttgaaagtctgaaattcaaagtgctcccaaatctgaagctttctgagtatcaatgtgatgctcaaaggaaatgcttattggagtgttttagattttggatttttagatttggtatgttcaacctgtaagtataatggaaatattccaaaatgcaaaatctgaaacacttctggtcccaaacatttcagataaaggatactgaacctttaatccattcatgaaggcagagtcctcatgacccagtcacctcctaaaggcctcacctcttgatactaccacaatggcaaccaggtttccagtacatgaatttttagggggatcattcaaactatagcaccctcctttatcccttaccctattccattagttttaatccccactttgtctcttcctctaatcttcagtctacactgtgacatgataggtatgctcaagtctctaacagctctaaaataacgttttctgtttttttttttgtcttcatttctggtggggttggataagaaaagtttttcaagttaaatcactctctattgcaagcctcttccaccttttttttttttttttttgcttcgaagaatgattgcctttaccttctcagttctcagttattttccagcacattatgattttatgaccttgatacagaagggctgggctcctggctaaattccacccttaaacctggaactgcaaccctaagtgaaaacagctaaccccattttttttcccacccaaatgttgcctctttggcctgccatgcccctatcctgtgctcataaaaatatttcagctgggctgggtgcggtggctcactcctataatcccagcactttgggagaccgaggcaggtggatcacctggggtcaggagttcaagaccagcctggccaacatggcaaaaccgtatctctactaaaaatacaaaaattagttgggcatggtggtgggcaccataatcccagctacttgggaggatgaggcaggagaattgcttgaacctgggcggcggaggttacagtgagcccagattgtgccagtgcactccagcctgggcaaccgagtgagactctgtctcaaaaaaaaaaaaacaaaaacaaaaaagatttcagcagctgggagaacaatataagcagctgacgtcagggatataaatggctgtgtgttgggaatacaagcagctgattgtcggaaatacaagccactgagtgttggtgatacaagtggctgagcagcgagcagagaatcaggtgagcgttggagactatggatgggacgtggctaacttcagatggtgcagctttggagaataggcccagccggagatggcctggcttcagggaaagatcaccttcttcccataccatccctttttcaactccccattctgctgagaaccacttccatcgtgcaatacaatcttctgcatatactacccttcaatctgttcatgtgatctgattattcctggacactggaagagaacctgggtgccaagaggagagggcaggggctgccaccctgaccctccactgagctggctggcacctggccatccccgaatggccgcgttgaaggagcattgattgtaacacacttggatgctgctgcggggccgcatagagcctgcgcctgccagagaggagcaactggctggttcccgcattcgtttgctctgattcccacactcactcactcgcttgcacactgcctcttgcaaggggtttgagtgtgtggtggccgagtaaacgagccacgctccgagccatgagggggtcaagggaattatccagtctcatctcaatccgacttccctcttcactgttttacttttgtaaaacccttgatgaacttcccattgtcaattcagggtctttttagctctcatcctgccagactgttgataacacctctgatttgtgctccacttttggcttctgtgtcatattgattcctgagttttcttccttctcctctattctcttaatctcgttttctggttttctcccatcacctgctggttaagcttaggggttatttacacttctctccttggtcatctttttactgtatttttccctccacagctatttcatccatttctgaggcctgagatttcatccatttctgaggctatagagaccagtgacttcctctgactcttctgagcttgaaattcctattggtaactgccattggacttaactgcctggttatatctctaactaaagtacttctctcttccagcctgtttatcttattgtgttccattgtgttccttatctctaccaatgctagttccttatgctagaaatctcattcattgccactcaatcaagtttgctaaaaacgaaacatctgattgtgtcacttattcaaccttaccaatttttttttttttttgagccttgctttgtcacccatagtggcacgatctctgctcactgcagcctccaccacccaggttcaggtgattctcctgccgtagcctcatgagtagctgggattacaggcatgtgccaccatgcccgactaatttttatatttttagtagagacggggtttcaccatgttggccaggctggtctcaaactcctgacctcaagtgatctgcccaccttggcctcccaaagtgctgggatttcaggcgcctggcctgttacttgattatatgctaaacaaggggtggattattcatgagttttctgggaaagaggtgggcaattcccggaactgaggatccctcccctttttagaccatacaaggtaacttccggacgttgccatggcatctgtaaactgtcatggtgttggcggggagtgtcttttagcatgctaatgtattataattagcgtatagtgagcagtgaggataaccagaggtcactctcctcaccatcttggttttggtgggttttggccagcttctttattgcaaccagttttatcagcaagatctttatgagctgtatcttgtgctgacttcctatctcatcccgtaactaagagtacctaacctcctgcaaatgcagcccagtaggtcttggccttattttacccagcccctattcaagatagagttgctctggtccaaacgcctctgacacaaggattttaaagtcttattaattaaggtaagatagttccttgcatatgtggtctgaaatcacagaaagctgaatttgaaaaaggtgcttggagctgcagccagtaaacaagttttcatgcaggtgtcagtatttaaggtacatctcaaaggataagtacaattgtgtatgttgggatgaacagagagaatggagcaagccaagacccaggtaaaagagaggacctgaatgccttcagtgaacaatgatagataatctagacttttaaactgcatacttcctgtacattgttttttcttgcttcaggtttttagaactcatagtgacgggtctgttgttaatcccaggtctaaccgttaccttgattctgctgagaatctgatttactgaaaatgtttttcttgtgcttatagaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctgtacgtatgagttttgttttattattctcaaagccagtgtggcttttctttacagcatgtcatcatcaccttgaaggcctctgcattgaaggggcatgacttagctggagagcccatcctctgtgatggtcaggagcagttgagagagcgaggggttattacttcatgttttaagtggagaaaaggaacactgcagaagtatgtttcctgtatggtattactggatagggctgaagttatgctgaattgaacacataaattcttttccacctcagggccattgggcgcccattgctcttctgcctagaatattctttccttttctaactttggtggattaaattcctgtcatccccctcctcttggtgttatatataaagttttggtgccgcaaaagaagtagcactcgaatataaaattttccttttaattctcagcaaggcaagttacttctatatagaagggtgcacccttacagatggaacaatggcaagcgcacatttggacaagggaggggaaagggttcttatccctgacacacgtggtccctgctgctgtgttcttcccctactgactagggttagactgcacaggctaaactaattccaattggctaatttaaagagaatgatggggtgagtgctttggcaggagtcagggaagagcaggtagcaggtaactggaatgagggtggagcaggtaatggaaaaacattgctttacgaggaagttaagtttaaaagtagaaggcaaagaattgaacatactggcgtattaattctttgaaatttagaactcacatctaacattggcttaaatgttaaatcctcaaagataacattcctgtttctcctaacacgattaagtccttcttggtatcttttctcatagcaacttgtcctttctcacttgtcacaatttgcaaatatatatttatttacattgtttatttaatgcctaatttccttctttattgcaaggcctgtgagggtactgagtctccagggtgaggtgtataataaatggccaaacgaattgttaattgaaaggatgaacaactaattcaagccagcactctctagactcctggggggctatcatgtgggttccctggtgctgctgatgtcagcccttggcctccaagaaaaatgcttgattcaaatgtcatctagttccatctctacgactctcatggggtccaaagaagagttttaattgagttttagaatttgaagttgtgaagtgtctgaaaaactacatggtgttctgaaagccaaacttttagccttttgggagagcatctaagacagcaggtgaagggcaggggttagaactagagggattgaagaatattatccatataggttagggttaggtttggcaacgtattatagaacaaacattggcaagctacagccacaggccagatctgtctgctacctttccacaaaggtgtaataacaaagttattcacaaatttgtgaataaactttcattggaaagtgaccacgctccttggtttatacattgtctgtggctgctttcacactacagtagcacagttgagtgtttgcactggagaccatatgacccatagagcttaaaatattcagtctggctttttacagagatgtttctgactttgttaatagaaaatcaaaacaactggtttaaataatgcacatactttctctctcatagagtagtgcagaggtaggcagtccagattagtacggtggcttcacgttcatcaaggactcaatctccttctttcttctttagcttctaacctctagcttacttcagggtccaggctggagccctagccttcattctgacagtaggaaggagtaggggagaaaagaacataggacatgtcagcagaattctctccttagaagttccatacacaacacatctccctagaagtcattgcccttacttgttctcatagccatcctaaatataagggagtcagaagtaaagtctttttggctgggaatattggcacctggaataaaaatgtttttctgtgaatgagaaacaaggggaagatggatatgtgacattatcttaagacaactccagttgcaattactctgcagatgagaggcactaattataagccatattacctttcttctgacaaccacttgtcagcccacgtggtttctgtggcagaatctggttctataacaagttcctaataagctgtagccaaaaaaatttgatgaggtattataattatttcaatataaagcacccactagatggagccagtgtctgcttcacatgttaagtccttctttccatatgttagacattttctttgaagcaattttagagtgtagctgtttttctcaggttaaaaattcttagctagattggtgagttggggaaaagtgacttataagatacgaattgaattaagaaaaagaaaattctgtgttggaggtggtaatgtggttggtgatctccattaacactgacctagggcttttgtgtttgttttattgtagaatctataccccattcacagaagataccgagactgtgggccagagagccctgcactcaattctgaatgctgccatcatgatcagtgtcattgttgtcatgactatcctcctggtggttctgtataaatacaggtgctataaggtgagcatgagacacagatctttgctttccaccctgttcttcttatggttgggtattcttgtcacagtaacttaactgatctaggaaagaaaaaatgttttgtcttctagagataagttaatttttagttttcttcctcctcactgtggaacattcaaaaaatacaaaaaggaagccaggtgcatgtgtaatgccaggctcagaggctgaggcaggaggatcacttgggcccaggagttcacaagcagcttgggcaacgtagcaagaccctgcctctattaaagaaaacaaaaaacaaatattggaagtattttatatgcatggaatctatatgtcatgaaaaaattagtgtaaaatatatatattatgattagttatcaagatttagtgataatttatgttattttggatttcaatgcctttttaggccattgtctcaaaaaataaaagcagaaaacaaaaaaagttgtaactgaaaaataaacatttccatataatagcacaatctaagtgggtttttgtttgtttgtttgtttgttgaagcagggccttgccctgtcacccaggctggagtgaagtgcagtggcacgattttggctcactgcagactcaacccaccagtttcaagcgattctcctgcctctgcctcccaaatagctgggattacaggtgtgtgccaccacactcggctaatttttgtatttttagtagagacagggtttcaccatgttgaccacactggtctcgaactcctggcctcaagtgatctgcccaccttggtctcccaaagtgctgggattacaggcatgagccactgcgcccggccctaagtggttttaatattttgattgacagtatactgaagaaatatactctaagacctttatgaatctcctcattcacaaataacactgtaggatataatggtccctataaaatacggtataactaaaatcagatttttatattggagtacagaacaataaagccatcttcagatgctggtattaaactcactggtgactggtcacaccttgcctaaactggtagccaccatgcatcctctcaccatctccactgtactacttccttccttgggaagtcgggcgctgggaggttgtacaggaaagatacagacccacccttctcagcctctcctcccctagctcgctcttttgccaaagtgacctactgctgagtttcaaagtgacctactgctgagtttcagccaactagcacgtttcagattcataccttagaaaaaattacacattatcacaagtcatgcaccttttaaggtcattttcaaataatagaaattataagtgttcggccaggcatggtggctcatgcctgtaatcccagcactttgggaggccaaggcaggaggattgcttgaggtcaggagttttttttgtttttttgtttttttccccgagacgaagtctcgctcttgtcccgcaggctggagtgtgacagcgcgatcttggctcactgcaagctgtgcctcctgggttcaagcgattcttctgcctcagccccccgagtagctgggattacaggcgcctgccaccacacccggctaatttttgtatttttagtagagactgggttttaccgtgttggccaggctggtctagaactcctgacctcaggtgatccacccacctcggcctcgcaagggctgggattacaggcgtgagccaccatacctggccgaggtcaggggtttgagaccagcctgagcaacatagtaagacctatctctaccaaaaaaaaaaaaaattaactttccaaatgtaggagtctactctgtttccttctagtatttatttctgtatacttttctaacatggttaaaatgtgtaatcaatatgtgtccttttactttggtgtgaacattttttctattataaattcttagaaaatatttctatggctatgagatatttgattcaagtgccttgtaatttacttctcaaatgtccctgatgttggacatttgtttctagtgtttcactattttaaaaaacagtaatatctgtctttatgcttagagctttttcagtttttcaaattatttccttagggtaaaatcctagaagtagaatttttggggcaaattatctacatatttataactgtcttggtattcaaaatctcgttttcaaaaagcttatatcaatttgtacttaacaccagtagtgaatgagagtatctgtcgtaccccaccagtgctgaatttcttttttaaaactgtgctggtttttataggtaaagaaaatgtcttaatttgcatttagttggttactagtaatatcacataccttttcaatgcttgtgaactttaagcttatacagagtttaaccttgcatgttgaacatttgagtgagtggaagtgttaagtgatggccatctgtataatctattagtaatgtatggagaccattaaagatgacaggtatgtgtgatgatgacaggttgttaccaacactcagaaggccaaaaagcaagtgatataaacccatgctgggaagcattcacctcccccactttaaaaatgctagtttcttaattccttttctttatccctttttttgtctgcacgtgtttacttgcctttagtttccctgctttagtaggctgaccttgtgacttttaccaggatcccattatacttttgttcttctgtttatttctcagattttattggagggtggaattctactttttctttcttataatctagaatttacattcagatttcctgcctttcccttacaaaatacctgtgtagttggataggtggagctctggactcagagttctttcttctagtaatcttaggaaattatttaatttttctgtgttttcatattttcacacataaaagagaaaacaccatttctaaactacctcttcttttctctgcttttaagcatgtaaaggttttcccaatcttgggcagtgacatgtacaggacagtatagctttacatctgccttgttttaattaaacactagttctttgaggtaacccctactattatcccagttttatggatgaggcactgaggcaggggtcacacagctagtgtgggtcagaacctaatgggtcagaatggacatttgagtccagagtttggcctggattgacacacatagctattacgtaagattcctctcaaattcagtcctcagctccctgaagtgtgggttctcttttcatgcctccatggaaactgcgtatcatgtggttaccagtttttcctttggtcgtatctgctgacctttttgaacctaattttttctggaccttattgccatttgacttatttattgcctcccacttgacactgattctggcttttgcttttcttcctactttggtcctttttgcagttttctaaagctaaccagccatgactctcagatgatggactttttcgtctctcccattacttcttgggaaattatattttaatctcatggtttaaattttcatccttaaatataacttttaatgtagtatttttagcccagaagggcccatggttggtttgttttctcctttgcatatctcttctactcagatacctggtagcatataaatcaaatgaattatccttcataccatttcattatcatcagtaggactgctttgctggggtttttttgtgtgtgtgtttttgtttttgtttttgtttttgttttgagataaagtcttgctttgtcacctaggcaagagtgctaggattacaggcgtgagccgctatgccaggacagccgttttcttctagtattatttgccctctgtctgaacatcttcctttagtaatgcttttagagcaaggcagctggcctcaatttgttttaatttttcttccccttaggatgttttaattttacctttattactgaaggatattgttactgggcagaaaattgtcttgatattccccttttcagcatttaaaaaatgctcttctgctttctttcagcctccatggtttctcataaaaatcagtcattcgaatcactgttcttctaaaagtaatacattgttttgttctggtcactttcaaaattttctttttcttttcagcagtttaattatgggactgtgtgaggatttctttgttcattctgtttggagttcactgagctttttgaatctctaggtttatgtcttttaccaaatttggaaaatttttcaaccattatttcttcaaaatttttctgtaccacattctttactctttttttttttgaaacagagtggcgcactgcaacctctgccttcccggttcaagtgattctcctgcctcagcctcccaaagtgctgggattacgggtgcctgccaccatgcctggctgattttgttaatttttagtagagacggggttttaccacattgaccaggctggtcttgaactcctggccttaagtattccgcctgcctgggcctcccaaagtgctgggttacaggtgtgagccaccacacccggcccttttttttttttttttttgagaccgagtctcgctttgtcacccaggctggagtgcagtgatgtgattttggctcactgcagcctcagcctcccaagtacctgggattacagagatgtgccaccatgcccagctaatttttgtatttttattagagatggggtttcaccatgttggccaggctggtcttaaacccctggcctcaagtgatccgtctgcctcagcctcccaaagtgctgggattacagacgtgagccaccatgcctggctctttaccctcttctgggagtgacaacacaaataactttttattccacaggtttctgaggctctgtttattttccaatttttttcactattgttctggttagataatttctattgatctgtcttcaagtttcctgaaatttgcattttgttggtaaacctattcagtaaaatgtttttggttattttatttttagttctaaaattcctatatagcccgtctttacatttttttattctgaaacttaaaactttcctttcattttaagagtgtttgcccttacttcttggagcatttttatgctccaaggattttgatatttttgttttattggccaattgatctgattgggctaggtccagccagccttgtcaaagcctttgcagtgttgctcagatctgccccatgtatatgccacccagtcaccagtctgggactggtatagtggtgttctatttgtaattcggttgtcagggtcggtgtgtactgttgaggatcatatccatactcactcaccttgggaatggacccacaagtttataaacagctttaagagattgctttcatgagtttctttctttctgtgatctccatgtggtttcttgggcttcccttttccattcctgcagccaaaagtggactttatcttcctaaagtcagggccaaaatgtgggaggagagagagaaataaagcaagggctatttgccccactctctcgggactgacattcttccagtcagagtaaggattccctccctctgaattttaggcttctgccacccacattaccatcaccacaggattgtgtgaggactgggcatacgagaatggagaaaagcggaaaagaatgccgggtgtggtggctcacgcctgtaatcctaacactttgggaggccaaggcgggcagattgcctgagctcatgagtttatgaccagcctgggcaacacagtgaaaacctgtctctactaaaatacaaaaaattagccaggcatggtggtgggcacctgtagttccagttactcaggaggctgaggcaggagtattgcttgaacccgggaggcagaggttgcagtgagccaagatcgtgccactgcactccagcctgagctacagtgcgagactctgtctccaaaaaaaaggaagaaaaactggatttttacactgtctgggtgttaggagacctctttcctgatcctcaagccagaactagaggtcttctggagctcccattgtcttgctaatgcccactcatgttgtaatgagcacaggtggaggaaaaaaagtggtcagctcactgctagtacttctaattccccagcccacctacctctcattacttttcatcttttgcaaccagctgctgcctgctttctgcccaggttttgtaactgtattcagtgggatagagagagtggaaggtacttactccatcttatctggaacctttcttaatatattttttgtcgcatttgtacatcttttatccatccttcattttattttatttttttttttgagacggagtctcagtctctcgcccaggctggagtgtagtggcatgatcttggctcactgcaacctccgcctcctgggttcaagtgattctcctgcctcagcctcccaagtagttgggattactgggacacgccaccatgcctgggtaatttttgcatttttagtagagatgagggttccccatgttgcccaggctggtctcgaacttctgacctcaggtgatccactggtttcggcctcccaaagtgctgggactacaggcctgagccaccacgcccagccttatccttcattttagacagtttaagaggtttgtattcagccagatctccacatttacttgttcatttgtgttgtgatgttttttaatgttcaagtcttagcacacacaaacaattatatagaaacaagttgtttactttgacacccagtataactaaaaggatcttttgagtcagagattgagtaacttgccagagcctgtttggaaataaaccctgaggatttttcatatcagtggttggttatgcaatgtctgtggcaagccctagaaactaaaagaccaaaccttaaaatgttaaaaacaggaaaggcagttaattattatacataatttgttataaaaggaactataacttattaaagtcagatgatttctggccttgatagtttagggtttagagaagatactgttgtgtactataaaacagcagggctgttttctttcataccctttagcacaggaaagctgaactagggatttttgcaagatgagaaaggcctgttgaaatgtgtgtgtataacatagtaataaaagaaatgcatatgaaaataacaaattaacatatttgacatattgactttgtcaagattagtcttttttgtcaagtaactaagccagtgtgtattaattaaatcagtaattagaaaaagtttgtacactttgatttagtaattttgcttttatgatatattctaaagaaggaattagaaatgcagaaaaatatttgtgaagtaggatgttcattttaatgtaaattaaaattggggaaagaaagggaaaacaatacagattccatgcataaggcaaaggttcaattgtgggtttatccgtatgagtagactattattttgtcatttaaaaatcatagtttcagctgggcgtggtggctcacgcatgtaatcccagcactttaggaggctgaggtgggcggatcacctgaggtcagaagatcgagaccagcctgaccaacatggagaaatcctgtctctactaaaaatacaaaaaaattagctgggcgtggtggcgagtgcctgtaatcccagctactcaggaggctgaggcaggagaatcgcttgaatctggggagtggaggttgcggtgagattgcgccattgccctccagcctgggcaacaagagcaaaactccatctcaaaatcaatcaatcaatcagtcaatcaatcatagtttcacgccaggtgcagtggcacggacctgtagacccagttacttgggaccctgagacgagatgattgcttgagcccaggttttccagtctagcctgggaaacatagtgagaccccagtctcttaaaaaaaaatcatattttcaaataatatttggtggcatgagaatatgtttgtaataaaagattacatttgtgaaagcagaatgtaaacagtacactagttgattctcactgttaaggtctttacacacgcctatacgtgcagatagaaaacatgtctgaaagggaaacggttttattttgtttcgtatttttttttgagacaatgtctcactttgtcagtcaggctggaatgtagtggcactgtctcggctcactgcaccctatacctcctgggttcaagcaatcctcccacctcaacctccatggtagctgggactacaggcacctgccaccacgcctagctaatgttcgtatttttagtagagacggggttttggcatgttggtcaggctggtcttgaactcctgacctcaggcaatccacctgtctcagcctcccaaactgctgggataacaggcgtgagccactgtgcctggcctgaaagggaaatgttggtattaattttggttgtcactggcctttagaatagttttcttcttttagtgtttctgtgtttcttaagtgttacaagcatatgttacttttgattcagaaaaatgctatttttaaaataagcaagactgggcacggtgactctcaccagtatggctgagaccagaggatcacttgaagccaggagttcaaaaccagcttgggcaacagagtgagacccccacctctacaaaaagaaaaaaaaaaaattaaaaaattagccaggcatggtggtgtacccacgcctatagtcctaggtactagggaggctgaggtgggagtatggcttgagcccagtggttcgagattgcagtgagctacgatcatgccactgtaccccagcctgggcaacacagtgaggccctatctcaaaaaataattaaaaaaaaaatatttgggggctcctagaaggtacagttaaaaaaattaaaattaggccgggcatggtggctcacgcctataatcccagcactgtgggaggctaaggagggtggatcacttgagatcaggagttcaagaccagcttggccaacatggtgaaacttcatctctaatacaaaaatcacctgggcgttggtggtgggtgcctgtaatcccagctactcgggaggctaaggcaggagaattgcttgaatctgggaggtggaggttgcagtgagccaagaccatgctactgcactccagcctgggcgacaaagtgaggcttcatctcccaaaaataaataaataaaattaaaaaaagaaataaataagaacatctccttcttcctttgccaaaaaaccgaggtgaaaagcatctctcaagaatgatgagaatttcaattatttaatatttactctggtccttaatttaaagcttaatatggaatcccagtgtacatctcccactggtattgtttgtcttggccaagacagacaagttttaaagagtgagataaaatttaggctaaagttgaagtatttggagggaaatgtacagatgttctcagcttaccttttttgtttttttgagatggagtctcgctctgttgctcaggctggagtgcaatggtgcgatctcagctctccacaacctccgcctctcaggttgaagtgattctcctgcctcagcctcccaaatagctgggactgcaggtgtgtgccactatgtctggctaatttttgtattttttttttttaatttattttttattgataattcttgggtgtttctcacagagggggatttggcagggtcataggacaatagtggagggaaggtcagtagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaaacacatcttgcaccgcccttaatccattcaaccctgagtggacacagcacatgtttcagagagcacagggttgggggtaaggtcacagatcaacaggatcccaaggcagaagaagttttcttagtacagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggcggccgggcagaggtgcccctcacctcccgggcggggcggctggccgggcggggggctgacccccccacctccctcccggacggggcggctggccgggcagaggggctcctcacttcccagtaggagcggccgggcagaggcgcccctcacctcccggacggggcggctggccaggcggggggctgatccccccacctccctcccagacggggcggctggccgggcggggggctgacccccccccacctccctcccggacagggcggctggccggccggggggctgacccccccacctccctcccggacggggcggctggccgggcggggggctgacccccccacctccctcccggacggggcggctggccgggcggggggctgacccccccacctccctcccggacggggcggctggccgggcggggggctgacccccccacctccctcccggacggggcggctggccgggcagaggcgcccctcacctcccggacggggcggctggccgggcggggggctgacccccccacctccctctccgacggggcggctggcctggcagaggggctcctcacttcccagtaggggcggccgggcagaggcgcccctcacctcccggacggggcggctggccgggcggggggctgacccccccacctccctctcggacagggcggctggcctggcagaggggctcctcacttcccagtaggggcggccgggcagaggcgcccctcacctcccggacggggcggctggccgggcggggggctgacccccccacctccctcccggacggagcggctggcggggcggggggctgacccccccacctccctcccggatggggcggctggcctggcggggggctgaccccccccacctccctcccggacggggtggctgccgggcggagacgctcctcacttcccagacggggcggctgccgggcggaggggctcctcacttcccagacggggcggctgccgggcggaggggctcctcacttctcagacggggcggccgggcagagatgctcctcacctcccagacggggtcgcggccgggcagaggtgctcctcacatcccagacggggcggcggggcagaggcgctccccacatctcagacgatgggcggccgggcagagacgctcctcacttcctagatgtgatggcagccgggcagaggtgctcctcacttcctaggtgggatggcggccgggcggagacgctcctcactttccagactgggcagccaggcagaggggctcctcacatcccagatgatgggcggccaggcagagacgctcctcacttcccagacggggtggcggccgggcagaggctacaatctcggcactttgggaggccaaggcaggcggctgggaggtggaggttgtagcgagccgagatcacgccactgcactccagcctgggcaccattgagcactgagtgaacgagactccgtctgcaatcccggcacctcgggaggccgaggctggtggatcacttgcggttaggggctggagaccggcctggccaacacagcgaaaccccgtctccaccaaaaccagtcaggcgtggcggcgtgagtctgcaatcgcaggcactcggcaggctgagtcaggagaatcaggcagggaggttgcagtgagccgagatggcagcagtacagtccagcttcggctcagcatgagagggagaccgtggaaagagagggagagggagaccgtggggagagagagggagagggagagggagagcgcttaaaacaatttttaagatgtatttcttttctcatagttccagaggccagaagtcccaagtcaagggttggaagcaatttttgtatttttagtagagatggggttcaccatattggccaggctggtcttgaactcctggcctcatgatccgcctgccgtggcctcccaaagtgctgggattacaggcatgagtcactgcgcccgatctctcagtttactttgatatgtattaataataacaaagactaatggatgaggagctagacagaaattttataaaccaagtactgcaaaatatgaatggtagactctaggtgatatatgggtgttcactgtaaaattaattaaattttgctgtgtgttcgaacatttttgtaacaaaatgttggaaaatttttgtggaagaacaccagaaacaactttgttgtatctggatataatttagaatattcaaatgttggctaggtgcggtggcaacctgtaatcctagcactttgggaggccaaggcaggtggatcacctcaggtcgggagttcgagaccagcctgaccaacatggagaaactgtgtctctactaaaaatacagaattagccaggtgtggtggcacatgtctgtaatcccagctacttggggggctgaggcaggagaattgcttgaaccctggaggcggaggttgcggtgagccgagattgcgccattgcactccattctgggcaacaagagcgaaactccgtctcagaaaaaaaaaaagaatattcaaatgtccaaggagtaccaatatctaggtaaagccattctgttggcctttgccaaattgtactattttataaagttgttttaaagagagatgtgggccgggcatagtggtgcacatctgtaatctcagcactttgggagtctgaggcgggcggatcacttgaggtcaggaatttgagaccagcctgggcaacatggcgaaaccctgtctctactaaaaatacaaaaattagcctagcgtggtggcgcgcacgcgtggttccacctactcaggaggcttaagcacgagaattgcttgaacccaggaggcagaggttgtggtgagctgagatcgtgccactgcactccagtctgggcgacaaagtgagaccctgtctcaaaaaagaaaaaaaaaatctgtactttttaagggttgtgggacctgttaattatattgaaatgctttcttttctaggtcatccatgcctggcttattatatcatctctattgttgctgttctttttttcattcatttacttggggtaagttgtgaaatttttggtctgtctttcagaattaactacctttgtgctgtgtagctatcatttaaagccatgtactttgttgatgaattactctgaagttttaattgtttccacatataggtcatacttggtatataaaagactagtcagtattactaattgagacattcttctgttgctccttgcttataataagtagaactgaaagaacttaagactacagttaattctaagcctttttgaagattatatagtcttctagtagaagtctgtgcatcagaatgttttaagaaagggttttaagaatgtataaaaaccaaaataattgattttcatacttctatattgttttttatcagtgactcttttttctttcaaatgaaatcttatatgaaattttcatatataatatagaaaaaagtggatctagtctgtcaaagagaatagtgaagctcagagatgtgccagcctggcctttttctcagctcaagtggcagaatacagtttgtaaacaattgcactagctcttaaattcgaagaggcagtcaaactaataaataaattggagagttatttctttggtagaggattaagggaaataaccacagacagaagaagcaaatatgagaatctatgtgaaatggatgatattctagaaaaaaaattatcaaaactgacccctaaagagagaatatctaaacagagtaaagaagaggtacagaaagttactgaagaagtttccaccccacctgcacaaataacaatagtaccaggccccagtggattaatggggaaattctgttaaacctttaaggaatggtaactctaatactaagtgttccgaacatataaaaagaaaaaaagcttccagattaattttatgaagccagcataacattaataactaaagccctgcaagttatcaagtaaaagaaaactattggtcggttatatttattgatttcaaaagcataacagaatattaagagaattcagcaatagatgaaaagaataatactttttttttttgagtctcacgctgttgcccaggctggagtgcagtggcatgatctcggctcactgcaacccccacctcctggattcaagcgattctcctgcctcagccccctgagtaaccgggactacaggtgcgcaccaccatgcccagctaatttttgcatttttagtagagacagagtttcaccatgttggccaggatggtctcgatctcctgacctcgtgatccgcccgccttggcctcccaaagtgctggaattaacaggcctgagccaccgcaccctgccataataatacatttgaccaagtggagtttgtttgcagaatcgttcattataagttgccatattactagatcatcatctctgtatgtgctaaaaggcatttgataagattcctgttcttgatcagattccttaataaatagacggggtcgggtgtggtggctcatgtttataatctcaatactctgggaggctaaggtaggaggatagcttgaggttgaaagttggataccaacctgcgcaacataacaagactttgcctctacaaaaaataaattagccagttgtggtgtgtgcatgtagttctagctgcatgggagactaaggcgggaggatggcttcagcccaggaattcaaggctgcagtgagctatgattgcaccactgcaccccaggctgggtgactcagtctctaaaaataaataaataactaaatctctaacattataaaatgtatgcatctcattctaaaggccaatgtcatcctcatagggaagctagaagcttgcctattaaggtcaggaatgagatggaggttttcttttctttcttttgtttgtttgttttttgttttgttttttctgagatagagtctcactctgtcatccaggctggagtgcaatggtgtgatctcggctcacaggaacttctgcctcctgggttcaagcgattctcctgcatcaaggcctcccaagtagctgggattacaggcacctgccactatgcccggctaatttttgcatttttagtagagcaggggtttcaccatgttggccaggctgttctcaaactcttgacctcaggtgatccacctgcctccgcctcccaaaatgctgggattacaggcgtgagccactgtgcctggctgagatgaaggttttctttatcaccaattatctagcattgctctggagggactagcaaacacaattaaacaggagaaagaaatacgaactatataatttggaaaagaaggttaaattaccaatatttggagataaaatgattgtttactttgttttagaactaactgaaaaccaattcaaattactaagtaagtttggtaaggcaattaattgattacaaaattaaacaaaagtcccctgtctgggtgccgtggctcatgcctgtaatcccagcactttgggaggccgaggcgggtggttcacctgaggttaggagtttgagaccagcctggccaacgtggtgaaaacccacctctactaaaaatacaaaaaattagccgggcgtggtggtgggtgcctgtaattccagctactctggaggctgaggcaggagagtggcgtgaacctgggagatggaggttgctgtgagccgagatcgcaccattgcactcccacctgggcaacaagagtgaaactccatttcaaaaaaataaagtgaaaacacaaatcaataaccttcacataaacaactagttagaaaacataataaaaggataagtcccatttatgatagcagcaaaaaagattaaatatctacgagtaaacaagaattgtgcaagccctggacactggtgaagcagagatgccagctgaggtcctgcccccagctccccttaagctgagcagtgtggagaacatcttgcacaggctgctgactgccttccaagaagcccttgacctttaccatgtgttggtctcccttgaccgggtgggcactgagcagtagcaggtgtagactgagctggcctctaacttcctttggatccacagccagttgtaggccaacaacggggtggaggggtctgatgtggctccaggccctctccagctcaggttacccctccttatgtacattgtactcagagctgctagtgcaggctgtgcagaggaaggcaggggacactgaggtccagcagtccctgctcctgcttctgaagaaatagatattttaagtgaataaactgacagcttagaggggtaaaaaagataatatgcaagatctattgagaattttaaggctgggtgtggtggctcacacttgtaatctcacctatttgggaggccgaggtgggaggatcctttgagcccaggggttctagaccatcctgggcaacatggttgaaactccatctctacaaaaaatacaaaacttagccaggcgtggtggtgcatgcctgtagccccagctgcttgggaggctgagtcaggaggatcacttgagccaaggactttggggctgcagtgaactgtggttgtgccctctatccagggtgacagtcagaccttgtctctatttaaaaaaaaaaaaaaaaaaaattaaaatatgctatcatttgtgtcaagtagaaaagtatatatatgacatgtatagactttctggaaggatgtacatgaaattaatagtagtgctttccaatcaggcacggtggctcacacctgtaatctcaacatttttggaggtggagacaggaggactgcttgagcctaggagttcatagccagcctgggcaacatagcaagaccccatctcaagaaaaagtagtgctttcctctaaagaggggaaccatggggcacagtggggagaaaacctacttttcacagtatctgttgtgaattttatatcttattcatgtgttacctggccaaagattaataaatagattgtttttgtttttgttttttagtttgaggatactggaaatgcttaatataaatatctacatcgtccagaaatttcaatgtttactctattttggaatttcaaagtgggagaggaatcatctttttggatggtacctgaaactgaaagtttatgcctaaaggcgtgcttgctttctcctcagttacctcaggcatcttctacagttgcaatctctttgttgttagatggtggattttgcctccccagaattaaaatagcattttcttcattataaaaatacttaacattcattgtttttttaaaaaagacattatataagattataaagaagaaaaatgaccagattcccaccacctaaagataagtcctgtcatcctttcaggaattaatatatcaatttctcatctactcttctctcacactactttgcataaatgggatcataaatgggatcctatattttttcaagcaacagtgtgttatgcctatactccatgtttatatgtgtgtattaaaaaatgtatttgtatatatgtgtatgtataagtgtgtgtgtgtgtatgatgattcttctcccgctttgaaggtgaaagaaagcacacctttatttaagcataaactttgggtttcagatactgtctggaaaaatgatttatctcccactttgaaattccaaaatacgtacatatattttttttttcttttcttttttagttttagggtcttgctgtgttgcccaggctggagtgcagtagtgtgatcatagctcacacagcctctaactcccaggctcaagctatcttcctgccccagcctcctgagtagctgggactgcaggcatgtgccatcaactttagctaattttaaaatttttttgtagtgatagagtctcactgtgttgcccaggctcgtctggaattcctggcctcaagtgatcctctcacctcagcctcccaaattgctgggattagagtgtgagccactgtgcctagcctgcatatatctatttttaatgactgctaaatctcattgtatgaaaatttatgtcctagctataaaatttgttagcacatgtttaattttttctaatttcagatgttttaaactaatatttcccaaagtatagtatggcattttaggtatgatatgatcttttttcctcttcgtactcatttttatagttatggcctgtgcaactggtttcccatttatatgaatgatacagagcttcctattaagaaaaagttcagcttgggaaaaaaaaagtgaattgttcaacttgagggaaaaaagtgaattaattggccaggcaccgtggctcatgcttgtaatcccagcactttgggaggctgagacgggtggattgcttgaacccaggagttttagaccaacctgggcaacatgttgaaaccctatctgtacaaaaaaaattagaaaaattagctgggcatagtggcacacacctgttgtcccagctacttaggaggctgagctgggaagaccacctgatctccggaggtaaagactgcagtgagccgtgattgcaccactttactccagcctgggcaacaaaatgagaccctggctcaaaaacaaaaacaaaaacaaaaaaagagtaaattaatttaaagggaagtattaaataaataatagcacagttgatataggttatggtaaaattataaaggtgggatattaatatctaatgtttgggagccatcacattattctaaataatgttttggtgaaaattattgtacatcttttaaaatctgtgtaattttttttcagggaagtgtttaaaacctataacgttgctgtggactacattactgttgcactcctgatctggaattttggtgtggtgggaatgatttccattcactggaaaggtccacttcgactccagcaggcatatctcattatgattagtgccctcatggccctggtgtttatcaagtacctccctgaatggactgcgtggctcatcttggctgtgatttcagtatatggtaaaacccaagactgataatttgtttgtcacaggaatgccccactggagtgttttctttcctcatctctttatcttgatttagagaaaatggtaacgtgtacatcccataactcttcagtaaatcattaattagctatagtaactttttcatttgaagatttcggctgggcatggtagctcatgcctgtaatcttagcactttgggaggctgaggcgggcagatcacctaagcccagagttcaagaccagcctgggcaacatggcaaaacctcgtatctacagaaaatacaaaaattagccgggcatggtggtgcacacctgtagttccagctacttaggaggctgaggtgggaggatcgattgagcccaggaggtcaaggctgcagtgagccatgattgcatcactgtattccagcctgggtgatagaacaagaccttgtctcaaaaaaaatttggtttttcaagctttttgaggttttgacaagctggccaatatggtgaaaccccgtctctactaaaaatacaaaaattagctgggtgtggtggcgtacccttgtattcccagctacttgagaggctgaggcaggagaattatttgaacccaggaagtgaagtggaggttgcagtgagccgagatggtgccactgcactctagcctgggtgacagagcgagactctgtctcaaaaaaaaaaaaaaagcaaaaaaaaaaaagcacaagcagagtggtagacacacaaaatgctcaattcattttttaaacgatttttttcctttatatcttactgcagaagcttttttcttttttttgagacaaagtcttgctgtgtcacccaggctggggtgcagtggcacagtcatagctcactgcaaccttgaactccctggctcatgcgatcctcccacttcagcctctcaagtagctagaactacaggtgtgcaccaccatgcctgactaacttgtttattttttgtagagagaacgtcttgctatattgcctaggctggtcttgaactcttgggctcaagcaatcctcctaccttggcctctcaaggtattgggattataggtgtgagccactgcatctggcctcaattcacttttaaaatcaaaattaggttacctactttttataaggtaatgtatagaattattcttttaaaaataaaaccgatttggacagtgtgagattcacattctgtaaccaccagtgtgacatgggtcctgaacagttagaacatactccagccattaacccaggcagctttcaggtacgtactctgtggctgttgccttgtatgaaagccaaaaagagatccattttcagagattaatatgtgaccccttctatattataaggccatggccatactcttttttttttctttttgtttttttcttccaaagacaggatctctctctgtcatccacgctagagtacagtggcatgaacgtggcttactgcagcctcaaacccttgtcctgggctcaaacaatcctcccacctcagccttcaaagtagatagaactacaggcatgcactaccatgcctaattttttaaaaaaaaattttttttcagagatgagatctcactgtgtttcccaggcttgtccggaactcctggcctcaagcgatcctcccaccttggcctgccaaagtgttgggattacaggcatgagccaccatgcctggccatacactttttttttttttttttttcaagacggagtctggctctgtcgcccagactggagtgcagtggcgtgatcttggctcactgcaagcttcgcctcccaggttcatgccgttctcctgcctcagcctcccaagtagctgggactacaggcatctgccaccacgcccggctatttttttgtatttgtagtagagacggggtttcaccatgttagccaggatgatctcgatctcctgacctcatgattcacctgcctcggcctcccaaagtgttgggattacaggcatgagccaccgtgcccggcctggccatacacttttgtcattatttacatacttactaaaatgtttggtggcctgtaataggaaacatcatcctcatttgattgacgaagaagtctgtggaaataggattgaactggttctgttcttgtatttgagtaatcagttgtggaactatagaagtcatatactctctctgactttcataattaccttatgttgtatagtacttgatggtttgcaaagtaaccatctattcttgcttagctgtgagtaagaatgccaggtctggagacagaatgtctgggttcaaattctactcatcactttttatttttattttttttgagatagagtctcgctttgttgcccaggctggagtgcagtggcgtgatctcagctcactacaacctctccctcccgggatcaagcgattctcctgcctcagccttccgagtagctgggactacaagtgcgcaccaccacgcccagctaatttttgtatttttagtagagacgaggttttgccatgttggccaggctggtctcaaactcctgacctcaagtgatctgcctgcctcagcctcccagagtgctgggattacaggcttgaaccactgcgcccagcctactcatcacttactagctatttgaccacacaagttactcaactcctatgtcagttatgaagattaaattaaatgatccatttaatacaataatacacttagaacaatgtctatcagtaaatttttttctgttttaagaaacaggatctcactctgtctcccaggctggagtgaagtggcacgattatagctcactgtagcttcaaaagcctgggctcaagcagtcctcctgtctcagcctcccgagtagataagactacaggcacaggttggtgttgacctcctagcttcaagcagcctcccaaagtgctgagattacaggtgtgagccactatacccagcccagtgttatatttttgtataatcctatgaagtatcaaggcagttattatccctgttttactgctaagaaacttgaagtttacagaggtaaattatttgcctaagcctaaactctgatctcgaatctgaatcccaagtccaatattcttttcaccgtattacaatatttttaccatcaaccctccattctgtctgcacatcatacaaatgagtatctctacagagctttgagttgcttttaaacaaaagagatttttgtacccaatgtttagagtagtgattctcggctccatttttacaagatttcaagatttaatttgtcaaaaaagttctgaaattttcaaagcaaaagcaattttaatttaattgctctaaaaaataagcagatttatcatttagcaattctttaagggagagtgtatcataaaactgaaatagtactgaatgtggcagaatcaaacaagttgaaaatctcatcacttcagagcagggcagacttctcattcaaacaaattgaggtagaagtggtgagagtagagatttctttgtgtatgtgtgttttattactgtactatattatattatagttctatatatactatattatattgtacatatatattattatatgaagagacatgaccactttgaggcatgaaatttttttttttttttttttttttttgaggcacggtcttactttgtcacctaggcagtggcgccatcttggctcactgcagcctccacctccagggctcaagcaatcctcccacctcagcttcctgagtagctgggactataggcacctgccaccatgagctgctaattttttgtatttttggtagagacggggttttgccatcttggccaggctggtctcaaactcctgagcacaagtgatctgctgcctcagcctccccaaagtgctggaattacaagcataagccactgtgcctggcaagacatgaaatttttaaatgtaaatgcatttaagtgacaataatgtgaatacaagttatcaattcttcctttacaagtttagctatacctgttttatatttttcagtgtttaaaattatttttatatttttatattctgaattttctttctttctttcttttttttttttttttttgagacggagtctcgctgtattgcccaggctggagtgcagtggcgcaatctcggcgcactgcaagctccgcttcccgggttcacgccgttctcctgcctcagcctcccgagtagctgggactacaggcacgcgccaccacacccagctaattttttgtattttttagtagagacagggtttcaccgtgttagccaggatggtcttgatctcctgaccttgtgatccgcccacctcggcctcccaaagtgctgggattgcaggcgtgagccactgcgcccggcctatatgctgaattttcatgacagagaatgaaagaaaaagtgcagttgatcgaaagaaatggtggtataaacaggaataacaggcatgttgtttcctctctgatttattatttttgtaaaataagctacttttcagcaccacatacatatgttctgagacctgaatatttgtgaccaaagagtaaagaagtaataaactttatctcgcaaagagttattattgtgttttatttaaatttactgccctcttacttcaagtacttctcagtagtacgtaatactgcttttaaaaaggagaagggatgaatttcttctactctgctcttcatattttgaaaagttcagtcaaatcccctttattaaattcatctcagagtaatctttttaatttgtagttcatatccgtgattagtttagaagtgacttctccctgtttctgctcactgtaggttgacaactgcttaaaatagtctatctcatcattatctctgcagctttcctttaaactaggaagacttgttcctataccccagtaacgatacactgtacactaagcaaatagcagtcaaacccaaatgaaatttttacagatgttctgtgtcattttattttgtttatgttgtctcccccacccccaccagttcacctgccatttatttcatattcattcaacgtctttttgtgtaaaaagagacaaaaaacattaaacttttttccttcgttaattcctccctaccacccatttacaagtttagcccatacattttattagatgtcttttatgtttttctttttctagatttagtggctgttttgtgtccgaaaggtccacttcgtatgctggttgaaacagctcaggagagaaatgaaacgctttttccagctctcatttactcctgtaagtatttgagaaggatattgaattagtaatcagtgtagaatttatcggaactgaagcacatgtaactatggtcattttcatggtacttgttctcatcttaaatgcacagcattcctggaactcctgcagatctctttgtttccttgcaagcaattgtcttctacctgatgttgattcaagagagttttcaatatgaatagaaagaaagaaaatgtttagatattggggaaccagcattcccattttaaaacctgttaggagttgttgattagggcaagctcaaggattcctttgagtgactggtttagatgtctttctgctattcggtgaccactggggaactgagattgttgagcagaagggtaatgtgagcagagccgtgcctttgtaagctggcagcactgtgtgagatgaattggtgggttggatactgagatcatgagaggcatactaagcataattaagatgatattgccatgatctaggtggaaagtaatgggggtttgaattatggtagtggcagtagcaatcaagggaaagagttgatcagaggattcagaggtagaatcaatagttctagcaactgaggagagaagttgtaagcttgaaggaaaggtgatgaagaaaaaatgctttcctgtgttttcttgttgttgttgttgagatagggtctcactcccatccaggatggagtacagtagtgtgatcatggctcactgcagcctcgacctcccaggctcaggtgatccacccacctcagcctcccgagtagctgtgactacaggcacgcactaccaggcctggctaatttttttgtgttgtgtgtagagactgggttttgccatgtgcccaggctggtcttgaactcctcggcttaagcgatcctcctgccttgacttcacaaagtgcttgagttacaggtgtgagctaccacgcctggccatgttttcttgtgtgaaggatctgtttagttttatatctttctgtggctcatatctaatttagttgacagtacctgtgggtcactaggtagacattgctagcagacgtttagaaatgaaatactagagcttgggaaaaagttgatatttgagatagagacttgaagaacattagcagagagttggtagttaaggtctgtgagctggtgagcaattcaaataaaagcagaagagaagaggaagacaagggtcaaactttgtcaactactgtgtttagagaatgagacaagagaggatactacaggaagtagaggaaaatagtggaaaattgggcaagccagtatttttcacttaagaatatcattactgttttttgatgtcagcacatgaaatggctgcatagtgttctcttacgtagatattcagtggtgggtatcctcattgatagacatttagatcatttccatttattttctatcacagacagcacttacagagtgcatccatgaacttatgaatattattataaaatgtattcttacagtagaattgctaagtcaaaggatgtatttaaattttgatagtttgccatattgcctcctaaaaaagctgtgcctgtttacattcccttcagtaatatgaaagtatcaatttccttacccctttggtgttttggtttgttttgttttggagactgagtctcgctctgtcatgcaggctggagtgcagtggtgcgatctcggctcactgcaacctccgcctcctgggttcaagcagttctcctgcctcagcctccggagtggctgggattacaggcgtgtgccaccacacccagctaattttttgtatttttagtggagacacggtttcaccatgttgaccaggctggtctcgaactcctgacttcaggtgatccgcctgcctaggcctcccaaaatgccaggattatagctgtgagccaccatgcccggccactgctttgttaatgcttgcctgtgtctgtgcatacatgcatgtgtgtgtgtctgagagagaaagagatctaataggcaaaaaaataacatcttgttttattttttattgtttgtctaatgctttgggtgattatttgaactttttttcatgtgtttcttagttacagatctgaatttattttgtaactggcttggtataatctttttcatatttgtgaaattaatcttttttgtgtgtgtgtgagacagtctctctctgtcacccaagctggagtacagtggcgcaatctcaactcactgcaacctccatctcccaggttcaagcaattctcctctctcagcctcccaagtagctggaattacaggcgcatgccaccacgcctggctgatttttgtatttttagtagagacgggatttcaccacgttggccaggctggtctcaagtgatccaactgcctcagactcccaaagcattagtattacaggtgtgagccactgctcccagccctgtaaaattaatcttaattatacaagtaattcattatccttgaaaaaggataaacattacagataaaaataaatttcacggtaactatcatctctaatcttaatgccttatcaagtacttacccctgttgtcagtttgttgtatatccttgtagattttttttgccaatttttctgttgagttactggaaaagcagtttcaagaaggagagaggctgggcgtggtggctaacacctgtaatcccagcactttgggaggcctaggtgggcggatcacttgaggtcaggagtttgaaaccagcctggccaacatggtgaaactctgtctttactaaaaatataaaaatcagctgggtgtggtggtgcacacttgtaatcccagttacttgggaggctgaggtgggaggatcacttgaacccaggaggcggaggttacagtgagccatgatcgtgccactgcactccagcctgagtgacagcaaggcttcatccccaccctcccaaaaaaagagaatatctttttgtttgtttgtttgtttgtttgtttgtttgtggcagagtcttgctgtgtcgcccaggctggagttcagtggggcgatctcggctcactgcaagctccgcctcctgggttcagccattctcctgcctcagcctccccagcagctgggactacaggcacacgccgccacgcccggctaatttttgtatttttagtagcaacggggtttcaccatgttagccaggatggtctcgatctcctgaccttgtgatccgcccgcctcggcctcccaaagtgctgggattacaggcgtgagccaccgcgcctggccgagaatatcattttttataaagaagtcaaaggtaatgaggactaagtaaaaccatacagtatttgctgtctaagatgtcattagtgacattgaagagagcagtttcagtagagtgatagaaccagaagcagtactccaaagggaaggtgcgtatgtgtgcatgcatgtctctgtgttttgccagtgctggcagtggaagtgatggtgtaggcagagaatgggtggtgaagaaggagaggtatagtaaatgtcatgtactacatcaaagattcctgtctcacaggcagagcaggtggtgacctgacaggagaacaggtttcaggaaaggtgtttcaaggagagggaaggttccattttattttatttatttattttttttgaaacagagtcttgctctgttgctcgggctagagtgcagtggtgtgatcttggctcactgcaacccccgcctcccaagttcaagcaatggtcctgtctcagcctccggagtagctgggattataggcacccaccaccacatccggctaatgtttgtatttttagtagagttggggtttcgccacattggccaggctggccttgaactccccacctcaagtgatccacctgcctcggcctcccaaagtgctgggattacagacgtgagccactgcacccgacctgttttattttatttttgaggtaagtcttgctctgttgcccaggctggagtgcagtggcgcaatctcagctcactgcaacctccatctcctgggttcaggcaattctcctgcctcagcctcccgagtagttgagattacaagcatgcgccactatacctggctaattttttttttccatatttttagttgagccacaggttgggagaagggaaaatacattctactcaaagtgagtccgtggcaaaagtgtgagtacagagatgggtgaggaattaggaccagactttcagtctgcagcaacattaaacatgtatgttaatttaatactcagaaagaagcatttactctgttttaaaatatctatcacatactatatatatatatatatatatatatatatatatatatatatatattttttttttttttttttttttttttttttgagacagtcttgctctgtcacccaggctggagtgcagtagcgtgatctcgactcactgcaagctccacctcccgggttcacgccattctcctgcctcagcctcccgagtagctgggactctaggcgcccgccaccatgcctggctaattttttgtatttttagtagagacggggtttcaccgtgttagccaggattgtctcgatctcttgacctcgtaatctgccctcctcggcctcccaaagtgctgggattacaggcgtgagccaccgtgcccagcctatcatatataatatttttaaaactcaacgtctgtgctcgctttagcagcacataatagtaaaattggaatgatacagatgatttgcatgtatttttttaaaagttctcaagtctatttaataaccacagaatatgagacattctgagatgttttagaaacagttcaacatatgtgggaaaataggagtataaacccttacctcctgtgtagatcaggtaggttcaagattgcatctgttcttttgtaatactaaatgtctggtgaagatttgaggattttatataaatcattgagtttgagaggtttttttgtttttgtttttgagatggagtttcactcttgttgcccaggctgaagtgcaatggcacaatctcggctcactgcaacctccgcctcccaggttcaagcgattctcctgcctcggcctcctgagtagctgggattacagacgcctgccaccacgcccagctaattttttgtatttttgtatttttagtagagagagggtttcaccatgttggccaggctggtctcaaacttgtgacctcaggtgatctacccgcctcaccctcccaaagtgctgggattacaggcatgagccaccgcacctggccttcgttttgttttttcaacagaatgtaagaattttttcttacatttttcttacatttttaacagaatgtaagaaaaccacaacgcaatgccgatgagtactttttccctgaagtggatataagcatgaatataaaaagttttaaatcagtcatcctggctatttgttctctaaaaatcaataaataattctttcatgcattttaatactgtctcccagttaagggtattcagtttgcaaaatgctcttactgacaggaaatgtatgagcatttttgttttttacttctgtcgtttgacagaaaaaatatacacctactctttgagctaatttattcttacctagtggtcattagtagaagtggttcactctgggagcttaactagaagggaaactaacaattccttgaggtagatcattttatctaaagctttttgatttcatatcagttgggggcgggtatattatgttaatttttaaatctgcatattttccagccaggcatgactataatcccaggactttgggaggtagaagcaggaggattgcttgagcccaggaattcaagaccaccctagactacattaaaaaacatatttttttgtatttattttttattttatttttttgagacagagtttcgctctcattgcccaggctggagtgcaatggcacgatctcggctcaccacagcctccgcctcctggattcaagcaattctcctgcctcagcctcccgagtcgccgggattatagacatgcaccaccacaccgggctaattttgtatttttagtagagacagggtttctccatgttggtcaggctggtcttgaactcctgacctcaggtgatccacccacctccgactcccaaagtgctgggattacaggtgtgagccaccatgcctggcctttttttttttttttaatttaaacgaaatctgcttattttcctgttgatgtaaggtgtttgtgttaaggtgaaatgaaaagtgatttttaaaaaaatattattttaggactatttaacaaatatactatttatgataattaacatggggttagcaaactactgcttgaagccaaatatggcccatggcttgtttttgtacagcttataagctaaaaatgctttttacatttaaaaaaaaaaaaaaagaacaaggaagaatatgtgacacacaaaacctgaaatgtttactccctggccatttacagaaaaagttagctggacattgattttcatgttactattaactgctaaaacaaaggagcttgtagctatattttttcatacttgcataaagaaagaaaacctaataaatcgctggtggcttcatttccaaaaggctatggaaatccataaacaggctgggtgcagtggctcatgcctgtaatcctagcactttgggaggctgaggcgggaggattgcttgagcccaggagtttgagtctggcctgggcaacgtagtgagaccctgtttttagaaaaaatgaagataaaaaactaatccataaacctcatacttggtggttgcccttcagtttttcttctttagatctggatttagttaaacagtgtattgcctgcctggtttctgttaacttttgatcatttggttgggttatcctataatgaaacttggttgacctcagaaataacaaggtggtcgttcagcttctttgattgtgtgtttctttcataagttcttcaagaagcctgagtattagaaacatggataaaattattgtgataaaaagccagagagacataaatgtcaagtatcttgtttaaaattactgtgaccaggccgggcgtggtggctcacgcctgtaatcccagcactttgggaggctgaggcgggcggatcacgaggtcaggagatcgagaccatcctggctaacacagtgaaaccccacctctactaaaaaaaatacaaaaaattagccaggcatggtggcgggcgcctgtagtcccagctactcgggaggctgaggcaggagaatggcgtgaacccaggagacggagcttgcagtgagccgagatcatgccactgtactccagcctgggtgacagagcaagactctgtctcaaaaaaaaaaaaaaaaaaaaaaattactgtgaccagattggactcagcttgctgctggcatttggttcccaccataacctcatatgtcatgtgtttgcttatatgtacttttgtgttattgttggtgtatcttcaggataagttccaaaatgtaatattgctgggttaaaggattaatgcacatgtagttttattagatgttaccaaatttccctccagtggggattataccatttttcattcctgcctgaaatatatgagagaagcaccattttaaagttttcacaatgtctctgaactaaaatgtggtagagatgcacatgtgtatatctagatctagattgatatattgatatacatgtatttttgtagaaggggcacagaggaggcctcttgactatccctattatgtttattgcttttaacgttttttctcacgccgggtttaaaacatggtttagcattattgaacattctaaaaatgagacataatatgaaggaaatttactctgtgcatcttttgaattataatcaccatctgaggcttttgtgagctccagtttgtcctggaatttagaacattcaactagtccagctattgtttcagtggaatcttgctggcctgaacagttttccttctggttccttttcagggactaaaaatgatgaagagttttgtgatagcaggtgcagtttgagtactacagtaaacattcagtttcagaacttcttctcttacctgctaaaaccaaagagaaccttttttttatttttacttctgattgttgaacagtcttaaggcagcattaggaagactggcgatttgtgtggagaaatgatggcttgttgttgtctatgcatactttgtgtgtccagtgcttacctggaattttgtctttcccaacagcaacaatggtgtggttggtgaatatggcagaaggagacccggaagctcaaaggagagtatccaaaaattccaagtataatgcagaaagtaggtaacttttattagataatatcttgatttttcagggtcactgttataagctaacagtatagcaatgtttttatcgtctttctttggtcatagactcctttgagaatctcttgagaactatgataatgcccagtaaatacacagataagtatttaaggagttcagatactcaaaacccaacaatacagtcaaagcatcctaggttaagacacctcccattaaatacagaataccagcatggaaaggttcaggctgaggttatgattttgtttttgttttttgtttgttttttataagtcatgattttaaaaagaaaaaataaactctctccaaacatgtaaaagtaagaatctcctaaaagaaacaaaaaagaaacagacaataaaggaaaaataagtaaacaaaaaaagcaaaatataaacaacataaaaatgagaacctcttgtctaacatggccagaataactgaaatatgatttgagatgtgctgatgtgtatactgagaagatcaaatattctaggtggatatgactttttagaagaggataagaatgacttaggatgagctgggtgcagtgatgtgtgcctgtagtcccagctacatggccaaggcaagaggatcacttgagctaaggagttccggattaccctgggcaacttataccttacctcaaaaataataataataatgaataataataatgacttaggataagagagtgaaaggccctctaaggatactacagaacatattaaggagaacacaagttagaagttgttattagatggagttgagggggagctttcattcagttttctggaatggaggctaccttcccacacacactaaaaaaaaaaagaaagggttgaggaataacagcacaatataaatagtctaaaaaaagggctaacttttatgaggaatctgaaaaacaacaggcacagtaaatattggtgaggaaaaaaaggccttaattgagttgctgtttgtcaggaaagggagagtttatgttttataaagccaggaaatctacagagttagcatttaggcaactgcaaggaagatactttcaaccaggaattcctatttggaactcagagatgtgagtctttattatacagtaagcaaggcagcagaacaaggtcatgttagactctcacgggatccttagggtgtgactttgctagccagaaacctctgtggctggtggcaccttttcctgagatttgctcaggcccactgggctcattccacctactcagcctagctggctatgcttggctttctctaccagctggaccccatgcctgccaaaggcaagccaggcatggagcagcgaggagtgcatgagcaagtgagtgcagggtccagccactgcacacagccaggcatgctggctgcagcagggcaggcagcctcaggtactagctccctgctgcagctagaccaggcattacctaagcagctttgactacaggccactaccactagtaaacctgatagaaaagtaagaaatatactggaaagaattgccacaagcctggctcttgtgttaaccttgtgttaacctggggaacacaggggcacccagaagcttggagatgccaggaactgcagaaccccaaagaggggggtcatagccctggcttagggaactcctgagtctggactccccgaagggccacatctcttcactcctctcttctctccttctcgccacctgcaacgtggcaagtggggggcacgtttcagccctgtttgtcttacggttctttcaatcctgccattcaatgggtcccaagttcttgtcctgcatccaggaagaatgaagtacgtggacagctggagggagagcaagatgaaaaggtgctttattgagcaacagtacagctctcaggagaccctatctgcaggcaggtcgtcccattgtctctgcagctctcagtggagaggagacctggagtgggtagctcctgtctgcaggcaggtcatcctgatgtctgtaatcctcagtggagaggagacccggaatgggtatctcctatccacaagcaggtcatcccatcatctctgcagccctcagtggagaggagacccggagtgggtagcttctttctgcaggcaggttgtcccttcatctgcccaagtctgactgagtctggggtttttatgggcttcagaggggaggaagtacatgctgatgggtccatgggtggccatgagcaggcccagaaaatgcaccataagttctcactgtggtctgtggaactgggagcttggcctccaggcttcaggctttccctgacttgaggtggtgcttcaccagggaacttcccctttccgcctaggagcctgtctgcctcctgctgccatcaacctgctgtctatagctcccatggcacccaggctgttcatgccaaagggtgcctgcaggcccacggtaagctgccttcagcccctcctcagtctccctcccatgcttgtcagcacccaaagtccagagggggccaaggtggcagggggctggcatgtcagtgctgccccaagcgcccgcacacccggccaggtcatgacagcacccagcctcagccacaactttgctctgaaatcggagcctgcagacgcaaggggcttcctggacccctgagagcacagggatgcccaggtctacagccacagctgggaagctgcagctgtgggagtgcgggacttctgccccaccaactcagaagggggcaggactcccgcctgttcctggctcctgccagctcacagagcatgctgccccagctgcacctcccctgctgcagctgccatctttgcagcagccactccagatgggccgctgctgccatcaagaccactagtaaacctgatagaaaagtaagaaatatactggaaagaattgccacaagcctggctcttgtgttaacctgtgttaagctaaagaaaatcaaatgattgtctgtgagcatgtaggtatatatgtatgtgagtgagtgatacaacagaatttcattcattttacagatgttgactgagcacctgactatgtgctaggccctggggatatagcactgaacaagatttcccctgcccttgtggagcttatagtctatttggagagatagatggtcaacaaattattacataaataattcatacagttgtgataggtactacaaagaagacgtataagttgctatgaaagtttataataggggaattttacgtatcctggaaagtcaaggggtgcttccctgaggaagtggtaataggggacggcccgctgaaggatggaggaagagctttccaagagagggacaacatgagcaagggctttgaaatgagaaggctggatgaactgcaggcttcctcagtgagaatgctgctggtattttggggggcacagttctttgtgggactttccctcatattgcaagatatttaacatccctggcccctcacccactaaatgccaataatggctttaaggctttgcaataatcaaaaactcctccatcctagttatttccaaacactccccggaagggaggtgctatccctagttgaaaaatcactgtgttaacggaactagaagttacattggaacaaaagggcatagggctccaagagggatatctgtgtaaggaaaaaacaaacaaaagaactgagagattacctgatgtggttgagctctgtcagagcatttcaggataaattagtcatagataataatataaaattcatcagtggaaaaaaatgaggcagttttccaaagaaaacaaaaacttgctcaaaaaagcaaatgtaattatagtatattctggctatagcaaagtagtttagttgtgaatattatttgcatagtgagaatataaagctgaatttaatataaggttatggcactgggaagacaggaagagttacatttgcgtgcactaaaggatgagacctaatgctttatcttctctataggaggtgaataagtacctcaaattaaaacatcaagttatggcacaatgagcatgctacttataattaattatggaggtaaataccaaaagggatggctaaaagagtttaaggtaggaatgagtatcagaagtgaggagggagggggtagaaaagggactgctgttttcatttataaatcttattcttatattatttcataaactccaaaccagagaagattcaggtttttggagatctggataataaaaagaatacaaaactatcaatacaaaattgtgagggctctcccagaggaagccatgcaaggaagggccctgaagcttacaagctttacttattcatggcaaatctacttctgctctgaacatgtattacttttataaaaaatgaaggaagaataaaagtactttgaacttcacttatatattttaattatttttaatgtatggaagttttttaagactatcatgctcaccattttcaatgagattgatagtcattataatgaaatgactggcccataaagacattcactccccgctcctttcccaatccaccctccagaatgaagccacttttataattttgtcaccaaatccagggatgagtgccaacagttaggaagctttcagttgcaaaagataaaaagcccaactcagttgccttaaacaaagaagaaatttattctttcacgtgacaggaaggcctgaggtgtaggcatttgaaatttgtagggttggttaatttggtggctcagggatgttttcaagtagcccaacttcctactctaccatcactagtttataggcttggtcttcagcccactgctcttcgtggtcatgacagctgtagttctaggcatcatgtctagataaggcaacattcaggggtagaaggggactgtttattttttcctttagtctctcttaaagagtgagaaaaattttcccaggaatcccggtggactttgcttcaccactcataggttcataccaagttacaaccccacaaccttagagcttttgttaggaagaggcttggtgggattaccgtgcttggcttggcttggtcaggattcaccaccagagtcatgtgggagggggtgggaacccaaacaattcaggattctgccctcaggaaataaaggagaaaatagctgttggataaactaccagcaggcactgctacagcccatgctttgtggtttaagggccagctagttacaatgacagctagttactgtttccatgtaattttcttaaaggtattaaatttttctaaatattagagctgtaacttccactttctcttgaaggcacagaaagggagtcacaagacactgttgcagagaatgatgatggcgggttcagtgaggaatgggaagcccagagggacagtcatctagggcctcatcgctctacacctgagtcacgagctgctgtccaggaactttccagcagtatcctcgctggtgaagacccagaggaaagtatgtgcatttctctatgttgcaaagtcatggattcctttaggtagctacattatcaacctttttgagaataaaatgaattgagagtgttacagtctaattctatatcacatgtaacttttatttggatatatcagtaatagtgctttttttttttttttttttttttttttttttttttttttttgagacagagtctcgctctgtcgccaggttggagtgcaatggtgcgatcttggctcactgcaagctccacctcccgggttcaagtgattctcctgcctcagcctcccaagtagctgggactacaggcgtgcgccaccacgcctggataatttttgtatttttagtagagatggggtttcaccatcttgggcaggctggtcttgaactcctgacatcatgatctgcctgccttagcctcccaaagtgctgggattacaggcgtgagccactgtacctggcctcccttcagactttttaagttggcattttacagcctgaccttttggcatttattttataaagtaaaagatttgtttttttaattgttccagtaagccttcatggccgtaatacatttgtctacaaaaattttattaatatgtctcactctgctgtagagagatctgtggatttgcatgatacaaccttgtacattattattccttttgttgacaagtgctatattttattttaaagaaaatcaaagggatttaggatattggcagaaatgcaagtatttcttcagtgtctaagatgtgttgccacttgatggatttaagttaacacttagggcttcttaggaacattatcagccactaaagccctttggttagggctcagtcatctcttcagttagtcttagagatgtggttcattgaataagactttagcatattttccaaccaagttatttttggttgtcttgtttttgcaagagtgaaacttgattaaaacattacaacaagaatattaagtagttttaaggaaacaaacacctaggttccttagcatctttaatcattagtcactaattattatgaccttgacatatccatcagtttgaggagaacactttttacaccttgtcctcagttttttaactgagtcagaactttcactgggcatgttcatgactttactgcttggctgagttttccagatatcaaagcccagctgcagcctgtgactttcacactcctggaaaagtagacgtatctgcctgctcttacagcaggctttagcttgcctttgctgggactttgttctgccctcagttaccacagtaattaggttgcctcttctactttcctcttttctcacaggcaccaggagccagaggaaataacataatagttgttgaccagagcagcagcataattctttcatgactgccttttctaatttgacgattccctctcctgagagggctctttgtgtcctcctcctcttcgtctccaacttttaaaaaaaaaaaagtgaaactatcaagtattgctcctgctaacttcagatcagtattttctttctctgaagccaatgcaaagtaataacggacgtgcttcatcatcttagcattcagcacacgtgtcaccatctctgatggtgtgagcatgttaaaccagacttgtgggtacttaccaaaaggttcagttgacactataggtcagttgctaaaaggcacaaatgtcttctaaagcaatctgttaaaagtcaacatttaacatttaattagaaaactgatcaaaggatctgaatgtttagttctcccaagaaaatgtaaaaatgatctgtaaacacataaaaagatactcagcatcattagccatcaaggaaatgcaaatcaaaaccacttcatactcactagattggctataataaaaaagatagacaataacaggtgttggtgaggatgcgaagaaactggaatcctcatacactgctggtgggaatgtaaaatagtatagtgattttggaaaacagttcggtagttctttgaaagattaaatatgacccggtaattctactcctaggtatatactcaagagaattttaaaacatatgtcaacacaaagacacatatacaatggtcatagtaatattgttcataacaggtaaaaacagaaacaacccacatgtctattaactgataagtggataataaatgtggtatattcatacaatggaatattacttggttataaaaagaaacaatctatcattagtacacttaggatgagcttgttactggcatgttggctgtgggaagtatatcttgaaattcactaaaagaccaactattgctgggcgcagtggctcaagcacctgtaatcccagcactttggaaggccaaggcaggcggaccacctgagatcaggagttcgagaccagcccaaccaacatggagaaaccccacctctactaaaaatacaaaattagcccattgtggtggcacatgcctgtagtcccagctactcaggaggctgaggcaggagaatcacttgaacctgggaggtggaggttgcagtgagctgagatcataccattgcactccagcctgggcaacaagagcgaaactccatctcaaaaaaaaaaaaaaaaagaccaactaccttcacaataaataaaaatgtcttacatttctaattaaaatttttgttcagttttattattcagctttaaaaaggaagggaattctgacatgttacaacatgaataaatcttgagtactttgtgctaagtgaaataagctagttacaaaaagaaaaatactgtatgattccacttacatcagagtagtcagaaagtagactggtggttgccaggggttaaggggaggggaaatgaagggtcgtttaatgggtgtagagtttcagttttacaagatgaaaagagttctgtggatggacgatggtaatggtagcacaatgatacgattatacctagtgtctttgaacggtgaacttaaaaagggttaagatgttaaacttgatgggtatcttaccacagttaaatttttattatttttttattttttgagacaatttcgctcgttgcctagggtggagtgcagtgctgggatctcagctcactgcaactctgcctcccaggttcaagcgatactcctgcctcagcctcccgagtagctgggactacaggcacacatcaccatacccggctaatttttatatttttagtagagacaaggtttcaccatgttggccaggctggtcttgaactcctgacctcaagtgatctgcccacctcagcctcccagagtgctgggattacaggtgtgagccactgtgcccggccaaaaaaattttttttaaataccgttaagaagtggaaaataaggccaggtgtggtggctcacacctgtaatcccagcactttgggagaccaaggttggtggatcacctgaggtttggagtttgagaccagcctggccaacatggtaaaacctcatatctactaaaaatacaaaattagccgggcgtggtggcgcatgtctgtaatcccagctattcgagaggctgcggcaggataattgcttgaaatcgggaggtggaggtttcagtgagccgagatcacttaaaaaaaaaaaggaaaataagctaccagctgagagaaaatatatgcaaatcatattgaagtcctgttaaaggacttgtatttaggatatataaaggatgcttacaacttaatacgaagacgatagcccaaatttaagatagggaaatgctttgactagacattctaccaaaagagatatataatggctaaaaagcacatgaaaagatgctcaacatcattaatcagagtggctagaatgaaaaaggctaacaataccaagagctggtgaggatgtgaaaaaactggaactctcaattgttgctggtggaaattcagactggtacagccagtgtggaatgtgatttggcagtttattaaaaagctaaaaacctaaacttacatagcccagcaattgcacccccaggagtctacccaatggaaatgaaaacagtccgtccccacagagacatggacataaatgttcatagcagcattattcagaatagccccaaattgaaaacaatccagatgtccatcaactggtaaatggataagcaaaccatataatggaaaaccattcagcttccaataacttccaagaaactgtagacacatgcagtatcatggttaaacctcaaaaacattatattaagtaaaataggcgaggcatgtattgtatgagtcatatgaaatgtctagaaaaggcaaatttattgagatagaaagcagatcactggttgcttaaggcctagggtaggagtggggattaactgtaaacgggtacaaggtacctgactggggcaatggacatgtggattgtgatgatagttaaattgtacagctctctctatatatagttgtacagctctattaattttccacaatcattgaatcatgtcttccagttttatgaggtaaatcatagtccaatgaagcttttttaaaaataagatgataggccatgtgtggtggctcacgtctgtaatcccagcactttgggaggccaaggtgggtggatcatgaggtcaggagttcgagaccagcctgaccaacatggtgaaaccctgtctccatcaaaaataaaaaaattagccaggcatggtggcatgcgcctgtaatcccacctactcaggaggctgagacaggaaagtcgcttgaacctgggcggcagagtctgcagtgagccgagatcatgctgctgtactccagcctgggccacagagcaaaactccatctcaaaaaaaaaaaaaatattaattaatatgataaaatgatgcctatctcagaattcttgtaaggatttcttagtacaagtgctgggtataaactatatattcaatagatgacgattattacttattattgttattgataaataacagcagcatctacagttaagactccagagtcagtcacatagaatctggaactcctattgtagaaaaccaaaaaagaaagaaaacacagctgaagcctaattttgtatatcatttactgacttctctcattcattgtggggttgagtagggcagtgatatttttgaattgtgaaatcatagcaaagagtgaccaactttttaatatttgtaacctttcctttttagggggagtaaaacttggattgggagatttcattttctacagtgttctggttggtaaagcctcagcaacagccagtggagactggaacacaaccatagcctgtttcgtagccatattaattgtaagtatacactaataagaatgtgtcagagctcttaatgtcaaaactttgattacacagtccctttaaggcagttctgttttaaccccaggtgggttaaatattccagctatctgaggagctttttgataattggacctcaccttagtagttctctaccctggccacacattagaatcacttgggagcttttaaaactgtaagctctgccctgagatattcttactcaatttaattgtgtagtttttaaaattccccaggaaattctggtatttctgtttaggaaccgctgcctcaagcctagcagcacagatatgtaggaaattagctctgtaaggttggtcttacagggataaacagatccttccttagtccctggacttaatcactgagagtttggtggtggttttgcatttaatgacacaacctgtagcatgcagtgttacttaagacagcaagcatctagtgagaggagctggtgccatgcatgaccccacatagatcttgctgatagtgctacagcatgaaccctgaagctttcaaaactatgattttttttttttttttttttgagacggagtctctgtcacccaggctggagtggtgcaatctcggctcattgcaacctctgcctcccagatttaagtgattctctgcctcagcctcccgagtagctgggattacaggtgcctgccaccacgcccggctaatttttgtatttttagtagaaacagggtttcaccatgttggccaggctcctcttgaactcctgacctcaagtgatgtgcctgcctcggcctcccaaagtgctgggattacaggcgtgagccaccgcacctggcttttttttttttttttttttttggagacagagtcttgctctgtcgcccaaactagagtgcagtgacattagctcactgcaacttctgcctcctaggttcaagcgatcctcctgtctcagcctcccaagtagctggaattacatgtgtgcaccaccatgcctggctaatttttgtatttttagtggagatgaggttttgccacattgcccaggctggtctcaaacttctgacctcaactgatctgcctgcctcagccgcataaagtgctgggattacaggcatgagccactgtgcccaacctgaaaactatgatttaagtaaacaacccataaaatatttcttgctatttttactaaagatgtgttatcttggccgggtgaagactttctagtgtttccgtaactagggtaaaaaatgaactctattatatggcttgtacatgtgtttacaagaaagcagtgtactcctcataaataaacttttagtttattttattttttaaacactgcagcctcatcatgcttcacggaggagcctgtgcgggaagaatgctcccacacagcataaagaatgctcccgcacagcatagagaatgcccccgcacagcatagagaagcccccgcacagcatagagaatgcccccgcacagcatagagaagcccccgcacagcatagagaatgctcttcacctctgggtttttaaccagccaaactaaaatcacagaggccaacacatcatttaagatagaaatttctgtatcttttaatttttttcaaagtagttttacttattttcagattctatttctttactagaattaagggataaaataacaatgtgtgcataatgaaccctatgaaacaaacaaaagctaggtttttttcatagctcttcttccagattgaatgaacgtctgttctaaaatttaaccccaaaaggaaaatattcagttaactatgttaaaaaccaagacttgtgattgagttttgcctgaaaatgctttcataattatgtgtgaatgtgtgtctttcccatcttctccacagggtttgtgccttacattattactccttgccattttcaagaaagcattgccagctcttccaatctccatcacctttgggcttgttttctactttgccacagattatcttgtacagccttttatggaccaattagcattccatcaattttatatctagcatatttgcggttagaatcccatggatgtttcttctttgactataacaaaatctggggaggacaaaggtgattttcctgtgtccacatctaacaaagtcaagattcccggctggacttttgcagcttccttccaagtcttcctgaccaccttgcactattggactttggaaggaggtgcctatagaaaacgattttgaacatacttcatcgcagtggactgtgtccctcggtgcagaaactaccagatttgagggacgaggtcaaggagatatgataggcccggaagttgctgtgccccatcagcagcttgacgcgtggtcacaggacgatttcactgacactgcgaactctcaggactaccgttaccaagaggttaggtgaagtggtttaaaccaaacggaactcttcatcttaaactacacgttgaaaatcaacccaataattctgtattaactgaattctgaacttttcaggaggtactgtgaggaagagcaggcaccagcagcagaatggggaatggagaggtgggcaggggttccagcttccctttgattttttgctgcagactcatcctttttaaatgagacttgttttcccctctctttgagtcaagtcaaatatgtagattgcctttggcaattcttcttctcaagcactgacactcattaccgtctgtgattgccatttcttcccaaggccagtctgaacctgaggttgctttatcctaaaagttttaacctcaggttccaaattcagtaaattttggaaacagtacagctatttctcatcaattctctatcatgttgaagtcaaatttggattttccaccaaattctgaatttgtagacatacttgtacgctcacttgccccagatgcctcctctgtcctcattcttctctcccacacaagcagtctttttctacagccagtaaggcagctctgtcgtggtagcagatggtcccattattctagggtcttactctttgtatgatgaaaagaatgtgttatgaatcggtgctgtcagccctgctgtcagaccttcttccacagcaaatgagatgtatgcccaaagacggtagaattaaagaagagtaaaatggctgttgaagcactttctgtcctggtattttgtttttgcttttgccacacagtagctcagaatttgaacaaatagccaaaagctggtggttgatgaattatgaactagttgtatcaacacaaagcaagagttggggaaagccatatttaacttggtgagctgtgggagaacctggtggcagaaggagaaccaactgccaaggggaaagagaaggggcctccagcagcgaaggggatacagtgagctaatgatgtcaaggaggagtttcaggttattctcgtcagctccacaaatgggtgctttgtggtctctgcccgcgttacctttcctctcaatgtacctttgtgtgaactgggcagtggaggtgcctgctgcagttaccatggagttcaggctctgggcagctcagtcaggcaaaacacacaaacagccatcagcctgtgtgggctcagggcacctctggacaaaggcttgtggggcataaccttctttaccacagagagcccttagctatgctgatcagaccgtaagcgtttatgagaaacttagtttcctcctgtggctgaggaggggccagctttttcttcttttgcctgctgttttctctcccaatctatgatatgatatgacctggtttggggctgtctttggtgtttagaatatttgttttctgtcccaggatatttcttataagaacctaacttcaagagtagtgtgcgagtactgatctgaatttaaattaaaattggcttatattaggcagtcacagacaggaaaaataagagctatgcaaagaaagggggatttaaagtagtaggttctatcatctcaattcatttttttccatgaaatcccttcttccaagattcattccctctctcagacatgtgctagcatgggtattatcattgagaaagcacagctacagcaaagccacctgaatagcaatttgtgattggaagcattcttgagggatccctaatctagagtaatttatttgtgtaaggatcccaaatgtgttgcacctttcatgatacatttcttctctgaagagggtacgtggggtgtgtgtatttaaatccatcctatgtattactgattgtcctgtgtagaaagatggcaattattctgtctctttctccaagtttgagccacatctcagccacattgttagacagtgtacagagaacctatctttcctttttttttttttaaaggacaggattttgctgtgttgcccaggctagacttgaactcctgggctcaagtaatccacctcagcctgagtagctgagactacagcccatcttatttctttaaatcattcatctcaggcagagaacttttccctcaaacattctttttagaattagttcagtcattcctaaaacatccaaatgctagtcttccaccatgaaaaatagattgtcactggaaagaacagtagcaatttccataaggatgtgccttcactcacacgggacaggcggtggttatagagtcgggcaaaaccagcagtagagtatgaccagccaagccaatctgcttaataaaaagatggaagacagtaaggaaggaaagtagccactaagagtctgagtctgactgggctacagaataaagggtatttatggacagaatgtcattacatgcctatgggaataccaatcatatttggaagatttgcagattttttttcagagaggaaagactcaccttcctgtttttggttctcagtaggttcgtgtgtgttcctagaatcacagctctgactccaaatgactcaatttctcaattagaaaaagtagaagctttctaagcaacttggaagaaaacagtcataagtaagcaatttgttgattttactacagaagcaacaactgaagaggcagtgtttttactttcagactccgggattcccattctgtagtctctctgcttttaaaaaccctccttttgcaatagatgcccaaacagatgatgtttattacttgttatttacgtggcctcagacagtgtatgtattctcgatataacttgtagagtgtgaaatataagtttaactaccaaataaggtctcccagggttagatgactgcgggaagcctttgatcccaacccccaaggctttgtatatttgatcatttgtgatctaaccctggaagaaaaagagctcagaaaccactatgaaaaaatttgttcagtgttttctgtgttcccgtaggttctggagtctgaggatgcaaagatgaataagataaattctcagaatgtagttataatctcttgttttctggtatatgccatctttctttaacttctctaaaatattgggtatttgtcaaataaccacttttaacagttaccattactgagggcttatacattggtgttataaaagtgacttgattcagaaatcaatccattcagtaaagtactccttctctaaatttgctgttatgtctataaggaacagtttgacctgcccttctcctcacctcctcacctgccttccaacattgaatttggaaggagacgtgaaaattggacatttggttttgcccttgggctggaaactatcatataatcataagtttgagcctagaagtgatccttgtgatcttctcacctctttaaattcccacaacacaagagattaaaaacagaggtttcagctcttcatagtgcgttgtgaaatggctggccagagtgtaccaacaaagctgtcatcgggctcacagctcagagacatctgcatgtgatcatctgcatagtcctctcctctaacgggaaacacctcagatttgcatataaaaaagcaccctggtgctgaaatgaacccctttcttgaacatcaaagctgtctcccacagccttgggcagcagggtgcctcttagtggatgtgctgggtccaccctgagccctgacatgtggtggcagcattgccagttggtctgtgtgtctgtgtagcagggacgatttcccagaaagcaattttccttttgaaatacgtaattgttgagactaggcagtttcaaagtcagctgcatatagtagcaagtacaggactgtcttgtttttggtgtccttggaggtgctggggtgagggtttcagtgggatcatttactctcacatgttgtctgccttctgcttctgtggacactgctttgtacttaattcagacagactgtgaatacaccttttttataaatacctttcaaattcttggtaagatataattttgatagctgattgcagattttctgtatttgtcagattaataaagactgcatgaatcca

SEQ ID NO: 689 - DNA, 87257 bp, Homo sapiens; identical to SEQ ID NO: 688

SEQ ID NO: 690 - DNA, 28334 bp, Homo sapiens
ttcactttcttattatgacccagttaagagattggctgttacatataatagtcaaaatttgttatgattatgattttatatactcagtccttgctttgttttacttgaatctttgccaaattccatgctcaccattacttcttgcatcccagttctttcactttgtaattttcttcttccataagtacatcctttagtagttctttcagtgaggatctagtcaatttcccagactttatttctctgaaggtctattttgcctttactcttgaacaaaaaaaaaaaaaagatcatagctagacatatagtgaaacttcagaacaccaaagacaagtctagaaacttaacaactttaatacatacacatgtggtatatgacagaagcagcattagaaattagtagtcttagccaagtgtggtggctcacacctgtaatttcggcactttgggaggccaaggcaggcagattacttgaggccaggagttcaagaccagcctggccaatatagggaaatcttgtctctactaaaaattacaaaaattagttgagtgtggtggtgcatgcctagaatcccagctacttgagaggctgaggcaggagaattgctagaacccaggaggcggagtttgcagttagcccagattgcgccactgaacaccagcctggatgacaaagcgagactctgtctcaaaaaaaaaaaaagaaattagtagtcttggataaatgggctattcagatagataaaagacctaaatgtaaaaaaaaaaaaaaaaaaccaatattgtaaaagttcggaagaaagaaaataatatctttatgacattggagtggggaagtacttattacataagattttaaaacataaaccacaaaaagaaaaggaacttgagtatcttaaaatttaaagcatacctctgcacaataaatgaaatcatatagcaaaaaagcaagatacaaactagtatatttgcatattacatagcacatacaattattagtatataaacaattccaacaaattaatgagaaaatgtaataacctaattttttaaatgagcaaataatatgagtaggcaatttatgggagaaacttgaataaccaataaacgtgaaaaattggttaatctcattagctgtcagataaaactaaaacaacattaagttgacactttacactcattggcttggcaaagaaaacatttcaatctgacaacacagaatattggtaagaatgtgggagaagaagagctcttaaaaatcattagtaaagagtaaatttctataatcactttgacaaacaatttagcatcacttaataaagatgataacacacataacatacaatctaggttgttccacttctagttacagatcctggagaatgtctccagtatgtgtaaaatggaaatagacacaggcattcattgtaccacttttgtaagtatataaaaggactaacaacctaacttgatgagtgactagataaataaagtgtggcttaccatagaatagaataccatgtagcagttagaataagggtactggatacaagtcaacatggaaaaatctttagaaaatgatctgtgttaaaagcaagttgcagaatgccactgctcagattccctaggaaacagaccctgtgaccatgagaagcatacagaaagtttattagggagtgtcttcaggattaacacctgcgaggagctgggcacagtggctcatgactgtaatcccagcaccttaggaggctgaggtgggtgaatagcttgagcccaggagtttgaaacaagcctggcaatactgtgcaactacatctctacaaaaaatttaaaactagccattgcatggtgccaaacgcttgtggtcccagctacttgggaagttgaggtgggaggattgcttgagcctgagaggtggaggttgcagtaagttgagattgcaccagtacactccagcctaggtgacagagaaagaccttgtctcaacaacaacaacaaaacaaaacaacaagaacaatgacaaaacaaaaccctgcaaggagtgaggaaagcgagactggcagagggagaagttaaaccacagtgtagttgcagcagaggcttcagtcaagcctgtggggagctctggagctgggatctccctttagagtagccctgagttgaggcaagaaggccagatcttcctattgaagaaggaataggaattgtttatttactaataactgtatgtgctatgcaaatatactggtttgtatcttgctttttcactatataatttcatttattgtgcagaggtattttttaaattttaagatattcaagttcattttcgttttgtgatttatattttaaaatcttatttaataaatacttccctactccaatgtcataaatgccctatcccctctcccagtcaatggtcagtggatgcttgtagggagggtgtgtgactttgggcaaggcttatggccaaagggaattcttggtgagagattcaactggaagctattctaagcttacatctccaaatgagggagcaagtgccttgtcctgaagatctggtgggccatgccacagtgtctaccacccagaatgatctgattagtattaatataatatttgtgtcattttacaaacacacaaaaagcaatacgctagttatgtatatataaatacattaaaaattgcaaacacttgtatgggaattatacatcaatttcaccatcatgggtactaatgagggaaaatggaggtagagacggaggtagggatgaggtatctgaggcttcagccattcctttaatatttattccaagaaagatgggaggagaagagagagttaaaacaaacatgacaaaatgtaaaaatcagttcaatattatgatacggtgaagataggaatatgtgattatttttgtacttttctatgtctgaatacttcattatttaaccctaaaagaaaatattagagaatatgtctcagagaaataagaacttgagagtcattctgttaggccttaagtggtcattgggagagcagagattgacattctgtgaatagggctcagggtcttaactgtaaaataaattagattattttaagactacctccaatttggaagaaagactttcaattttatgaatgttttgataaaatcacagctgttggtcaatgaaagctttaattctgtgaagagtgaaatagtcctccaattggatcagctctttagtttttacaatcaagtgtcaactttgttcttagctgtacctaaggcatatagaccactttcagcaagcattcactagattgaccagctattataaactaggcactgttctaggcactcgagataagacagaaaacaaaacagatttttaaaaagttctactttccctgttaaaagaatgaaaagacaagtcacagagtggaagacaatatttacaaaacacatctgataaaggacttatatcaaaaatatgaagagaactcttaaaacagcattaagaaagcaaacgatgcaacttaaaaatgggcaaaagatcaaaacagaaacttcactaaaggtggtgaggatgtggagcagcaggaactcttattcattgctggtagaagtgcaaaatggtacagccactttggaaaacagtctagcagtttcttacaagctaagcgtagtcttaccatacaatccagcaattacacgctttggtgtctatccaaatgagttgaaaatgtgtgtccacaaaaaaccctgcacacaaatgtttatagcagctttattcatcattaccaaaacttagaggcaaccaagatggcttcagtaggtgaatgaataactaaattgtgatatatccagacaatacaatatgatatggtaatgaaaagaaattagctgtcaagccacaaaaagatgtggaggaaatttaaaggcatattgctaagtgaaagaagcctgtctgaaaagacaacgtgctgtatgattccaactgtaagacattctagaaaaggcaaaactatagagacagtgaaaagatcagaagttgccagtggttcagggatggagggaagagggatgaataggtggagcacaggggattttttaggatcacctatgtgatcctgtaatatggatacatgacattatacatttgccaaaacccataagactgtacgaaacaaagagtaaacttacgttaataataatgcataaagatcagttcatcagttgtagcaaatgtaccacactaatgcaagatattaataacaagggaaatttaggggggttagggtgagatgggaaagggcattaaggaaactctatgtactttctactcaatttttctctaaaattaaaactgatctaaaaaataaagtctactaattaaaaaaaaagaatccttgtctttgtggagcatacacaatggttgggggaaataagtaatgtgtttatagaagatggaaatactaatacattccatggaggaaggaaaaaagcagagaaagccaatagagagtgaggagttgccattttaattggatgacatggaaggcttccatgagaaaggacatttaagaatcaataaaaaactcaaaatgcttccactggatgggcacgccagacctcattttcaatgaagcatctgtcagaggctcaggaaaacactagtgaaagggtagattagatgacaacacttaacccttgatcagtgttaacagtactaaaaatgggaccacgagacctcatgtgccgcctgatggaatgcaatcggaaacacgcgatagtacctatggagtatttgccaaaataaatgcatctgaatctaagcaagcttcacactcaggcagcaagctcatgaaaaatacaaaggaacaagttattagattaatgggttgaatgagaatgcgatcagcaaaatctggcatgccggaagttctacaggacaaatgaaccaatgtcttcaacaaacaaaaaaacggctaaaaatggggaagtgggaactttcatagattagaaaatacctaagagacatttcaaccaaatgcaatttgtggactttactctgtgatttcaacaggactgtaaaatatatttgagaaaattggggacatttgaacacggactgcgtaataggtgaaataatagaattaatgttaattttgtcaggtatgataatggaatggtgggtttgtggtttttaaaaatgctcatctgttcgatttatatactactgacttaattatggataaaacaatatgacatcaaaaaaggtgaataatagataaagcaagatggacaactggggctggacctgtgcttggtgggtccttggtgtacctggtgggtcctgagcaccaccccggtggttctaggtgtgccctgtcaaattcctgaaaactcctcttataaatgtgcaaatatttataatcagttttttttttttaataaaaagagtctaacattctatggcgacattatgtgtaaaaaaattcctttggatcagttatgtgaaatattttttaaaaaccaagaaaaatgttaaaaattgttgaatttgaatattgtgtcaatggggttcattatactgtctttctacttttggatgtttgagaatttccttaatagaacaattttgaaagtctaggaatactaagagatattagaaaattaaaagcaacagtctaagactgattttcaaggtgttttgttttgggttaaagacaatttcttttaaaaggcaattatggacaagtcaaatatgcacaacagatacatttggaactacctgactgtgatggagtcactcttctctcctctgcccccagagatacagcacatacagtttgaagttagttcaattaaggtaacaattttcattgtctactaagtcaacgactctcggtcttttggaatatgctggatgctttctagtgtttactagaatacttgagtagtaaatactttctagtatttactagaacttggagtagcacaattcaaaggattcagtgaattaagaatataccaatcaacaataattgcactacagctgactaacaatatctcctggtatccataaaagacattgccaatgaatacactatttggtttccctatcacagtgtcacagtgtcaaacagtttgtactcaaacaacttgagtacaattctttactgttctgactgcctgtctcttatgtttatggcaaagtcccagtgtgttccagtcatttcttactttccctgttacttgacattacctctttctcagtgactctcttcaacacagcgtcacataacatgatcattccagtcatctacactgaacaaaaagttcaaaatgggagcaaacataacctttacacattgataaaaatatggtatcattaatagtccattaattggatgttatgctaataggtttgatcatctgaaagctatatacctggatttatctccccagatacaccttatttatcatcctaaatacaccatgaagacctaaaagaaatatgaggtaatatgctctaaatataatttttgatataagatatgacagaataaaaattgtttgcatcttttttgaaaatcactatggaagatgttgtccactgaatgactcctgtaaacctatttaagtatcatagtagagtttacacataggaaaatgattgcttccttttgtttataaatgatctgtttctctatgttaccttgactttcacatacgtgagagctaaactgaagctaccataattaatttaggttctcttacacaacgaaccctgctcatttccatcccatccagctttatttaatgattctattgatgtatctgttgtggacatattttattttgtccccccagcccaaacactccctcttctgatagcagcagcaccttcttttagataaacccttctccccacctgtcccaactccaaccttgtcgttttagtaatgcagtcaacctctgccttctgccactctcagaccattgccatggtctttgctgaaggccagagtctttgaccagcattatttcaaattgaaatcaaggaactaatgaaggaggcatcttcttgaccagtgataagccagatgaccacaacctccaaggtgtgaaagaatgtgacacagaaagacagaccagagtctgagacagctactttcagcacctggtactatttcctcccaaaccagatacatccctgcccattcaagggttaggttacctgagccaataagtgttcctcatgactccagtgagtttctgattgggtttctgtcacttgcaatcaatattaccctgcctaatacagagtacttcattgtgagctgtctcaagtcttttgcagaagcctgcagaggagacagaataaagtaaggccatttatttaataatttatttacttctttatttcatataactggtttatttccaaagtttatttgcaatatgttgaatgaatagatagatattggctccattagaaggccatcttgagcctgggcaacatagggagaccctctctctacaaaaaaatttaaagaaaaaattagctgggtgtggtggcacatgcctatagtcctagctactcaggagggtgaggtggaaagattgcttgagcctgggaggttgaggctgcagtgagccgtgttcatgtcactgcattctagcccaggcaaaaaaaaaaaaaaaaaaaaaagccatcttggccatcttcaggaagtaatatccaagaacttcaattacattattttttaaggtaattgtgcttcaaccttcaacacactcaactcctctaggctccccggattctctggaggcccatgtaatgatatagttctagactggcaatttagtatatctagaagtgctgcctttcatagataaaaggaacatttgaggccatgcaagtaaactcatcagttcctgtatgacatacggaaacccagaagtgttaagccatctgcctaatatcacacagctctccatcacatcccaaacctgaatcagatcccaaacctgaatctagctcttctgatacccagctcagtgacttttccactgcaccatgcccccaaagtccttttcaggacagacattaaaaaagaaatagactttgcttttctttgtaaagccattgaggcagttcttcagtttcgttgcaaggaaaaatggatcttgctcatgcaatgaaaagtcttgcagtttgagaggctactgtatgggaggactgcctaatgagggtcctcagagcagactgcggtgcaataacactggggtacgataagctggggagagagcattctgggtctggcttaaaggggtccacaagggcccttaacttcccttagttttctgacttttctaagtatacttttttgctaagtgaatataataatagtaataataacacctattgtattttaccaatctcctacagttataggaaggatcaaaagaaacgtgtgtaaaagtacctggtaaagagggaagtgaatattctgtcatagtaccaaaaatttcccgtttgggtcatcagacagtctgagattctgttttgtcttttctaagaacactccatgcctattccaaccttccagccttcccttgcctggaatgcgttttcccttttcctccatgtcatgaaaccctctgcatcctttaaacacactttctttgctaaagtgcctttcttgagggctttgctctgaatcccttcagtggagtttgtggatcactgttgcactctgctttctctggtcattgctttgggctctttctctctggctagactgtaaaccccttaagccaagaacactattttatatgccctctcctcccagagtacattaaaaaagcagtgggtgccagtaggcagatgcttcttgagtagcttaataatccccaagacagctcttacttgcttgcaaaaggcaattgtgcacatcccttgccaactttgggttcagcaatgtcagatggatggcttgaaattggcagagctcagagtatttacaccacagaaattggcagatgccacagatggtttttcttttttccctgagagccagctgttagcattgaccagcagcccatgcactaaggcagatataacataggtctgcaacagagaagagaacatagctcttaaaacaggagtcacagctggtatagctccacaggagaaggtggaacaagccttataaaggatgcccacaatcaaattagagctccacaaatctaagtaactagaaaaaaagctgcaagacctttctactttaataccagtgatctcatgtttttctcaagagtattattaaaaaggtgatagacacgtggaaatgggagaggtaagggtgttttatcattattgtcaggggtgtagaaacaaaagctttaaaattctttaaaatatatttgagggggaatacaatggcttgacaaagctttataattacataattaattatggggtgaaatgtgattgcagggcctttgtatttaagtctcattcagcattcatggcatcgagaattttctccactttgctataaaaaggattttgttctgaacaaagagaaagagagagctgatataatgtcatgcttggtgcaaatggcagcataagaaagcagaaggttgaggtgaccagccaggggtgaccagaaaaaaagtggggtggggtgggatgatccacaagctttcctattagttttttttaaaatcctttttcttaatgtaaattacccactgcataaaacagtataacattagacatttctgatttaaggaataggattaacgtaaatcttatattccacttatatgaatcaataactttagaagagattatttgcaaaatatctgcctgtaatctcctagcatcttcactgctgtgcacagcccccacccctccagccacataggaagcaggtggtgtttcctgggcaggggaacatggcgctgggggaggtggagctcatttgtctcttgatcttgcctttggtggttgcatccttagctggaccccatgagacacttaccttgctttcacagaaatcactcactctgtgaaagaaatgagagtaaaggaagggaaagaaaattaaggaaggcagaagtgaacatggaagagaaaaacaataagaaagaggaaatagaagggccatggttttgaaatacaacgcctggaaaacagaaaatgaaaacagaataaaggaatgaaattgtaaaagctatgaaacaaagtaatgagagaaataaaatcttaactctgaaaaaaatagatgtgatttatgacaaatatcaggaaagtgactcaagagcatcctgaaatctccttgatagtaccgaagggagacctgggcttcttatgatcactgacatctgtaaaataagaatggtagctgtaaattttgaaacgatgaaaaataaccttgtagcaggaatcaaagggagagtttgatctaatgttggccagaatgagtcaaatacattcacttcgctaaagtgctctgcgttggtcagccgatttttctttttttttttttttaaagtaaaatctttttttattattattatactttaagttttagggtacatgtgcacaatgtgcaggtgagttacatatgtatacatgtgccatgctggtgtgctgcacccattaactcgtcatttagcatttttcagattctacgagaccattcaaattccagctctgcttgatattctctctctttgtagtgttgagacaaaagccttacaaatgtttgtgtagagaaatcagtgatgttaaaaaaagcaatcacttgtatgaaaaattccaaagacagcactaacatgaaatgatgaaaatgccaaagatatgaaaaataaagacaactgttacaagacgtaacggctctgagtgtttgcttttatgtgacagatgtttttaaccaaagctcaacactggcagtttgagtacacttctgattttaatttgtgttctatccccttttcgtattgatgtctactcacatctgtgaaggctctgtaacctgaatttgacaggggaaagtgaacagactgcttttggagtgcttccattaagtccacataacagactgttaacaaaaatcttaaatagctattctaatcatcaacagcaatcttacacaaattaaattaggcccaaagggcccgattaactttaaaatgccttacaggcatgaaacataaatttaacttattttccccctttggagtagaaagagagttgttcagtgtgactcagatgcacagtttaaaaaaaaaaaaagtatgcatgctgtgaagacatggagacagggtttcattttctttttcaggaaaccacacttacaggcattgaaattcagttaggccacagccatgctccctgtttacatgcaaagtagatgcattaaggttttcaaggttttaaagtagatgcattaaggtagagtttttgcagatggcacagctactctaatcagctcaaggaagtcctattgctaaagaaaggagacatatatcaacatgcattaacattaaaatgatgccttcagaagaggtaaaagttgaactagaatttctgtagttcaaacccacctatcaagaaatgggttagattcatgatttaaaattataccacaaatcaaagaaaaaatacttttttaagtgtctgctcttctttattttagccaaatctctagaggtctgtccaaatatatttcttgaattttcttgaactagccagcaggttcatcacttgtggatttgctgtagtctccaatcctcacaagtgtttgatagcttttcttaggcaacttccttccagctgcatggaacatgtaatttcggcccaagtcaatagcagtgaatgagaaacccagatgccagggaaaggcagcctcccaatagatagaaaacacctgaaactggtgatcagcagcttccggataagatctcaggagttgggccagtgggttcaagcatgcacactaagaggcaaaatggcagagtttgactggtatatgaccttctaggagcaatcaactggtaagagaagagtgcttcaagtaagcatgtgtacaactccagtaaacacactgcgcatgcggcccctcccaagcactagcacacaagtggtcagcccaccccaagggaagaatcaggggagaggggacccaagaccctgtaagtatgtcagcatataaaactcaaagtcaaaaggtcaaactgtgtacttgatctcccaagttgcttgcttggccctcttccaagtgtactttactccctttcattcctgctctaaagctttttaatacactttcaccactgctctaaaacttgcctcagtctctcactctgccttatgcccctgagccaaattctttcttctgagaaggtaagaattgttgctgcagacctatacagattcaccgccagtaacactttcagctcttacaagaccattatagacacccgtgcttgtcaacaacctcctgctctgataacctcaacataaatttatttcatcaaacagcagatgctctcttgtcccaccagcccagacaccagtgggtgagagtcatggaaggtgttcattttctgcaaaatattcattagtactttagagaaccaaagtaattttcagaaaactacctattttccaaatacctcagaggaaactgaccatatctggatcactggtgatagaacctaattaggtgaagccaatggcagtcttccatcccctgagattagtacagggatgggcaccataatccgagatgaaataagcagaataaaaacaaggactcatatttcatgttacattgtataccaggaagtatatatcccccatggccactggcagccatattgcgagcacaaggagaaccagtcttaggatgaaactaatgctgccctacctttgaaatccagttatgtagataaatgttcttattgcatacacaagcttgagtcaggtattttgattcctcgtaggtgaaactacttaattaatttaagtggtcttatgagtaatttgtactccaatgtctctgaaattttcctagaatttaactactaatcccagggactgggccagaagaagctctaagtagtaaacaatataactcaatgttgtcctctttttccagtgctagagcactgtggttgacccaagggtgtgagcttcttttagtgggttattctcccaagataattctatcattatgcaactagacttttcctacccacctgaaaaataggccctgttataccctacgatgtcaagctaggctcatgctggaactcccaaaacatgaacaaatgtagttttataaagtttgagctgaaaaaatgttgtgtttttttttttttcttttagtttattcagcttaatcccctctttttaggtaaacctacaatggggaaatgacttgactaagaaagcaatagactagacctagagataggacagagcccaaggcttcagttctgtgctcgacctgctgtcctggtacactgaggctgaaaactcatttccagcaccccttctcaatggcacatgaacattatataaacactgtatagttaagtcgtctgaatttttcatttttgccatattagctgttattactgttattggtgttttctgagaaataactagctcacagtgcttagatgcagtgaaaatctaaaggacaaaccatttggaaaagagtttaaagctccaagttaaggttcagcatcagttgtcctactgatgttgaggttatctgattatacttaggcttcttaagcatgttctaaaataatcaagtaatcagttaacaaaacaccctatattttaatataaaaaagcacaaatagcaagatgaacttttattttataaagaatccatattaaatgcttaattatgaacgttgctgctaaagaagtctttgaaatgtcattttcaatatatccttgacctacttaagaacagacacttgtttcttttctccatcctcaaatttagaaatctctggctgatttttaaagcattttgtagatcacatcaagttaaaaagcttctgcacagcaaagaaaacaatcaacagaatgaagagaaaacccacagaaatatttgcaaactacccaactgacaaggaattcataaccaggaaatgtaaggcgctcaaacaactttacaggaaaaaaatctaataacccaatttaaaaatagacaaaagatctgaatagacatttctccaaagaagacatgcaaatggcaaacaggtgtatgaaaaggtgctcaacatcatgatcattagagacatgcaaatcaaaactacaatgaaatatcatttcaccccagttaaagtggcttttatccaaaacacaggcaataacaaatgctggcgaggatgtgcagaaaagagaacacttacacactgttggtgggaatgtaaattagtacaaccactgtggagaacagcttggaggttcctaaaaaaagctgtaaataaagctgccatatgatccagcaatctcactgctgagtatagacccaaaagaaaggaaaccagtatatcaaagagatatctgcactcccatatttattgcaacacaattcacaatagccaggatttggaagcaacctaagtgtccatagacagatgaatagataaagaaaacgtggtacatgcacacaatggagcattattcaaccataaaaaagaatgagatcctgtcatttgcaacaacatggatggaaccagaggtcattatgttaagtgaaataagccagacacagaaagaccaactttgcatgttctcacttatttgtgggagctaaaaattaaaatcattgaactcatggagatagagagtagaaggatggctactagaggctgtgaagagtagtggtggaggtggcagggagtggtgatggttaatgggtacaaaaaaaatggttggaaagaatgaataaaacctagtattttgacagcacaacagcatgactatagtcaataatgattttattgtacatttaaaaacaactgaaagaggatgattggattgtttgtagcacaaaggataaatgcttgaggtgatagatactccatttactttgatgtgattattacacattgcatgcctgtatcaaaataccccataaatatatacacttatgtacccacgaaaattaaaaatttaaaaataaataaataaaaagcaatccgtgaccaccaattattcagctatttcacttcatcacctcctgtattctctgaaacatctgcactatagccagaaacttccatttaacaacatgctatggtattcgggagtattcctccctcaggtttcagcctatgtttaccctatacctgaaatgccctctcaaccaactcttccatgacagttcaagttccattcatcctatggggctctttataaatgccttctcattcatgatgagtccagcccatactgattgtccttaccttttcttgctttcacaactgtgctaccgattgttgtgttatggtttttttttaatatttcatgtgtggattttttcaaatttgattgtaagctgttaaagaataagcaatgatgtttttctttcttacatgcattctacagagcatcttgcacatatggaagttgaaagctcctctacaagcttactgattgatggatagaaataactagagtacaagtgaagtggtgccctctttgccttcctcccctctccagggccttcactgccactgtcctgttagagtaccattaacttccaatgttagaacaggctcttgatggctgaggaccaagttttgtttgtttgtttttgttctcttccactgcgttctttctgccttgctgtagattctgagtagatcagttaagatcttcacgcctatagaaatggcagacagaatctcaaattttaaaggacaactaggatgttgataatctcttctggttccaagtagggtagagcataagctgtttcagcaaagttcttgttctcaaaatccccaggcaatcttaggtgtcttgcagagatatgaagttatttctaatatctaatctaaatctctgtctgccactcaagtctcttccctttatcacaaccctaagtgaaaacaggaactagggctttctttgctgaaaaccgtgtccacaccatatagctatttttaaaaagatgtattcccagcttatcttctttacaagttaaggacatggtgttgtgttttatatctggtctctgtttgaaaataaatggccatctagagtacaggctataaggaagtaagctcttcttcaaacatacagaaagtagagacaaattttgtcacatttgctttaaatattttattttaaaatttgaactattatagatgtaggtgaatgatgcctttgtaccactgcctgttttcccttccaaagagtgatgactattcagggacattttttttcctggcaagtttaaaaataatatatatgtatattcacagaaatatatataacgaacatatctcatatacacatatatatcatatacatgtttatgtcatgggatatctacataaattccatatacaatatgcaccatttttaagtgttcatattctttatgtaaatcataccacagtatatgtatcactctggaactttcttatacttaagacttagtatgttcttaagatttcacttatgcatctacagtaatgtgttacttaacaacagggacacattctgagaaatgcatcattaggcgattttaccattgtgtgattaccacagagtgtacttacacacacccaaatagtgtagcctactacatacctaggctgtatggtgtagcctattgcatctaggctacaaacctgtatagcacgttactatactgaatactgtaggcaattgaaacacaatggtctttgtgtatctaaacatatcaaacatagaaaaggtacagtaaaaatacaatattatattcttcaggactgctgtcatatatgaagtttgttgttgatgaaatgtcattacgcagtacatgactgtattataaaacttgaacccatcctatggtaaatctaagaactttccgcagcagaaaaaaatatctaaaaccagaatctagttaaaaatgaattttgagttttgaaagggcaatttaacagtttggaaaagtaccaatgcttatacactcataaaatcatgctgctttcaaacattttaagaaactctcaaaatattttgagacacagttgtaaagttttccctgttttctaaaaataaatatatctaaagattggtctggagataatgaacaaaaatctattagtaaatttactaattagggtcatgtctatgtgtttatgaaaacattaaacatttgtttatttgaagtaaaatcactttagccaactaccataaatattggctgcctgtcagaaatgatgtacccgaatttcacgtttttcatttcctcatggtaacccagcccacacaatatttttatataatgacagctgtcaggaaagcagaatatcttatatatacattgtattttgattaatgagctaatgatggttctctgtttaaagtaattagcccccaatgtggtttttagccaaagtgtgctcagagttgacaatgatgtgattatgttatccagttagggtatagccaaaatgatcacattgcctatagcaatgctttttgaagtgccattactaggttataaaatcaacttaatatattttattagggttgaataaagaaaagaaacctaatagattagaatataccaaagatattagcataccttgagtacaacatgtgtaggtttatgaaacctttgttttaataatgtgtgtatcttttgtgtgactgcaaagtcatcctataaaatgtatttctgaccgtggattacagtaaaaacatttttagaaaccctaggcttctttcaggtttttattgcaactgaagttgttctagctttggcccttggctgtgtaatgattgaagtcattcccttatacacacttatgctttcttaccaccccttggccagccctttggtggagcccatttcatccctgccaatggcatgtgaggtcctcacttctccagctttacctcttactgccctttccctcttgttcagtccatagccttctttgctgtccttgaacgtgccgtgcaggctgcagctgcagtgcctttccactgtctgttccctctgcctggaacactcttcactctggtattcacacgcctacctccttttcttccttcaagtctttgctcaaatgttagctcctttatgaagcccactgtgaccacgttatttaaaatagcaaccctcctcttttttctcacagacctcctttttctgctatatttctttcctccacagcaccagccaccttctatcacattgtagaatgtatttattatgtgtattgtttgtctgtctccctctactagacataaagtccaggagggtaggtattttagtatgttttatttatggatttaattcaagcaactagaacagtgtctggcacaaagtaggtatcaataaatattgatgagctaattcagattggtccagatcatgagagagagagaaaaagagagtggccaagcatcagatacaaatttacaggagattctagtgcattcttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgattcgcccgcctcggcctcccaaagtgctgggattacaggcgtgagccaccgcgcccggcctctagtgcattcttaagttatgtcctgtcttttatgagaaacttctaactctcctttgaagtagctattctttttacattttctccttatagggcccattcccatctggctctacaagatattagagcaacagcttctactaacttctaggaattcatccagaagagtgtattgaaagtcaaaaaaaaaaaggagtctctgtttacaatttatagtcttaatataactaatctaggcaaaatcatcaaaacatgtgcttctgctgaacttatttatccaacatggaaaataaaatagtaaaaaaaggtcagaaaataaatcttggggatagttggtttacaacataaaactaaggaagaaaagtaacaggatcagtgcaatgggcccagtttcccccgcccctgctggagttaccacatttagtgaataaactaaactgtggagttggctctgctgctgaggcaggagtgttatgtacttgggccatctcattcatttcccgcctgaaaatttccaacatagccagaaagacaggctgctacttgcacctaatgaagtcaacaatgcctttgtgtactgactccaaaaatgatagcttgatctggacattgttatatgaagcatatgtaaagtagcttctgttttgcaagagttagattattattaaataaatcatttctggaaaaaatggtagaaagtcacttctgagttgtacatggttaccacaggaatgtcatttggatgtttgctcactgaagacacacctgatgttagaaataagaaacggaggcaacttcaaatacattgacatcataaaatagcaagcaagcaaacaaaaaatgcacaaaagctcagcaaggggtgtctaaagatttggccactccttttaatcattgtcctaacctctgttatttatttaaaatactgttcagattatgtaaaaagcaaaaaaagtattttttttcttctatccccaaatttttaccttctttgtcccaatctatacttatggtctgagcaatgtgaacatcaattcagctataaagctccttttaactcagtgtttaactctgaaaccagaaatgttgcaccatagcttgttcatacttcttaatcttttaaatcttaatccacattttaagtagatagcaatatgtctggagagtgcccatccacaagaaggtgacagagtctatttcgttataggcgtgccacttttttgtcaatttagtcacaatttaatcaattactgccattactatggaaattactacagaatgaatattgtagtctttaagtacagagcaatccttttacattttaactcaatattaaatcctttttaaatctctagtttcttcccaaatccagaacaaaggatgcttgctttgttacaatcttcacctctagtataatcttaataagaaatacaaaagactcatttactctgcctaaaagttttgataaaggtattttttggaatgtgctgcatgtttatgctaaaaatagagaaattataagcacttttaaaggataatctgtttattaattgaattatattatcaaagaattagagatatttagtgaacaaatgaagaagactaagttttcagaaatgttgcttttgcatgatcaatataattgcaaaagtcaacatgaaattgacattattctgtggaagttacaacactttctctttaaatactcagtcaatattacctatttttgctcttaagcaaaacattgggtgaaatgctcacattaccagaaaaatttgttaatctttggcaagcaacaaaccatgtttagtacttgcatttcctgttttacagatgttttgttagactgaattaataaaatatcttattactatttgaagagtattttacttatagtgagaaagcagcagatatgaacagctttgattttagtaatgtgtctccttaagcctcttaattgtagagactgttggtaaaagtaattaagatttaccaaaagagaatcaggatatcattgtttaggcacctaagaggaagaacagggtaaaatgaagccagaaattaatagtatttccaccatcaaattaaaaatactaaaaattttagaaaatatatcacagttgaagtgattcaagtgcaactatggttagactttagtaaccacccttttattcttattattctttttaactgtgatcatattttctataaaagtttatatcctgcttcaaaaaacaattttttaaaattttggtttccccatttattatcatgttaaaaaatgcatagcttgaaaaaaatctcaaacacactgcattgtagaaaatattaatagcatatgtaaaagcaaattaggtgatgataactaggacatcaagttattaagattatatgaattgtgtgatggttgctagggtgccaggcagcaaaatgtgtaattatctgattatctgatttatttaattctggcagtctatctctacagatacttcagccagaaaagtatactttggagcttgaattacctgaatttctagctaccttgattttatataaatatatgtaacacttataactatatacacacacatacacatatggaaatgtgtaaacatagcaccaatactcttcagccaaggaagccaggaagtcacctgtagttgaacaagtttggttcattacttgttgcagcaaggaagaacacacatcacggaaatcatgggtgtttcagtaagagggtgttagaaaggaccttataggatttgggctttgattgagtgatttgaggtagagtctaaggcagcggggattccctctagattggatgctgttagaaagtggagcacttctgtaatgggagatctcacttactcttataggaaggggaaactatagtgagaataaagttgtcattggtaaagaaggagcactcattttggccaagagataggatgtttggtacttcatgggtggcaaagtgacttgcttttgtctgtgctcacacaaaattatgaatggtcttatttaatcatggtctcaaagtagcccggtcagaggctggttttctgtgagatggttcatgtctaatgggagaatcgcagggtctgcctatgagagccaggccagcttctgggtgtcaggtgctgccctttttccttcctcaatagcttcagtcattcttatgctacgatgggcagatctcacaagtttatgtgtgcctttttttcacactgccaagtacagttcagttttaggttgggttggttacgagagaacagaaagggaatattcttcccagaaagaatgattcagtgctactcatactcactggtcccctttctacatagttgatgctctcgagagcggacttttctcccaatctgatgcttcaggatgatggtgctttctctattgtcactcaatgagcatttgatggcaggaaaatttggtagaagagaacaactttttctcctgagaaaaatgatgataaacatggattttaattttaattttgttttgaaagaagcaatcttacagatttttaataatatagaggagaaaatattcttccactacctttaatacaatgtctgtctgctctaattaccactaagcattgctgaaggttatttggcactgaattcttctcccgtgccccacccagttttttttttcttttttctctttttactaaaaaccaaacatctattgtttccagcatttagaagagtctcaaattttctactcaagaggtgttaagttgctgctcccttcttattctttgtacagaactagtacagactagtactgcaagtaattcacagactgttttatgatatactagatgtaatcaatttgttttgatttataaaattgggaataccacaagccacgacagcttagctatccgcataaatatttactcaaaaaatatttgctgagcacatgctatgtttccatattattttgtcccaggcatggggacaccagggagggaaggaaggtgaagagcccagtctctggagtcctaaggcctgggttggaattcctgctcagccacttgctagtcatgtcatcataggcaggtacttgatctctctcgactctacattcttcctctgtaaaatgtgggtgactaaataatacttacccttaatgctgtgggagggctgaaagaggtcattcgagttaactgcttagtgcagtgctcagcatagttaatactcagtgaagccattgttattttttgacaagatagtggtgaattactagatgctattcttccctcaaggaactgactggttcctctcactggtgaaattggaggcatctcacttattcttgggaagagtattaggaggcaggaagagaaggcacttagtaagacctgatggatgagtgagagttgtcctggcagtggtaaagggtaagggagaagggaaggaatgatgcttgtggagaacaggatggtctcagcattggggacacaataccaagtgctagatgtgacagagaagagaaccacaggcagttccttgtggccacactgtggactgggtggagagcgacataggtggtgggaactgtagctggggagtccagccaggaccggatctcaagggccatgtgttcaaagcttagcaccttagactttaccttgaagacaacagggatctggagtcagcctatcagtaatggtatccttttcaaaaaggtacttacataattttttttaatgataaaggaaattatttacagaaagggcagagttcattgttttctcattcacagagtatagcaaccgttacccgtacgagcctgggcctctcatttaatttctcctgcccctcattccttacccatgctttctcccattcctctccatattaaagacacccatattttatttaagtcccagagtatatgtgcaggatgtgcaggtttgttccataggtaaacgtgtgccatggcagtttgcttcacctatcaccccatcacctaagcattaaactcagtatgcattagctcttttctctaatgatctcctccccgaccaccctccgcttacaggccccagtgtgtgttgttcccctccctgtgtccatgtgttctcattgttcagctcccacttataagttagaacatgcggtgtttggttttctgcgtctgcattcgtttgctgaggataatgacctccagcttcatccatgtctctgcaaagtacatgatctcattcctttttatggctgcatggtattctgtggtgtatgtgtacattttctttatccagtctatcatcgatgggcatttgggttgattccatgtctttgctattgtgaatagtgctgcaatgaacatacacatgcatgtatctttataataaaatgatttatattcctttaggtatatacccagtaatgggatcgctgagtcaaatggtatttccagctctaaatctttgaggaatcaccacactgtcttccacaatggttgaactaatttacattcccaccaacagtgtaaaagagttcctatttctccccagtcttgccagtatctgttgtttctttttttttttttttttttttgagacggagttttgctctcgttgcccaggctggagtgcaatagcgcgatcttggctcactgcaacctctgcctcccaggttcaagcaattctcctgcctcagcctcccgagtagctgggattacagacacgcaccaacacgcctggctaatattttttgtatttttagtagagatggggtttctccatgttggtcaggctggtcttgaactcctgacctcaggtgatccgcccacctcggcctcccaaagtgctgggattacaggcgtgatccaccgtgcccggcctcatctgttgtttcttgactttttaataaccaccattttgactgccatgagatggtatatcattgtggttttgatttccatttctctaatgatcagtgatgttgaacttttttcatatgtttgttggccacatgtatgtaaagacacccatttctttatgtgcttgacatggccttaaatatgcatgtatccttgtaaattacatcgtgttgttctttgtgccttttaaatttacctacatggtattctgctaaaaataatttcctgcatctaaatttttttctttagatacaaagcatctgtttgtatatgtacaccaatcactgtgtcaaactgctgtatacatagcccatatacaatacacatggtagcattatttataataacagtttgaaataacctaaatactgcacactagggaatggataactaaccctagtacaccagctgtgttaaatatcatgccttcattaacaatgatacttctcgatatgaaggggcacatgcttatgacaatgttaagtgagaaaagcagacaaaacagtctaaattgtgacaacaaccacaaaaatatacattaatacagccaagggctagaaaggatcagagaaaaatgaaacaggtatgtatgtctgagcaagggaatcatgggtaacatttctcatgtacagtagctccccctattcgaagtttcgctttccaaggtgtcagttacccccagtcgaacttggtccaaaaatattacacgaaaaattccagaaacaattcgtaagttttaaattgtacagtgttctgagtggtgtgaagaaatcttgcaccatccagcttcgtcctgcaaaggacctgaattctacctttgtccagcggatccacactgcagaaggtcccctccttatgagtcacttagtagctgcaagagtagtgatgctggcatactgtgagaattgttctattttattattattgttgttcatctcttactgggcctaattttcaaattaaactttatcacagatatacatgcaaaggaaaaaacagtatattagggtttggtactatttgcggttttaggccttcactgggggttttggatcccatcctacaggaataatggggtgctcctgtagctgttagtaagacgatggtgtgcctggggatttgtgctatacaccacagcatcttctacagtcgttttgggggagagggaagatcagagcagtaccaatctgctgctccttgccccaaaactggcaagaggcgcctttcctcagccagaaaggcctcttctccaccagctgtgtcctgcaatcaactgcagctgtattggtctcaccccatgggaaacaggtttgaagttaaaaaccttttcagagggccgagataaatttagtgctgctaaatttaactatcttcaagattaaacatgaaaagcaaagtgcatgagttatgtatattattctttcaattgtgcaaaaataagacattaacttgtttttgcatggaaaaattctgcaagaatagagaagaaatgttaacagttacccctgggatctgggataaaagagatacatcatgcttttctttaaaaaaaaaaaaaataggtttttgtggatttttttgtttttgttttttttgacagagtccagctctgtagcccaggccagagtgcagtggtgggatctcggttcactgcaacctccatctcctgggttcaagtgattcttgtgcctcagcctccgtagtagctgggattacagatgtgcaccaccacacccagctaatttttgtattttcagtagagacggagtttcaccttgttggtcaggctggtctccagctcctgacctcaggcgatccgcccgcctcggcctcccaaagtgctgggattacaggcctgagccactgcgcctggcccgtgcttttctctaaagtatgaaaggaatatgtactttcttcttaaaaaccatgtaccaaacaacacttttcaattaaaatgttatttttaaaagtttaaatccccaaatttcatggctctaactttttaaacatcactttttaaataaatgtctaagtttttaactcagtatacagcgttctccaaaacaacaaattcatattctgagcccaaaactgtgcacctcttttagtgatgaggacggagtccaaattgaggacatcccttgtagctcacaatgcacacatattctcacatcaatagcaacacagaatgcaactgatgaccaatatatattcacaaataattgaggaccatggctaagagttgcattcggattccgatgtgactgctattgtccttaacacggactagctccaggtgagtcccccggccccgggggtgtggcgggcgtcacccgttgtccgggcacacaccccgcagacccaatcctagcccgctggctagaccatggagggccgctgggtgcagccacagagcgcggggccccggcgaccccgccccgctccgcgtcactcggcgccctgcggcgcgcgatgagcacctaccactagcggagccgcgagggagaggccgcggccccttcccgttgcctgcggccaccggccggcattcagagcccctcgcctggcgctaaatttaaaaacgtaacacgagcagcaggctggtctcggaaacgaaacgaaattcggtccctgggcctcctcccgggcgctgccggtccctcagcgcgccgcgccacccggaacagacccttctcccgccattttcggcggggctgggagactgaggcccgcggcgctgagcctgcggcgccccggaagaggcgggcggcatggccgctggcgtggactgcggggacggggttggcgcccggcagcacgtgttcctggtttcaggtaaacacgcgcgcccgggcggcggggtcggcccaagaactggcggagcggcccgcgaccccgggcgcgccgccccccaccccggtggctcccactacccggcccggcgcgggatgggattctctctgggacagctggccccgcattttggtcacacgtcatagcaagccgcggttttcaaacccggaagcgccgaaaaggaccgagcgtgtttcccgggccctgatccccggtggctcgggtgggagggtggaagccgactcagcctgaggggagccacgcgggttcgcggtcaccggtgcgctgcgggccccggaggtttctgcccttggtgtcccctacctggcagctggccctgcttctgtgatcctactgggttggaaccagggatccagtaggctcgaagtggcctcagacggtgcgcagttttaagaaagcaaagggacaggcctgcagtggcgaggcaggagggaagcgggatgggagtcgcggttaggccaagggtagttcaaagcgattcagcaggatgatgaccacaggagtgctggagccgggcctttcagcccccgtgt

SEQ ID NO: 691 - DNA, 47088 bp, Homo sapiens
ccgctggctagaccatggagggccgctgggtgcagccacagagcgcggggccccggcgaccccgccccgctccgcgtcactcggcgccctgcggcgcgcgatgagcacctaccactagcggagccgcgagggagaggccgcggccccttcccgttgcctgcggccaccggccggcattcagagcccctcgcctggcgctaaatttaaaaacgtaacacgagcagcaggctggtctcggaaacgaaacgaaattcggtccctgggcctcctcccgggcgctgccggtccctcagcgcgccgcgccacccggaacagacccttctcccgccattttcggcggggctgggagactgaggcccgcggcgctgagcctgcggcgccccggaagaggcgggcggcatggccgctggcgtggactgcggggacggggttggcgcccggcagcacgtgttcctggtttcaggtaaacacgcgcgcccgggcggcggggtcggcccaagaactggcggagcggcccgcgaccccgggcgcgccgccccccaccccggtggctcccactacccggcccggcgcgggatgggattctctctgggacagctggccccgcattttggtcacacgtcatagcaagccgcggttttcaaacccggaagcgccgaaaaggaccgagcgtgtttcccgggccctgatccccggtggctcgggtgggagggtggaagccgactcagcctgaggggagccacgcgggttcgcggtcaccggtgcgctgcgggccccggaggtttctgcccttggtgtcccctacctggcagctggccctgcttctgtgatcctactgggttggaaccagggatccagtaggctcgaagtggcctcagacggtgcgcagttttaagaaagcaaagggacaggcctgcagtggcgaggcaggagggaagcgggatgggagtcgcggttaggccaagggtagttcaaagcgattcagcaggatgatgaccacaggagtgctggagccgggcctttcagcccccgtgtggatgatgaccggccatccaggacatgcgagggcttgggacagtggacagccagtgccacacaaggaaggaccgattaaatgacacagttaaaggaatttggcctagggagtgcaagccagaaaggtttggtctttttatatatgtaacattggaaaaaaggaacatctcctgttccctgtattaagttttgactttagctcagcaaatgcagtgtttgtggcagtaaatatactctgataacaatattctttcccaggaatttagagttttatgatggttattgaaaatgtttacatgacaggctgtcaataatattttttgcctctaaaaataaaacatacataaagtgtacggattttaagtatgcaactcactgaacttttcatacgtatacaccaccctagtaaccatcccccagttcaagatgtagactgtttccaataacgcctcatgcctgttcctagatagccccaggaacctctatgctgacctctgtcaccagagattagttttgcctgtttgaataagagtgtaccctttgtgtctggcttctttcactctgaaagattcatccttgttgtgaaattcattcatgttgtagcagttgtttggttggttggttagttttttcattgctgcttctgtttaattgtatgagtatccatactatgtatctctactgtggatggacatttgggttgtttccagtttgcaactattacaagttacacttctcagagcattcctttaggcggcttttggtagacatgggcactcatatctctagggtgtataccctggagtggaatggctggttctagtacttgtgtgtagagctgtagttgacaatgttaaatggttttccaaagtggttatactgatttatattcccacaagcagtgtatgagagttcccattgctgcacatcctcggtaaaaacgtttgggtggtaaaacagctaatgcaaaattcagggttttgacagaatctcgcaaagggctacccgtatacatgcttttcattagaaaaatcatcctttcttctcacttcgtcacatcaagacaattagattttcagagtaggaactctaatcattctttcagaatcaagtgcattattgttatttcagatatacacaatagctgatgataatttgagcttcttattttgttgttctgtttaatcagtattgacatcgtcattttatacgtgtgtttgtgtccttgtattaaacacaaaaccctcaaaagaattaaatattgattgtatccctgaaaattgtaggttttaatatatctactgctgggttgtgggaagagtttcagttgagtttctgttcagagctgagatctactgtgaccttttaaggcattgggggaggctgagcagctgttggaactgctagaaagagctgtgtggtcaggggggcaggaactcttaacagttaaaaacttgagctaccagctcctgcaattcttccttctggcctttagcgccacctgcaggctctgagggtacaacaaggtttgacagcgactgcagtgcaacactagttctcaaacttgagggcatcatttacctggggagctgggcctcagttcccagaggtgctggttcagtaggtcctgggctggggccagagaatgtgcattggtaacaagttcccaagagatactgatgctgctggtccggaaaccactgcccccaccccaggaaccactgcagtaaagactttgggaactagattgggatataagaatgacaagcctcatgtttggccctctttgtggtgggccagaatttatatggtcaaggaagtgcatgtaagtgcagagtgtgaggctcatcttcccagatgtagttgtcgtcttttccagaagatgagaaatcagcctgcttagttacccattcgggagttggaaacgatatgcccttggctgagggagcaccatactccagtaaagctgggcccttaataaagaaaacaaagattattaaacatttttcaaaagtatttggcggaggcggcttgtattcggttttagaaaacttgggatctgaagaacttactttgtgtactgaaaagtgagcacatgaacccacaggccaacagaactttaaagggatttatccgtgagacaagggtaaagatgcctaaccttgcaatgatacttttttccaacatttaattcatgctgttcatcgagttgcctgccacagcactgtgttatatcttgaaggatatatttaaatgtttgatttaggtatctttgcctctagttttcagtttgtttggagaagctggctatctcagataaacaaatctggaacttggaagagatactgtgagatatgcagacttgggacgttggttttcataggctggtgaagacagaaccatttcccatttcagcaaggcaagcatttcttttagtttgggatggtcttaaatgtttctgtaaaatggcctgggaatactagcctgtttgcagttttaatttctataagaggccattactttactttttggaaagtagtataagtttccatccctctttttctgccctaaaagtaaatgtttgagtcatatttttaatgtttttcttaagtccatttttcttgttaatgctactaagttgggatgtacccaggtgtgagaggtcacctgattcattgcgtttagaagactgcatttattgctgttgggggctgaacaattaattgggttcatctccaaggaaatgttaattgggaaaccctaacattgtgtattgaaaaaaaaaaaaagaagaaaaatcatttcaggcctgttaaaacaaaactcatttgggttcacttaggctgattaaaatattccttaatcagccccctgattaaacagtcctgaggtgaaactgcacctcaactcgaattttcagttagagacaagttttgcaataaagttatccccctttatttcatgaatatacatgttaaaaagtattttaggaaagattgcacttattatttatttctccacagaaagcagtttcatggaggtagaggatgggttgctttttgggagataagaatccctgtctaccttagacatttcaaatacaataacagctttttatgtgaggcatcgtgataatcacaaatgattataccagagctatctttccaattggaatgcaaaaatagatgtggaaggattgtataaattcatgcattagaactatgttctaattaaaggatttaaaaaataaatttaaaaggaaaaactaattttcttatttaatgatggagaaaatttatattaatgttatttctgattacagtcttgaagattttttttttttttttttggtccaccaactggcataattgtagctttttataagtccaaagaaatgcctcttgttttgggggaggaaaaaaagtaaaggtttaaagtgtatggcaaaggaagaactactatagatttaactgacttttcagtgacactaaaaaacactcttttcccttctttacctaatggctcatggttaatctcagaagaaaaagttaagcaggatttttgttctttgtcaaaacggtatgtatgtatatgtttgtgtttagaaatatacgtgagggccgaaagcttccttattttcagaagagatgaacttcacttggcacatgatagagaacctggccaattcaagtgctgattttagacaacctcggaataattaagctcagctttttggaagatgtgtcatttaccgaatagtctactgcaggcagtcagcagtgtaggagtctcagagttttccagcatagagcgtgtttaacattttccacatgaatctcagtctggctttgtttttgcaaaatgtttttcggtgggacccgactgacctttctcagatggccactggatctgctccccttgctatctatctgagcacgttctgaagtggatggacttcagttgccagttggtgtaatcaggctgtttccagagtctgatcttgtccctttagtaactgttccaaaatacttgggacatttataagtaagaactcatgactcccacatatttatcctccaggtcagaaaaaaattcataaaaggaaagcaagcagtgttcatgattttttatttgagtaacagaatagggactgcatggattctcccacatcctctgagactgtgattttaaaaaacaaacaactcagtcagtgtgctccaaagcctggctataataacacagacttaaaagctagatttatgctatttattagctctgtgtcattgggtggtttacttcctcactataaagcctcacttttgtcatctccacagtggggagaagagtaccagtctcatggggttgttatctgtggtttgagttactcataagctttcttacacctcaagcttttagccctgggcctgggacagagtagatatttcaataaatatttactgaacgaataaaagtctcacattccatttcttcctgcaatgtctttgcttattctgctttttcctccccttctacttctatccaaattctaccctttcctcaaggttccattcaactttattttccacaaagctaagccatttgctccagctcagcttctccgtcttgactttgtgtctgcctggaatcctgcctgctcttcactttatctacctggcaaattcctacttatcctttaaacccagctcaagtatcacctctaccaggaagccttcccatgggtctctcctcttgttactgcccaggttcgtggtacctctttgaccacctacacatttcatcatgattattcatttaagtgccatttttatataaatatgtattgaacacctaatacatgccaggagctagagagagtccaagtgtgttttccctgagtggccatttcgcttctcagtgtgggcacctcagccttctgcttcagagcacaacctccaaacagtagagcatgtcacgtaggatttccaggcctttattcagagctacctttatgacttccttgtctaaggatgactgtttgctaaagcagaatgggccaccccgtggcaaggggatgtaagggatttggggctgcatgttctagtccctgtttcattatctgtccccgaaacagctaagctggaggctggcttactcctccgagggcctaggtctcaacatttggtaaggctctcctgcatgattggctacctttgcctgattgtttttaaagattttttgttattgttgttgccttttaaccttcttttgaccagttaactctacatttacacgtttttctcacagtggtttttttttttgataactttaaataattagaataataatatttacccagtatagaaattctagtaatatggggaaaaaaataaagaataaaataatttgtccatcatcctcacccaaaataaaaattttggagatatttctttccagttttttcatgttgtttacattacaaaatgaattccaatcttcttaaatttttttttcttatttttctatttttgcctttatttcattgtttacccttactacttatttaatgtaacactaaaacactcagggagattggggttacataaaagtttatatggtgctgttctacataaaattggagaaagttcagttgatttaatagaggtaggggctgtttttttcctcttaattttgataaggacagaaactcacacagtgatatgaaacaagttgacaaagagaatttgtattttaggctttgaacattgaagaggtgtaatacttattgcttcagacagtagacagtacatatttggaatgggttatctttgaaagtggataaagattgaaaatacaaataggtgcaaaagaggtaaagatacatttacagagctgtattggacccaatggcaaactaggatgtttcaaaagccattcaaagcaggttacatttttgaggacaaccatagcctcctgcaaacatcccttggtgtgctttcctgaaaccggatactggtttgaatagcctgtgagtctgccttagtatggaaattgccattttttaatgtggggtcagtgcacctgggttgtgtgttacaaaatcaaacatgaacttctttgggagttccttagcaggttcacatcctcccaggaaggagcaggggtggtggagagcataggacatctggccctagggtgttgcagcagcaggagtccagggtttctgcctctctgagtgttaacttcctcttctcaaactaacttcctgcatttagtgaaaaactggtttcacgtgattcccaagctgcagatccccccagtgtctgctgggaggggtctctcctcttagttccagtttgaaacctttcaaaacagccttctgactggtcctgctgtggtcacatgcagtcccaccctccaccacctattgtagccagggaggggcaggctgtaagcacaaggtgggagaggaggaggacaaagtgggcacttgaggctaaagagtgcttttctggaagaaggaaagggtacaggatagacagcagaggaactagctaccacgtcgtttcaccagtgggactctgagctctggccagaaacctcagccactcatgagctgtcttgcctatggccaacattaggggtttctcagttgctggtagtctgtttgactggcttgtatataggtatagcagaggtttatttgtatggagaattgggttctagttgtaacttgtacttgccttcatttagtcaaagtttgtataatttttaggaagcccagcttctaggcctgcaacttctagctgttataactttgcaaaacactttcatataattgtatttgaccctcttgatgaccttgggaagcagttaaggcaggctttattatcaccattttgcatatcaggaaaccaagactcagagaagtcaagtaatctgtcaacatacaatagaaatccagtggcagagactgtcagctctctcaagtccttttccaggactcctgcatgtgccagaggccactctgctgactgaataatgatgcctcaccactgtgggagaggccagaggaccaggaaaggctggtctcaaactgctctcagtttgatgactagggaccagacatacctccttccctggaaccaaacctggttgctctcagtcaccccaatcaggtctgtcttttctagcactccacaatttttcctgcttcccacatagttcatgctccatccatgctccatctcagtatgtttgctggtctttgtggctctgagttggctgtgaacctgaatatttttactagcttcttcaccagtgcacaggctgttcctagaaacatggttgttgatagggacagccctgaaagaatggagattttgtcttctatggtcctgctgaaggctagtttctaatttttatatttatttatttatttatttagagacagagtctcactctgtcgcccaggctggagtgcagtggcacgatctcggctcactgcaagctccgcctcccaggttcacgccattctcctgcctcagcctcccgagtagctgggactacaggcacccgccaccatgcccagctaattttttgtatttttagtagacacggggtttcactgtgttaaccaggatggtctcgatctcctgacgtcgtgatccgcccgcctcggcctcccaaagtgttgggattacaggcgtgagccactgcgcccggcctctaatttttatttttttctccaaagcttcaaaagaaagttacacttagaggaatctattacttcagtaatcacataattttcctggtgcatgtctctcttgctttcttggtttgcctcttgtagtctttgaagaaacaaagagcttcaaagccaggaaaatgacccagatctctttgacagcagtgctaatgttttgggaagtgaaggcatatagttattactgaaattagtgttcctggaagctgcaagttacttgaaaattatgctgatttgtcttgcatgcattgtatttgtgtcctaccaaagtgtttccaaggaagtatctggcaaacaggcaggagggtgccggggcagtgggacggggagggtctgaatatattctgatggctgaagtctaaagaaaatgaactggaacctatttaggacatcgtattgcataagcatgagagtgataatctcatctctctttttcttttttctattggatcttcttaagaaacctgaatagccttgatatgatatctaaaaataaagtaaatggtgctttgatgtctgtactttctcctccatgtaacagtgggtgtatgtttctcagagtttatctcctgtgtgccaaaaatcagagaggctcaggaacaagtgtccattgcttccaagtcataagaacaattggcaaaaatcacttgtcttgtgtctttgaactttaaatgcagtgaaaaaacttgtcttaaccaagagagggataagaaagagctgccaagtttgaaaaacctgctgataaataacttcataccaactgtacaacaacctgtactatatagtctgtagatgaaaaatcatgtaccattttggcttgtacaatactttgtggctaactttaaaaaatacggaatggttaagtctgtgcattaatacgtgctgtgtaacctaacttctcagcattataatgtcacagatatctgggggtggtggggagaagtatatgcagctatgtatagaatatacacagctctccctcctttctcttccttctgccccctggctgtgtggtctactggctggattgcaatagctggattgcagctggttagatgactctgctggtttttgaggatgaggaggacaggacaagagagggaaaattttaaatgtttatatcataggagaatagtcatgtcagaatcattgtgtttccaagctgcagtttgtgctttttaagttaagaggtatgggacttcagattaagagtttctttacagtattatagtttaaaacattggctctggataatagttgactgagtttaaatcctggctctatagttgacttgcactctgaccttcaggcaggtttttcatccaaaaaagtggaaattaacatagcacttattatgtgaccaatatagaggacttaaacagtgcctggtagaccgtaaatggccaatacatattagctgttatttttgattttacattcattagacacaattgtctctttgtcactggtatgttttctttaaagtacagatgtcaggaaagtagcaatcagagattccttgtttgttgagggtgttttgttttgttttgttttgttttgttttgttttgttttgttttgacagagtcttgctctgtcgcccaggctggagtgcagtggcgtgatctcggctcactctaactgcctcctgggttcaagtgattcttatcaagcgattctcatgcctcagcctcccaagtagctgggattacaggcatgtgccaccacacccggctaatttttgtatttttagtagagacagggtttcaccatgttggccgggctggtctctaactcctggcctcaagtgatctgcctgcctcagcctgatttcacaatactgggattacaagtgtgagccaccgtgcctagcctgtggaagcccagcagatggaagatttgctgccagagttaatggtgaccggtgggatatacaattgaatctttacagagaatatagagaccatgagataactactctggaatcagttagttttaaggaaccacaggggcagagcttgagataattgggaagtttaacatattattaaacctaaaatggccagcaagactgatagctgcttctcagttgtctgagttttttctttttttgtgaaaatacttttttagccagcatgacttatgtcatctcttagatgagagaaaagagtaaaaaagacaaagtgtatagctactcttttaaaaatagtgttggaagcatagttttggaagaaggtgtctcacatgagtcaattttctagacaagtgaaatttggctcttttagtatcaaaacttgcttttataattttttattgagttttttctaaacttgaacaattcatttatgttatgtttattgagtatatctcatgtgccagaaacactactgggtactttacattgccttgatttttacatataaaatgcattgtgttctggcttttaaacaagatacactggttttaatttaatattttcttggaagactaattgttaagccgttatgtaactctgtgcttagatttcgtgactttcatattttgatcttattattccctacgtgttctcgactttttccacgtagttgagggaagggttactgattgttaattgattatttattatgtgttctaggcactttcacatacatttcatttcaatctaacagaaacatgtaaaattattattatacccattttatagatgacacaatgaaccacagagaggttgagtatcttgcacagagtcacactgctgagtgaggagaggagctgagattggagtatggacccttctgattctgggtccaatgttctttctatgctgacatcattgaagaaatagacataagttaaaagtaggtttatagatcatgacccttcctcacactccctctttcttttctaattctttcccattgctgtaaaagcagggttttcttctctaattaatttagctattcttcacctgtgctagatgcaagtaaaagacagcagaagttagaaaaagggtggagcctccaaacctgttgggtgagaggctggtccatgaaatgacccaggattttctcagagtaaatggaaaatctttaactttgatagagttaatttatagttacaagtaattttgtgtgcctaataccaggtatagactaaggaatttatcagaaatattatagtaaatgagccctttttctcataccaagtcttcaaagttcagtgagggtaaatccaccctcccataaaagcaatgaaaacactagcaaagatagcaaaaagcaactttttcagaacccctgagattagccaaaggcttccaatagtttgagaagtgtttattcaagaaaatcttctgaatcttattaggaacagcagggtttgtgggattgtaactgaactactcccatttcctctcctcagctctgcaatagccttgaaaaccagcagtcttgcaaaacttgtaaaaacggtacttgtaaaaaccaacagccttcaaccattggctaggataggcctggatggaagatcctcaagaagtcccattcccagagcattgtccctatttgacttttctcacagctccttggaaaagtctcatttgcagggcatagttgttatttgacctaccttggagctcagagcttgctctgttcccacagagccctatcttcagggtatttgtcaaaaacaatcagtgacaattgtttaacgtcgtagcttctgaggggtcaataccagttgcgcaaataaaaacctggccaaaaacttacgggtaagatgtgaggaataagatgtccataagaggcttttaaaaaactcttttgacatattcctagaggattagaaggctacacacatatgcagggctatgtgcatgctcagaaggacctgagagggcctcagtgtctcacctctgactgagtatgaggtccggagaaggcaataaatacaagctaaggcagaagattaaagtgcccaactgttgaaggtatgccttaacacacacacacaggacccttcagcaaagattggatcacttattggttcacagcatcagctaaccactaagctaactaaacagagacatcagtggctgcacaccacaagaaatacagactttacagaattagtccagaaaagtcactaaacaaacaaacagcaacaactgcaataactacaaaaaacagcaataacaaatcctggggagttgggagaggagagtctgatttccagaattgccacatttgttattatctgaagtgctcagttttgttttgttttttaacaaaaagcatgagacatacatacacaaacaagacagtatgacccatacacaatagggaaagtagtcaatagaaactgtctctgaaggggctgagatgttggatttattctacaaagattttattcagctactatcaacatagtcaaagaactaaagaacatcatgtctaaagaatgaaaggaaagtatgacaatgaagtttcaccagatagagaatatcaatagagaaattgtaaaaggatctaaagtctggatttgaaaagtataataacaaatgaaaaattcacttgtgagctcagcagcagatttgagctggcagaggaaagaattagaaaactcaaagacaggccaattgagattatccagggtgaggaacataaagaaaaagaataaagaaaactgaacctgaacctagtcccagagacctgtaggacaccatcaagcctactattatatgcattatgggaatcccagatgagaagagaagggtggaagaggaatatttgaagaaataatagccaaatacttcccaaatttgatttaaaaaaatacttgtctgcacaactaatgagtgcaggaaactctaaataggataaactcaaggagatccatacctgtgtgtgtgtcgtagtcaaactgtgaaaagacaaagagaatcttgaaagcagtaaaagaaaaatgactcatcaaataaaagggatcctcaataaaattaacagctgacttctcattagaagctatggtggctggaagtgagtgggatgacatatttaaggtgctgaaataaagagagtctcaacaaagaattctatatctgttaaaattacctttcaaaaattaggaaggaaccaagacattctcagataaaggaaaaaagaatgtgtcactagcagacctgtcccacaaaaattatgaagggagtccttcagattgaaaggataaggcactagatgataacttgaatccacaaggagaataaagagcactagtaaagataaacacagaaataaacataaaagcacaaatatatttttgtaactcatttgggtgatagataactacatagagcaataattatgaactgtgttaacaggcttataatatgtaaagatgtaatttgtatgacagtagcacaaaggagaggagaggaaaaggaatatgtgcagaaaacttactactcttgaaactcagttaatattaatctgaactacattgtgagttaagatactaattgtaattcccaggataaccactaagaaaataactcctttaaataaaagaaacaacaaggtatcaaaaatggtaccctagaaaacatctatttaactcaaaataagacagtaataggggaatccaaaggaatatgacatacagaaaacagagctaaatggcagatgtaaatcctaccttatcctaccttatccataattatattaaatataaatgcactaagcacttctattaaaaggcagagattggcagaatggagggaggaaaactcctgacccaattatatcctatctactagacacacttacacacactttaaatttaacaacaaaaatagtttgaaaataaatgaatgggaaaagatatacaatacaaacagtaactgaaggagagctggagtggcaatactaatatcacatgaaatcaactttatgataaaaattattactagacacataacagtctattgggaagatatcataattataacatacatgcacccaatgacagagccccaaattacatgaaccaaaaactgacagaactgaagggagatatagacaattgaacaataacagtgttttttttagagaaagagtctcagtctgtcacccaggctggagtacagtggtgcagtcacagctcactgcagctttaacttcctgggctcaagtgatcctcccaccttagcctcccgagtagctgggactacgggcacatgccaccacatgtgtattttttgtagagacagggtttcaccccgttgcccaggcttgtcttgaactcctgggctcaagcaatctgtccaccttggcctcccaaagtgctggagtacaggcatgcaccaccatgcccagccaagattttcttttaattactgatttcaaagtattattgtgatgtatagttttattcctgtttcttatgctttgagttcattgagcttcttggatttgtagttttcatcaaatttggaacatttcagacttactttcttcaagttttttttttgttccctcttctccttttggaaactccagttatacatatattaaaatgcataaagttgtcccgtagtttactaatactcttttttcttcaatttttttctctgtgttcccattttagatagtttctattactgtgtcttcaagttcattaatcttttcttcagctattaattttatccagtgtatttttcatctttagaaattcaatttaggtattttttttttgcaatcttctatgtctctaattaactcgtctatgaggattgttgtttttaaagcctttgtctatcaattctattatcttgtatattaatacccctctttcagtaattgattttgtttactcattatgggccatatttttctgcttctttgaatgcctcatagtatttgattagatggcagacattgcgaattttgtctttttgggtgatgagtattttgtatttctataaaatacccttgaacttcattcttggacacagttactttgaaagaattggatacttttaggtcttgcttttataattagtttggtaggaccagtccagcaaatagttagggctgactcttccctactactaaggacccttttgagtactatgcctaaagctccatgaattgtgaggttttacagtctgtctgggagtaggcacaattcaagaccctgaggaagtatgaggtactgctccctcgaatctgtttagatgggttttctcctggcttttgggtagtttcatcacatgcatgcactgatcctacttaagtaggaccctctgcagatctctggggtcttgtttctttttagccctctcctttcctgtgtgctgacctgtgaaccctaaccaccttggtgtctctggaattcttagcatcatctcttcaattcagtgagtcagctaggctttactgggttctccctttctgcactgtggcctggaagctcttttaaagcagtaagctgggcaatcatagggctcatctcatttgtttaccatctctcagggactacggtcctgcatggcttgtgtgcagtgccttgagaatagttgtttcatatattttgtctggtgttttgtgggtttttgttgttgttgttgtttcagagggttaattgaattcctgttattccatcttggtggaaagtagaaatctcaattttttttttctgtagatacttaatgtcactattagtttaagaaaaaatggtcgtattttaaccattcatgggtaagccaacttgtaaaatatgtctgctctatttaagcttatgaagatctgaagtagagtaaagggagtgggggccatagaaaaataaaagagagtaaaatctcccttctttcattctttctcttttgctcttttggtaaattgttgctatgcccccttactaatcagagccccattgttctttttggtaataggaacattttaagagttctgtgaatatgccactcaaaatatatgaagagtgttaccaataaaattgtcatggtctttatgttttaatctatgtgataaaaacttgatggttttggtacaactggttaacttctcgaaaaaaatatttaaattggatttcctcttaatatcttatacccagatatagtccagataggttaaaaatataatttctaaatattaaatgaaaatataggcaattcacagaatcttaagaaaaggtctttctaagtgtgatacaaaggatacaaccataatgaaaaagatcaatatgattacatgaagattttatgtcttttatatggcaaaaatcattataagcaggattaaaaacatagtcgatatccttagtatataaagatacctcacaaagtagtaaaaaaaaagccaaatatcccactgggaaattaggcaaaggatagttgtgtaaaaaatataggtttcaggtaaatatgtttacaatgctgtacttcataatagtaacaattacaaattataatactcataataatagctatcatttatttcatgtttctatttgcttgattacgttaatgttttcagtagattggctaatttgatactttgaaaaacaagtatactattattgtcagtttataaatggcatttgagacaggagattaagacccttgcccagggtgacaaagctatccaagtggctaagccaagattatcacccaggccttctgattctagacccctgcttctcatcattcctcatagcaatacatttaaactacctgaaattcaactgcaacttgcagagaaattggtaatttgctcaagatcacaacatttgtaagtgataaattgagttaaaaatcttacaaaagtcatataagtagaagaaaggaaaacagggtaaagtaaggtgagcaacaaaacagctgtgtgttttaattttagatattcacggtttattttcagaatatttaaaagatgcttcaaagaagatgaaaaatgggctaatgtttgtaaaactggttaacccctgttcaggtaagttctcttctcataacttgaatgttcttaaatgttgtggctaatgagtatatacacttttatgtctttgtgtccttgctctttctgaatagcttttaaagttaagatggcaccgtgaggagaagaaaacaaggtgatgacattactagtcttcccagataattcatttgacttaaacattttaaaaatttcttctcataattttaattcacagaactgttcagccatcagaaatacgggcaaaacaaaaaagtagcatgtttgagttctctttaaaaacagattaattttctttggcttccttaagccaacttttcttagttattcaacattagcctccatttatatccattttatcttataaagtaaaataaacaaccagaatttaaaaaaacaaaaacagaaggcttttacttgacatgccaagattttgattaggttcagttttagctatacttccctattttcttctgaccaaaaagtagtactttttttctccgtcaggggacttttttttttttaaatgataagcattgtttattgaagggattcatatcttattggaaaaattttattttaactttatattcagtgcattttcagttttgtcttcacattttttaggcaaaaatattaaagtgtattctaaatattgagtaatatgggtgatagtgtttatctctgtgtgtaattgtttttccattaatttataaggttttgtgtagacacctgatacttgccatattagaggtttctcctggtgacagtaatacggaatagtaaaagtatgggagggccactgagtagtgccttgttgttatagagacatgtaaatagaagcaacaagagaagaaacacattcctgactttctccagtgttcttttcttcaaaatgaaattgactgtaattggtcagctatatttagaaatcttagttatatatcagactaagttgacgtgagaaatatttcttcaagagaagttttaggtagcagtaaaggttctaaagcatttaagaaaagtacaggtacagaagaaagccagccctcttttaaaatttctgttttatctaaatgctcatagacaacagaggaacaaatgtttttatttgctacattggcagtgggaaagtaaaggctaacatttgctgagttcttactatgtgccaagtattggtttaggaaatttacatgtgttcttttttttaattcttataaaaacccttgaggaggttcagtattgtctccattttacagatgtggaaacagccacaggaaggtttatgtaacttctccaagggcacgtgcccagcatatggtggagatagagttaaagtcagcatccttgtctccagagattgtgctgtggttaaaaaaaaaatttttttttcattagttgaagtgataaaacatgcagatgtgcacagtcttcaccctcttgtgcctcctcccttttttttttttttttttttttttggttaagaaaggaaaggaaaaaaaattcattcagttgaataaagctttactcactccctatggcttcaagcatgtctgtctttctcacttagggttggcctgtggcttggtccctgtcagaccctgtgtggggagagccacacactgcccagaggcagggacccacgtgccagctcatgtcatatggctgaactgttgtgttttgatagtttaggaatggatattccctcttgatctgatggaggatttaaggacaggctttgtattagttaagataaatgacttgcactttctaattttttggtttaagtccagtgaggattatggagctggaaaactaccatctatgtataatagctgtaagctttccttggaatcagttttttagaatagacctgtgtatgtttatgttcatattaggaacattcgtcagagatactggatagtcttttggggtgtgtgtgtgtttgtgtgtgtgtgtgaaaacttacaaataaaagacagatttgtcttaacaggagaaggagccatttacttgttcaatatgtgtctacagcagctgtttgaagtaaaagttttcaaggaaaaacaccattcttggtttataaatcaatcagttcaatcaggtaggtgactagtgtaagcatttccaataactaaacacatactccagcttttccattcttcacacgtggggttgtgggtctgtcaccgggtttggagtctggtcactggtttagccttccttggcatgagagcaggtttaatcaaggagaaaggaaagatcatttgagcactaaggttaagtcatctcctgtgtgtcttagacggtaggaagttttaaactagcaactctgatttgtctcctaaaacagtgacacatcctgagttagaagttagatttgtacatggggcacatattgtgttgattagaaactcttttgaggatctttgtgtttttaacatgttatttccttgaaactggatactgatatggcttctaacataggctagagcataacaaagtttctttaaaatgctttgtcatatacctgcctgcccacctgctcccccacccccatacacacatacaccccccagcaccaaagttctgtttcttgtggtgttcccttaatttgggggcagtgctgactaaaggaagagtaggccaacggaactgttctgcctcatgttctggggtgggggcagtcagtggctattcaaagaatcctacatccccctgcccacagaccacggaagggactgtgtatagagagaatggcactgctttcccatggctttgtcctcaaaagcacaggaaattacattttactgcagctttatagatagactgacgatacaggttccctaacattgccgtcttctcattctgtctgtgcttcctcctaacccctcgtttttcagggggttgggaggctgtgttaaaaatgatttctaaagaagaaatggaaagttaaagatcaatttcagggtcttggttctcctctccacacagggatttgaagctctttggagtaaaatctcatagagcacattctgccttttgagagaatcacatagactctgaggcctgtataagaagagatttgaatttggaatttcacatatatttttcaacactgtttttcactttgagattaaggtgaaatagccacattgtctttccaagacgtttaattcccttcatcctttttgtaatctgcaggaggtcttctccattttgccacacctgtggatcctctatttctgcttctccactacctcataaaggctgataaggaggtgagtttccagctcggagcatccacagtgaggaaacagaatcaactatttttgtttgatctcctctctctccttttaatgatccaaaggtggattctaccttcagatctattatagtgactagagaaaacatgaatcatatgggccagtgcaggacagagcactactgcacaggccagagaagcagcaccttactcttgatccagtctgaccctggcttgcttgtgacctctgacttgcctgactcactgtgctgtgcaccttactgcttgacaaagcctgacagctaacactcctttatcattaagtattccttacacttgaaatacaaaacaggtatttaaaaattgaccacatgtcttaaagagtctcttctttagtgagagactgtggaataggtaaactggagcgggtccaatagaagctcattaatggtgatgtgctagttgagacttaaggaatcccagatggataaaatttacctttggaatagaaataaagacacagcttactaatagtaataattttagccagaagttctgtaatattttggtctcaggatacatttacaattaaaattattaagggttccaaagagcttatgtttctgtgggttctagcaatactcttagaaattaaaactgagagatttaaaaattatttatttaaaagttaaaaataataaggccattacatgttaacataaataacacatttttattgaaacaaacaaccaaatttaatgaggcgtgtggcattgttttacatttttgcaaatctctttagtgtttggcttaactagaagacaactggattcttatatctgattctgcattcagtctgtttccatatgttattttggtaggattatatgaaaaatatgcggccccatacatctttgtagttagaaaaggaagaaataatgttacagcctttttagattattgtggatattcttctttaatactgcctaaaaaatcaacaagtagttttttaaagtttagttgcaatgtgaaatgtgaaactttgtcagttaactttctatgctctgttacattaaaatgcattggtctatcttgcacttaaaatggatctttttaccagtgtatgattttgtaacatcatgctttggtcatttggaaaatattgatttgctgagttatgcatatcttccaaatgttgacacatctcattttacacacacacacacacacacacacacactcccttttgttaatattaccactgatctcatcagaaagctctttaggtattgagaagctgtcatagtggcagatagaaattttctacaattctaatttttgcttgaaagctcaaattttattattggccgcaaatattgtcaatctttcccgtgaaatgacaggctcacttcgttcatattctgcctaataccggggtctgaatcaccgtaattcatagtgggtttttcaaataaaaatgatatccatgaaaaagcagctggttctgcttgcaactcagccagccccaggagaacatgctcttcctggtaatcagcttatctttggttaagcagccaaaggcctttagccatacctcactttcatcacagataatttacaagacttgtgttcaagggccaagatttaagtaaaattaattgcttttactacttgctcaaggatattcttaagtgaaactggcattttttaaactgcacataaatggcggtgaggatccaaatgatgactaggacagtctggtgccaccaccagactcgtgctaaagagccagcagttttacccaccattgcatttgaatcatctgtgcagatgtccacacagtgaaaatgcagatagcgtcttagcagtattaggaaaatagctttgagcttaggtacttcatgacccagggatccatcaaccatagttggaaaatcttttaattaataactttgagtgataagtgtcactcaaacagcttagaagaatctggtttttttggactctcatgtttgcataaagtttgaacacttataaatttcttacttaatccttagatcaaattcctgaaacctccatttggtaggtaaattaatttaagttgctgtaaatactgaaagtcataaagtatcaatgcatgttttctcttgatgcagcttagcctcttttagcctcctccttccctgccctccgcccttcactgtgaattagtgaagttttatcccttcgtttaatcatgtgtcccattatctggaagctactgtgatggccggtataacgagggcacacaagctgtgaggctggtaagcctcgtgtctttaaggaacagaaatggtcctaatcaccaccaggaacgccctggggaatattcagggaggaatttgtaaacctcagtggctcacctatgtggtgttttctaggataaattaatgagcagaaagacaccaaccagcctcagcaaatgtattgatctgcacttaaggctccccctcccctttttgatagcatttctccatctcccattaggaccatgactctgggggattaaccctgtcttggcactctgggcacctccagggtgctatggcgagctcacgttgacaagtgcagaatgaagcagaaatgctgttcagggtggcctttggctttcattttaaaccgtcgtacttcccaaacacgtcttcccaagtgccaaaaatgccctttaaagtaacatttgagatgtttaggtatttccttctctacattttagacatgatcatttcctatttagttaaaaattattgatacacacttttgaaatgtgacctgttcttttaaactttattttaacatcagtaaaaataactttttttctaggtatcccactgctactagctttatagtcaaggcaggttgcttattgcatttccttcaatgtatatatggtaaataaaaataagaatgaaacactagttaattacaaaattattttatatcatgattgtatggtagtccattacatataaatattgttttagagtagtcaaatatttaagatattgattgatcatggaagactatagatttaaggtagaaatctaaagacagtaagacttgggaaaaatctgtgcattattcttactatttgaaggaaaaagaacatttaaattgagatagttcatggcactagttaacctaagagaaagtatggcaagctatcacgtgttcttaaatgattgagaagattttacccttaaaacccaagaaagctgcatttgcagaaattgatcagatgcagtttttgtgtcttcaggaggagttgtcagtacacgagaggtagagcgagctagaagtgggtcatgggcaaggccatacatctggtacagtctggtgtccccaaatcagggggctaataccttaatttagacaaacttcacctctacttgctactagtacagttacgaaaaactagacctaattccaaagaatgatgttgtgaatccatatggtctgcacttctggcccactggcaaccaggccatataaacttctgtggctgagcctgatttagcctgtctgcagcttcccatgacttctccctctggctgtcttttcttttattctggtctaaatttggaagcattgtgaggcagctttgacaggggtagattcacttttgtattttctttttgtggcgggtgcttctttcatcatccctagagtgatgatggggaggcagatgtatgtctgggcctggtctgggcttgttccaatgtgacagtcaggactcttgctctgtgaccacagctggttcttcaaattgaatgggttggaccatccccaggcagtctccaccatctttgcaagcttctgtggcttccagtgcttttgtagattgattttcttccccatttcatttggggactgtacacccaaggtagatggtgtgctgtgtgggactccagtgctcacaggagcttcctgaagggagctggggtccgtcctagagcctgtcccattgtagggattccttagatggaataggtggcttctgcactaagtttaaaggcccagccatgagttaatgtgtctttttctctttttttctgaatgtctttgttgaatgaaatgcttgctttccaactaactgttttttcaggggaagtttcagccccttgatcaagttgtggtggataacgtgtttccaaattgcatcttgttgctgaaacttcctggacttgagaagttacttcatcatgtgacagaggaaaaaggtatggtataacttaaaggcttatggctggtagaaaggatggaccttgcctaagaacgtggctgcttacagacacactgaatgtaaggcttattctgtgtccaccatagggaaaactatcattcagatttgctaacactgccagcactgttcctctattgctttggagtgtttagtctttggaactacaaccatggcagtctagggcctacgtccacagggcaggaatcacaaggtgtggcttcagtctcacttcttctttgaactagttctgtgacatcaggcaagtcactcagctgccttctgcctcagatgtctcattgtaaaattacgtaaaacctgtaccttaatagatggaagcatttatcgagcaccttccaaaaagcatatgttgcacattagtgctaagctctagatacttatgaataagacattgtccttttcttcactttgcgcccagtctgatgggggtcaatgacaagctgagcagtgaccgcacagtgtaacggaagtgaactctgaatttactggggatgcacaggacaggtttctaatctggcggggttgggtggggaatgtaggtgggtagatgttgtgttgctttcctgggggaaatgacctctttatggagtcctgaaggatagtcagagaagcagtgtaacagaggctcagatgtatggaaaagtttgtcaggttcaggaagttccaaggagttcaaagtataggattctggggaaggatgtaggttggtaaggaatgaggcgggaatgctgggcatgggtccagatggtaaagggccctgtgtgtgtttggactttgcttaatggtagtggagtgtctgtgaagttttaagcatggcagtctgcagtgtggagagtatattggagaagccaggtccaccaaggctgttgcagtgatccagacaggagataatggtggccttgatcttaggagatagaacaagaagaaagtagccatttagagatggacccaactgcatctggttgttgggtggtggtcaaggagaaggaggagtcaagagtgacttctcggtttgtgcctgacccaaaggatgtgtagtggtgggatcctggacacagggaacatgggctggaggagcaggatagggtaatgaagagatgcgttttcactatcattcatttaatttttcagagggaaaagtaaggcagtgtgtgtgaatgtgttttgacaggttagaaatagtataaaaacttggctttggtgtcttaaaaaatcatccaagtagtttcagggttaatatggaaacaaagtgtgggaaccagagcatcaggctgataagttgtggctgtttgggtcatagatggtttggccaactatgacagttcttctgggaccaagaaagtggtgattccaagaagtgtaagcttacagtgggaaagagaagaaccttattgattgcattttatgtttaaggggtccagtaaattcatacttggccacacttggagctccagtttggaactgaggggtatatggtgccagggttttatcaaagcagttccattaaagacattccctgatgctgagtttggcagaagacagcagtctttttgtgggtgacctgaattagcccataaccacttttaaaagataaagtaatgaagaataatttaattaagccatgttaatttttgtcaacttaatgcaagctgaaaatgcagttaactcattgtccagaattctgctattagctgtataagaacaatcatcttaaaacccagaaatccagatttagaaacaatgttagtgcctcagcatttgtttccttacagtctgcagccgagagcaagaggctctctctgtgtcatcccttccctcttgtacaccgaactcctgaccatttattgcatcattatctgaacttgtcttagtctcctttgcttctcaatattgcctaacttttggaagttctgtacttccattttcaaagtagctatattattagcctttatatttgccagatttcaaaaaccctaggcctcaatttttttctttatttttaagtgatgggcaaaacataaaatactttagaataaatttcacacagtaaaagatgtattcaatctctagaggtttggcagtttctttttatcaaattcttcccttaataagctgcagcctgtgaatctcaaaataatggaagttttaaaaacagaaagaaaaagatttttatttttatttttttatttttatttttttaagacaaggtcttgctctgttgcccaggatggaatgcagtggcacaatcacggctcactgcagcctcaatctctggggctcaagcaatcttcctacctcagcctcctgagtagctaagaccacaggcacaagccaccacacctggctaattttttcattttttttggagagatgagggggtctctctatgttacccaagctggtcttgaactcctgggctcaagggaacctcccgcctcagcctcctaaagtgccgagattataggtgtgagtcaccatgcccattctcaaaaagatttttaaatggggggaaaaatacgtaagattctcaaatgcctcatccttaagaagatattggaaaatcaaatatctaaaaattaaatatataaaacctaagcgggctttattgcaagaattcataattggttgagcatttaccataatttaccatatttatgcattacaaaattgtatgattatctcaaaagacacagaaaaggtatttgataaaattcagtcatgatatatattatcagcaaatgaagaataaaagggaacttccaagggcatctatggcaaacttaaacagctaacatcatcttcattgtaaaagactgaacacaatcttcccccaagactggatacaagagaaggatgcctgctcttaccacttctattcaccatgtggtggatgtcctagcatgtgcaataagacaagaaaaagacatacagattggaaagtcagtagtacaactgtctttattcatagacaatattgtcatgtatgaaaaaatccaaaagaatctacaaaagaagttactagaattgataagcaaagtttcaggatacaagttcaatatacaaatattagttgtgtttctatatactgacattgaacaattggataatggaataaaaacataccatttatactaccattaaaaataacattctagtgctaaatgtaacacaatatgttcaagaccaatatgctgaacattacaaaatattgctgagagaaattaaagaaaaattaaataaatggagaaataggccatgtttgtggattggaagactcaatatttttaaggtatctattttccccaaattacactataattacactatataattacattatagattcagtgtaatacttagccagctccatttttttttctttttttttggtaggtattgataaactgattctagaatttatatgactatgtaaagcagcagaagcagcagtctccaacctaattttggcagcaggaactggttttgaggaagacaatttttccatggatggggcagggagggggatggctttggggtgaaactgttccacctcagatcatcaggcattcgattctcataaggagcacacaacctagatccctcgcatgtgcagttgacaatagggttcgcactcctatgagaatctaatgccatcactgttctgacaggaggcagagctcagccagtaatgctcacttgcctgacactcattcctgctgtgtggcccagttcctcacaggccatggattggtaccagtacatggcttagggactggggagccctgatgtaaaggacctataatattcaaaacaattttgaaaaagaagaatttggagaacttacacaaactgaattaaagacttactataatcaagaaaatgtggagatcaggcacaatgactcatgcctgtaatcctagcggtttgggaggccgaagcaggaggattgcttgaggctgagagttcgagaacagcctgagcaaagtagcaaaaccccatttctacagaaagtttaaaaattaggcagctgtgggccaggcacggtggctcacgcctgtaatcccagcactttgggaggccagcgcaggtggatcatgacgtcaggagatcgaaaccatcctggctaacacggtgaaaccctgtctctactaaaaaatacaaagaacattagccaggtgtggtggtgggcacctgtagtcccagctactcgggaggctgaagcaggagaatggcatgaacccaggaggcagagcttgcagtgagccaagatcgcgccactgccctccagcctgggtgacagagcgagactctgtttcaaaagaaaaaaaaattagccagctgtggtggtatgtgcctatagttccaactatttgggaggctgaggaggaaagatcacttgagcccaggaggtcggggttacagtgaactgtgatcacacaattgcactccaatttgggtaacagagtgagaccctgtccctaaatttaaaaaataaataaaaataaaataaatttggtgttggtataaggataaatatatagataaatggaatagaatagagaatctagaaataaacccacacttatatggtcaattgattttttttttccaaaagtgtgaagataattcagtgggaaaaaggatagtctttacaacaaatgttgatggaagaatttggtatacatatgaaaaataacgttgattcttacctcatacagaaaaattaattcaaaatggatcactatgttaaattcaaaaatgaaaattattgagcttctagaagaaagcataggataaaatccttgttgtcttgggaggcaaagatttcttaggacacaaaacccactaactgtaaaaaaattataaattgtattttatcaaaagtattctcttttgtttttgaaaaatgccattaagaaaaaaggagattgtgagttgtgggacagttggaacttacctacctggctgtccacggcttaaaatgatatagccacttgacaatttcttacaactcaggaattctactactccctggtacaaagtaaggaactactgctagctgcaacaaaatggatgaatctcacagaaataatgttgagcaaaagaaattggacacaaaaagtatatactatatcatttcatttctatggtgttccagaataaagcaagaattgccctataatgatggatgagtggtgacctgtgatctgggtagccatgggagaattgactacataagggttccagggaactttgggggatgatgcttacatgactgcatacatttttccaaactcctcgatttgtacatttaaaatgggtgtgtccattgtgtgaacatgaacattgcgtgaacacctaaataaaattcatttttaaaacaatatttactgatccagcactagaagctaagcctcctgatttctaacacagtatttatttttacttgcccctttcccccaaaataatattggctccttttctctctatacttcctacctcccatgggatggagagatggaatgtgggaggcaaggccagtgtgagcactggctctgaggtttaggcctcgatattcaggagagtggtgtaggaggaagatgaaccactgggttttagacacatggaggcttagttcagggctttgggcctcccggttagtttgtttagtcttgttgatctaggaggagatcacaccagatgaaaggatacagttgactttggaggagggtgaagcagagctgggaaaagaatcagataagtcattagagacataaaaaaatagaaagcaattttatatatgccatggaggagaggttgttaggaggtactgaggaaagtgcagacctagtgatcttggtaaagtgaacatcagatccacagctttgatgtcagcatggttgggagttgggtgctcttgcctacttcctcagtgacttaggagagtttacttcatgtcactcagagccagtcttcgaagatggggacaaatcatggtttattaattgattctgagattcattctgatcattcaataagaaaatgtataaaatgtgcctagcacagacctgaataaacattagtttcttatgttttattaacaaatcatatttttcatcacaatatcttagctaatattatgtatttgctaagtggcaggtgttgtgctctaggatttgtatggattatcacatttcatgctcagaatagcccagtgagaaaaaaacctctctttacacatgggggaacaggctttgagcacgaggcggcttcccaaggagacagcatgtgctggggtatgcatgagccctggtagcatggctcagtctgtgctctctgccccttcttagagaataattcccagaggtagaggagaagcctcctagtggggctcagggagtgggagacaggaaggaaaacagcagcagatggtagacattctttgagaaaatttggaggtagaggcaagaaagaagtgagatgccagatcagggtaggattttcaggagaaccttgagcagtgagcttcttttggagtttttttttcctcaggcaatgaacataacttctaaaagccattcagcgtcatatatttatttagtgattgctgtatgctcttaaaattcccctggtttgtacatcggttgggacatgggctccagggaaattgagtccggtctcattggctttggcttacagtaggctgtttgcccaggtagtcctggctccaaaacagcagacattgcaccttggaattctgacactcctgacaatgcttttgcacctgtccctcttttttgttactgtagtgacatgtcctgagaagatggctgcagatgtccagcccccaatccatcctgcctcatcttgcctgcagcattgacaaccataggctgaaacagagaggaaattcacaggaactaaggccagggacctcccaacctctctcccatacagtttaacagactgcagaaaatgaaccctgaatgggcagttttcatttcccatcaaaaggtgggagggagaaagagcctcattctatataactcagaggtggtaaattcacatcaggcccaagggttgctagtggtcataaagataaatcctgcatggacagaggaggctggaatagaagtgctgcccttgctaattgcacagacagaagaaatcccatgaatgaaaagggttgcagaggaaatcatggtttaatgtcatggtatataaggctgggtggattgtggggaagttaagtgtaatttataagaggtgaaacttttatctccataaagggccagattgagcctaccataaatctaaatcttctcaaatagctatgattatgttggtaatatgttaaaagatagatagatctttttttaatgctcccccaatccccaataccaggccactactgagtagttaacaagatttttttcctgaatgtatgtagtgaacttcatagatacctgcatttcgtttcaattttctttattgggattttcatttttattttaagaaaaaaagtggttcattgaaaacattgaggtgagcttaaaattattcagaacagttaagactgcttagtatgctaatgtgaacacaaaatatctgagacaggtctcagtcaatttaggaaagtttattttaccaaagttaaagatgcacccatgacacagcctcaggaagtcctgagacatgtgccccacggtggttgggggtacagtttgcttttatgtatttcagggagacatgagacatcaatcaatatgtgtaagatgtacattggtttagtccagtaaggcagcaacaactcaaagtgggggtttccacgttagacatagataggagacaaaaggtggcattcttttgatcagccttccactgaatacacaatgtagtctggcttgagtgtggagccattgctagggaccggccctcttctgcccagaatttccctgcctcctgtccctatcaacaagattattttcctttcacattagtttgctgaggttttaaaattaccttttctacagagttgtttgtataatttgaaggttttcttaaattcttactcatttagtggttgatgactcctgaggtagccacattactactaacatttaaaaaaacatttcaagtatgttctcaggtttgtaaattaagcttttcaagaatttaaacttacaaaatattctttaaatggttaacttgtatatgatacaaccttaggagtttattttttttttaattcattgtgctgagtcttttttttcttttaaggtaatccagaaatagacaacaagaaatattacaagtacagcaaagagaagacattaaagtggctggaaaaaaaggtatagttcctctctagtgccttgtggtaaaagtaaaaattcagttctctaagaaattttcagagaaggcagtaagtctgaatccagagaccatcttgtatattcagtgaaaagaggaaaattgtgtagagataccaagtatgagaagaaggctttgactttttaatcctccctaacttctgtatctctgaagttagctttatgttttcttgtgacctgcattctcgtttctccctgctcctactacggaatgaaataatttgttggtgtagatttgagtcttccaagtaagaggataccaggcttggcacttgttggccactgtcagtcctgcaggtgtctccaagggtgatgcttacacacagccaggcaaagggacccagggacacagccaggcaaaggtgttcaggtttagaggaagtatgtcctgctctcagggtctggacactgatgaggggtcatcttacaggcaaaccctgtatcttagtgattctaagaatcttgacctaatggatggactggggcagtgaatttcaaatcaatttagtaggtaacaaccagtatttctcttggaatgaaacagattgtgatgggatgggacgggacaggacgggatgggatgggacgggacggacgggacgtgatgggacgggacgggatgggatgggacgggatgggatgggatgggttaaaatatagcagaggaagggcaggtattaagtatggctctgtgaaatgtatttatatgtgtttaagtattgggttgctgtatatttcttactatgggttgtgataaaaaaaaaactttgaaagccactggtctaaggataatatgtactttcacattgattaagaatctcgctaaaccatatagaataatgataaagtttttgcaagatcagtggataccagtagttgtagtactgtttcctaagattctcttccatcttttgtgtgaaaagtcatgtttgtctgcatgttctctctcataagtgggagttgaacagtaagaacacatgaacacagggaggggaacatcacacaccggggctgtttcgggggttaggggcaagaggagggagagcattaggacaaatatgtaatacatgtggggcttaaaacctagatgatgggttgatgggtgcagcaaaccactgtggtacatgtatacctgtatgacaaacctgcatgttctgcacatgtatcccagaacttaaagtataataaataaaaataaataataataaataataaataaattgtgtttatttgtcataccatgttaccaggctcattgaaagcctgggaagctggaaatgagtccagtagaataatcagtctcctaatgtgcaaagtagtggaaagatttagagtgccatgtttcattttttatttgtgatatagtagtagtagtattccatgtaggcgaagaatgagaataaatgcggagcagaatccttgatgtttacttttgctcttagccaaggaaaatgacatgaatagcgaagaggagtttatacttactgattatatttcctaggaagtgggaaatttatattattctatttaggaagttattacatataaattttgtgccaggttctattgtaagggctttatttacatatattacctcatttaattttcacagtagtcttatgaggtgaatgctatttttttcccccatttcacagatagagccacagaaaggttaagtaactagccgtggttacagagccaagcccagcagcctgactccagagtcagctctcagttatcacaatatgttgccttctcatattgtgtaggccatggaagtccatgtattgagatcatccagatattgctgccactcagcctttcttcaaatgggcaaccatttctcatcttctggtgtctggtgaagatacttctaggttctcaaatacttctttgcagatctcttaaatggtctgaaggccacctatgaattcatagatttctaaagttaagttgaaaataccctgcctttcccctcttggttgcttcataggttaatcaaactgtggcagcattaaaaaccaataatgtgaatgtcagttcccgggtacagtcaactgcatttttctctggtgaccaagcttccactgacaaggaaggtaagtaaagcattttatcagaaaagatttttgtctggagtaagttgcttatgtgtaaatgcctatcttaggatttaaaaatcttaatatcacagaagcctcatattcctaccaatgcctcatacacattgtggcaggtgtgcatcttatttcagaagcgaagaatatttctaccataggttacttctgtcattcattgatacttaagttatttattcagcaaatatttcttttacattgatagtagtaacaaccctggctatcatttattgagggtgtattgtgtgccaggccctttgctaagttgccactatacaaacatgatctcatccaaccctcccagtaaatttcataatgagcatcttgaggccctgtgcaaagtctcacaactagtaaatgccaaagctgagctacttatggagcttgtctctgaagcccacacttgtaatctttttgtgatactgttcctgtggcacagttgtactgttccagtggctgcatctgtttgcattttcttctcaagatgcatgtttcctgatacagggatcaatatattttgattttagatgaaaattgatttacttggcaatttttcttttaggttattcttttataatctaaaaaaggtatattattttcttttccaagtagagtcctcttatttttatatgtatagttgaataagaacagctatataatgcagttaacaatctcaaatggtgagacagaaattattctgacgttaaactccaattcattgttcccttattcagggtatacatatggctttagtcattacataaataaaaactaggaatagtggcctgtttgtgattgatagtaattcaggcaatctgatttgcaggaatctaccttgcatgtataggtagttggctactgccattctgggagtggtggacagcacctttgccatactgagttaccagctgtcagtgtctttaattggctttaacaatagaagatgagggattgagatagatgattaatggatagataggtgggtggatagatgcatccatggatggatggatggaaccatagattttgttttaaaagtaggagaagggatgttagaggttatttagacagatcatctcattttttaaatggagaggtaggtaacttatcctcaagatcttctgttctaagtctagtgcttttaccagtactctacatattaaggttctgggcttggctatattgccatttagtgtcctgaccataaagtaaactttacatattttacattatttcattttttagatatttaggttggtttggtaccagaagcagcaaatgaactatatgttgactttcttaaaatagttttcttggtctagtcatgactcattggataatgactatcccagatccatgagcaattttaagaagggtcaaatgataactttcagttctccattgacaatgaaaatctcttactgaagactttttgacatcaggtggtccccagacggcagtcattttctatgtaatactgaggcaaattgttactttgacttgagagcagaggagaatggaaaaaaggaagtgagtgaatatcccagcagcaaacctggggtctgcttttggtgctttatatccccacgtggttatcccatcttatgattaagtttgattatctgcttgtattctacataaaatactgaattcaggaacagagttttgaaacattttattgtcttcttatgtaactgtatttctaattgctgccagagctgcattttagtactgagaatccaaatgctttagaattaatgatgataaattctgctgagttagttgtttaagtttaagtattttattagtttgggagtgtgtgtgtgtgtgtgtgtgtgtgtgtgtgtgtgtgtatgtagaactatgtatatagaacaatatgtatgtatagaactatatatatatatttcagggttcttataaagcaaatacctagtagtagagacatggtattttatttctcttaaatgagtacactcattactgttgaataattagatttattctttattgaagcaggcttagaaaagattacccttttaaaaaagacatgactatttcatattgttgtagatgatttttaaactttatttgtattcagtggtttcaaataagaaagcaaccctgagtttttgtttttaatgtcatttagggagcatctactgtattatacttgttttatcttatatctttggtatcatcacatgtcatatctcatccctcatatcttcccactagtctgaccgatagatattactatccccattttacaaatgagaaaactgaggctagagcttaagtgagttccctttatccagatagggtcagaatttgaattcaggtcaatttgactataaaaccaccataattactattttttttttttgctttcactcctccttctgtttctttcagaggattatattcgttatgcccatggtctgatatctgactacatccctaaagaattaagtgatgacttatctaaatacttaaagtgagtattgattatcttcagtcataatgaagtaccatttgcttcttggtttccccagcagtggggtttccttatggcttatcatatcactgtttatgatacaagattattcttcagctatgtcatatactttgtgctttggggatgatttttaatggatgattggaatgaactgatttgatggatacggattgcaggaactagtgaatgtcaagattggaattatggcttggtctgattttagaggattaactatgttaaaattttatcctcaattatacttaactaatttggttctttgtgatcgttttaagaggaagaaaggagggatggaaagagtagatggaatatagacttttttttaatttacaaaatattgatatcattttcactattatcactagatgttcactaaagggactttatgccaaagacttggaagtcaaagtaatatgaaacacaatctgtgtctttgaggggcagaagaagggttttaagaatggtttaatgtatgttcctttctttataaagagcttatacatttagactttaagttgaaaaagaagtgttagaagtgtttattttctagatttttgcaaaatcgttacttaattttgttgttaagattttatgtgtgtgatgatttaatagcttttcctgatccttataaatcctttttatcctctgagtcatgaagataaaatgactttttaatagatacagttgttggttttagcaaattccagaggtcctactttaaaaaacaatgattggaaactggtttctataatagttaaagtgtgctgaaagcctgcttcaaattgataatcatatccttctgcttaatatatccccagatttctatgctgcttgtcttgttagagacctcatgtctttgtactccattgtttgtatagattcctttctttccactaacatttttaagttttggttgaagagttcagaagaaaggtatgccaattaaactgctttctaatggaagaaaagttgaaatttatgtggctttttgtgaacagttaaaatgattttcacctttaaatatatgttagcatcttcactatgaagaaaaaatactccaacaccgaaacacaaatttatagaggctaaagaaaaggaactctgttccaacagatgggttctaattttattttttagttcagacaacaccaaaacaaggacttacatatcaaaataaagactcatttattgagaaaactttcattctttacactgagttgattgaacaggaagatatatggaggtaaagctgtaagttgaaaagtaggacttactaagtcttaagttggccctgtctttctgtttgtttgtctatgaaaaacgatgactttgattgttatttttaactttcttaggcttccagaaccttcagcctcattgccaaatcctccatcaaaggtaagaagctgtgactaagatatctttgggggacttagaaaaatattacactcttaccacatgagtttagttggttctaatatattttaaggtgtactaaatccattttgcatggagtgatgccatgtggaataaagattgtactgggctctccatcactattttttatttttgtggattccacctgaatggtaaataaagtgccatgaaaacccaagaagagttggttttagcaaggtacccctgtgaaaatattaaagacatatagttaaaattaaatcttcctgcattagttagatcacttaattaaatttagtaatcactaagcatactctatatataactaaaactcattttgccaaatctaattgtcactggcacaaaggtgaacagaaaacaatttccataatacaaagaatcctttgagcaaagatgatcactttttttctgaatttgaaatgattgatgaatttacgtgtaatctttgttagtggaaaatcttttcctcattcattctcaggctgctacccacagctcctctgcagctggtatgtttatctcctagatccagagaatggagaagccaatcataaaccacacctgactgcaaattgcagcgttccttcagcccaggccagatctcagatgagttaaactctgctccaagacagggaaataaacatgtgcaccagcttgtcagtgaggtcatttcttcagccagcaaagtaacggatgccttgagaatgtaaaatggacatattgtggatgttacaaactttccttctcccttgcattgttttcttggccttcaaggtagctaaaatgctcataattttttatgtcattccctgtataaaggtggtggtggctccaaagacattgtccttagaaaaggacagaaaattgaaagtacagcagtgtttgtttgggcctatgttcagcatgttgtcaaaaaaaaatgcatgttttactctcttggagaatagcactgggcagaagtctgttgctgtaagatctaaggactgctctaggccagacccatgcgtctttcattccggtagttaatctctgacagtagctctagaggacctagagaggcacagttgtcttgctgaaactaagagggtaggttctcagcgtgcttcttatttttcttcatccaaaaatgaagcagatttttttctcccaaatatctatcttccttagtaacttagagatcattcatgaattgatctaaacctattcttgaaagctttaaccttggataccttttggagtaatatgtttcataactttattcttctctgctcctgatttctgttttcttattttaattttcagaatttaagttgtttgtgacttcatcatttatgatttagatcagagatcagcaaaccttttcttctaaagccagacagtaaatattttaggctccatgaagcagatggactctattgcagctactcaactctgctgttgtattgtgaaaacagccacagataatacataaacgaatgagcatggctgtgttccagtaaaacttcatttataaaagcaggcagccagctggatttggcccctgggccatcatttgccaagccctgattttgattttggcatcttgctcttcctaaaccccagccttgtcttctatattatttgagttgcttttcgaggtcttctactctgtgtctttctggggttccagtgtacacatgacaaactatactagacgatgtaccatcgtttaaacaagcgtagaacatatcttctgctagctttcctgtctgtatccaggatttgattgatttttacagtaatatagttgactgtttccaggaaatatattccagtagtcattaggtatctttgtatctatgttgtaatcgatagcgtggagcctgtcatctttaatatgttttatattattttcctttactatcatatgtctgcctttgttgaaactcagcttccaaccctcacttgctccagtcttttcaatttgtcactgtcagcaagcagagttgaatgcaaccagtgggtttggagatgttcccgagttccttcttgcaaatcatttgtaagaaggcctaacattatccctgtggtactctgcagtttgttctctttccagaactgtatccatttagtcatagcctttgttactgtctttctgagccacttctctgctgaaacaatctcccaaatccatagggatttggtcttttaaataacaaaaattttagtaaatgcttcaatcatctttttttccaatatattcaacagtgcactgggaataacatacaaactagttatatgtagaggctaccacaatcattttctttttttaaacacttgtaactggtatcttgttttgttgtgagctattaaaacacctgaacaagtcatttctccaattaaacattttatgtccatacaaaagtacctttcatcttaagttcttgtaatgaacactttttatttgaattatcaatgaaaagtgaacctcatcagttcagtggcacacacttgtagtcttagctactcaggaggctaaggcagaaggtcgcttgagcccaggagttcaaggctgtagtatatgatgatcgcaactatgaatagccaccgcactccagcctgggcaacacagtgaaaccctgtctctaaagaaaaaaagggaataatgtctaagtgtttataatgacatctgtgttaggaacattttgccatagagaaggaacacaagcatcctcataacttcaagctttttgtgttttgaaaatattttggccttcagcattattagctgtgagtttcaccctcctagctgaagatacctttctagtaaaaaatgtgcatcacctaaacaccctttgctgtcttaatttaaatagaaacatgtatttttttttttgagacagagtcttgccgtgtcatctaggctggagtgcagtggcacaatctcagcttactgcagtctctgcttctcaggttcaagcaattcttgtgcctcagtctccggagtagctgggactacaggcacatgccaccatgcgcagctaatttttatatttttattagagatggggttttgccatgttggccaggctgatctccaactcctggcctcaagtgaccgcccacctcggcctcccaaagtgctgggattacaggcatgagtcactgcaccaagctgaaacatatattcttaacaaagttgcaaatatacattcacttggtgctgataggtggttcatttgtgatggattagtctttttcttttaatgattcatttgctagaggttgctgtgtggccaagaggttttcctatagtgtgtggtatattcccaggatgagcctctgtttttttacagcaaacaattttaagacatggtgttttatcctcttgggttatgggataaaacaccatgggctgtggaatcttttagcaccaactctacccgttctttgtttagcaaagcaggggcatgaagaatgaagctgggaagaagtctgtttcctaggttagatccatgttgggtctggtcaacctggtgtctccataaacagcctgaaaattataaaaatctgggttgtgatcaccatgcagtcaattctccatgttcaacagcaagacttgtcttccctgcttttgtaccttttacataataagtgtggcatgatttcttctatattgtgatcattaaggccttgacaagattctcacattcactggtgtaaaatgttcatgtgaaaggagaaaatattaagtaaaggtctgacttagttgcattgggcctaatggaaagaacactgtatcagaattgaaatcttggccaaagtcctctacttggtgaccttaagctattcatttagcctctctgtgcttccctctcttactggctgcttgcttgtgcaaggttgttcttgcatggataaagtaagataaatattgtcccttcattcataagtggacattaaactggcccaggaggtaaatgaaatagggattctggctggacacctggcccccttcaagagactattctcattttgacttctgtgccttgcattcatctggtaattagcaatcccctcatgcccaccacacctggcacctacaaagcctgtgtttgctggaccagctaaggggctcagccatgtacttacccaatcatatccaccatcaccaaggctgcttcttaggagtgatgtgtggctcaattccctagatgattggcaaaatgtaaaggagcctgtaaaaagtaagccctttgctgggtctgctgtcccattcgcctctgtagaggtctaaattatacatgttgggtttttttttaatggattgatgttgtgtcaaagtgacatttgacaccacttcactgctctaatgttgcagaaaataaagttatcagatgagcctgtagaagcaaaagaagattacactaagtttaatactaaagatttgaagactgaaaaggtatgtgggttcaggtgtagtggtgtttcgttcatactcagtgcgtgatgtgcatgaatacatgaggaacagttgcacgcttgattgtgattacagttttgaccaggaagaattattaacttgcatttctgtgacttaataattaagaattgcatatgacaatgaaaatgttaagcaactaagacttattattagtcagagaaaaacaatatactacttatcaagagtgtgcctaaattttgctatgtattcatagagtgatagggtgggaaaggagggaggaagctctacaggtaattttttgtcaaccctgctgcccagaagcagaaattatgatgataaaaattaataatttcaccattcagcattcaccctggcaaatggcattttggtaacagtccttacttagttttatacatgcattataaatacatatgtggcctttaacattggcattataatactcagttctgggctttttatttaacattaaattgtgaaaatgttcacatatcattaaacattctttgaaaaaatattcatgtttttatgatattcagtcatgggtgtttgtttcaccatatggaatgtaatttaatcatttccctatatttggacatataggttacttctgatttttttattttttgtttttattgaagtgatagacattcttatttacagtctgtatctccaatcatttcattagacacaattttgaactaagactaagagcttggagaacatgaattctttcataattgaaatatatatagctaaagtgcttttcaaaaatggagaaagttgtgcttccaaacattattgccaatgagtatttatcttgcatttttgacgacattgagtattgcttttattcttgaacattgttgcctgtcaaattaggctacatttctttaactagaaaggttctttttccaaatgcttatggcccatttgcatttttgcaaattgttggttcctgtcgcttgcctgtttttatgttgagatagtaatgtttctctgttgctttgtatgagctcattctaaattaaggctattaacacttttcatgaaatataggatacaaacttgttttaactttttcatttgattttttaacagtgttaaatttttctgagtgttaagtacagaaattgtttccctttatgatttttccattgtttttatgcttaggaaggccttgcccatctcaagataagttaactttcacttagattttaaaaatactaactgccctttgagtttaatgttttttagaactgttattcttgaatcaatatgtaatttatttgggcatatgatactgaggatagttcgatttaagatctgcccaaatagcgagttatctcgatgctgtgtcaacagggacattgtcagtttctctgagagaaatctttgtgccccgcccttctgtgggagtgccacttattgtatccacttgggcacagcatggagaatgtcttaaatgcaccagataagtctgaaacagactgttgctttgcaccattgagtcaaaaataagcctactaaattataagtgacagaatgtgaaaagcagaattgtgggaatcatatactgtgcctctaaaaaatactttatcaatgactttgtcttacagttcccagggagacaggtgatttttttgttttctgattcccatcatttatgcttcttctgaacaatttgtggtgcatctgcatcaaagttaaatcagctgctatttaccttctgcaagtgctttatataagacatggaagaaaaaaattcagtgaccagagagagatagaaatgtacagggcagaattatttggagtcagctttttggaaagtattgctttgttggaggaaaaataaggcagctatcctgctggtctgggatgctttgcaacacaagtcatcttttgaatatcatagggttgtccttggtttcccatggagcaaatgaataaaatcagatggtaaattggtgtgaattattcatcatgtggtaatacaaggctgtaattcctacctctgacaattgcggcctgtgtcagttccattgtttgtgttattgtactttatgcaccctccagaattatctaccccctccccagtgtaaaccattggttggaacattctgcttcttagaaggcagcagttttgtcttctgcctcttttaacatattctgtctcttaggtctgaattctgaatagaaatcagaactttttcactcccttatgaagcatgttagtgggggatgcttaccttccttaatgaaacttgagacatgcagtcttctttgatttccatatatgattaataaatgttacattcataacaatttttctctcttattttcattaacagaaaaatagcaaaatgactgcagctcagaaggctttggctaaagttgacaagagtggaatgaaaagtattgataccttttttggggtaaaaaataaaaaaaaaattggaaaggtttgaaactttgaaaataaaatctagcaaaaatatttgctttttacatgtttcagtttgtccttcctgactgttaatgactacctttggttgggggaaggaagaggccaatttcatgttctcttaaacatttctttgcatttggtttttgtgttcctgaacaaaatatgggaaagtgtctaacttcatggctatggccttttggagtctcatctgacataatgaaaagtaatcacttgaagagaattaacatatagcatcatgattttctcaataaactgatgtgtgacaatgtta

SEQ ID NO: 692 - DNA, 60783 bp, Homo sapiens
ccgctggctagaccatggagggccgctgggtgcagccacagagcgcggggccccggcgaccccgccccgctccgcgtcactcggcgccctgcggcgcgcgatgagcacctaccactagcggagccgcgagggagaggccgcggccccttcccgttgcctgcggccaccggccggcattcagagcccctcgcctggcgctaaatttaaaaacgtaacacgagcagcaggctggtctcggaaacgaaacgaaattcggtccctgggcctcctcccgggcgctgccggtccctcagcgcgccgcgccacccggaacagacccttctcccgccattttcggcggggctgggagactgaggcccgcggcgctgagcctgcggcgccccggaagaggcgggcggcatggccgctggcgtggactgcggggacggggttggcgcccggcagcacgtgttcctggtttcaggtaaacacgcgcgcccgggcggcggggtcggcccaagaactggcggagcggcccgcgaccccgggcgcgccgccccccaccccggtggctcccactacccggcccggcgcgggatgggattctctctgggacagctggccccgcattttggtcacacgtcatagcaagccgcggttttcaaacccggaagcgccgaaaaggaccgagcgtgtttcccgggccctgatccccggtggctcgggtgggagggtggaagccgactcagcctgaggggagccacgcgggttcgcggtcaccggtgcgctgcgggccccggaggtttctgcccttggtgtcccctacctggcagctggccctgcttctgtgatcctactgggttggaaccagggatccagtaggctcgaagtggcctcagacggtgcgcagttttaagaaagcaaagggacaggcctgcagtggcgaggcaggagggaagcgggatgggagtcgcggttaggccaagggtagttcaaagcgattcagcaggatgatgaccacaggagtgctggagccgggcctttcagcccccgtgtggatgatgaccggccatccaggacatgcgagggcttgggacagtggacagccagtgccacacaaggaaggaccgattaaatgacacagttaaaggaatttggcctagggagtgcaagccagaaaggtttggtctttttatatatgtaacattggaaaaaaggaacatctcctgttccctgtattaagttttgactttagctcagcaaatgcagtgtttgtggcagtaaatatactctgataacaatattctttcccaggaatttagagttttatgatggttattgaaaatgtttacatgacaggctgtcaataatattttttgcctctaaaaataaaacatacataaagtgtacggattttaagtatgcaactcactgaacttttcatacgtatacaccaccctagtaaccatcccccagttcaagatgtagactgtttccaataacgcctcatgcctgttcctagatagccccaggaacctctatgctgacctctgtcaccagagattagttttgcctgtttgaataagagtgtaccctttgtgtctggcttctttcactctgaaagattcatccttgttgtgaaattcattcatgttgtagcagttgtttggttggttggttagttttttcattgctgcttctgtttaattgtatgagtatccatactatgtatctctactgtggatggacatttgggttgtttccagtttgcaactattacaagttacacttctcagagcattcctttaggcggcttttggtagacatgggcactcatatctctagggtgtataccctggagtggaatggctggttctagtacttgtgtgtagagctgtagttgacaatgttaaatggttttccaaagtggttatactgatttatattcccacaagcagtgtatgagagttcccattgctgcacatcctcggtaaaaacgtttgggtggtaaaacagctaatgcaaaattcagggttttgacagaatctcgcaaagggctacccgtatacatgcttttcattagaaaaatcatcctttcttctcacttcgtcacatcaagacaattagattttcagagtaggaactctaatcattctttcagaatcaagtgcattattgttatttcagatatacacaatagctgatgataatttgagcttcttattttgttgttctgtttaatcagtattgacatcgtcattttatacgtgtgtttgtgtccttgtattaaacacaaaaccctcaaaagaattaaatattgattgtatccctgaaaattgtaggttttaatatatctactgctgggttgtgggaagagtttcagttgagtttctgttcagagctgagatctactgtgaccttttaaggcattgggggaggctgagcagctgttggaactgctagaaagagctgtgtggtcaggggggcaggaactcttaacagttaaaaacttgagctaccagctcctgcaattcttccttctggcctttagcgccacctgcaggctctgagggtacaacaaggtttgacagcgactgcagtgcaacactagttctcaaacttgagggcatcatttacctggggagctgggcctcagttcccagaggtgctggttcagtaggtcctgggctggggccagagaatgtgcattggtaacaagttcccaagagatactgatgctgctggtccggaaaccactgcccccaccccaggaaccactgcagtaaagactttgggaactagattgggatataagaatgacaagcctcatgtttggccctctttgtggtgggccagaatttatatggtcaaggaagtgcatgtaagtgcagagtgtgaggctcatcttcccagatgtagttgtcgtcttttccagaagatgagaaatcagcctgcttagttacccattcgggagttggaaacgatatgcccttggctgagggagcaccatactccagtaaagctgggcccttaataaagaaaacaaagattattaaacatttttcaaaagtatttggcggaggcggcttgtattcggttttagaaaacttgggatctgaagaacttactttgtgtactgaaaagtgagcacatgaacccacaggccaacagaactttaaagggatttatccgtgagacaagggtaaagatgcctaaccttgcaatgatacttttttccaacatttaattcatgctgttcatcgagttgcctgccacagcactgtgttatatcttgaaggatatatttaaatgtttgatttaggtatctttgcctctagttttcagtttgtttggagaagctggctatctcagataaacaaatctggaacttggaagagatactgtgagatatgcagacttgggacgttggttttcataggctggtgaagacagaaccatttcccatttcagcaaggcaagcatttcttttagtttgggatggtcttaaatgtttctgtaaaatggcctgggaatactagcctgtttgcagttttaatttctataagaggccattactttactttttggaaagtagtataagtttccatccctctttttctgccctaaaagtaaatgtttgagtcatatttttaatgtttttcttaagtccatttttcttgttaatgctactaagttgggatgtacccaggtgtgagaggtcacctgattcattgcgtttagaagactgcatttattgctgttgggggctgaacaattaattgggttcatctccaaggaaatgttaattgggaaaccctaacattgtgtattgaaaaaaaaaaaaagaagaaaaatcatttcaggcctgttaaaacaaaactcatttgggttcacttaggctgattaaaatattccttaatcagccccctgattaaacagtcctgaggtgaaactgcacctcaactcgaattttcagttagagacaagttttgcaataaagttatccccctttatttcatgaatatacatgttaaaaagtattttaggaaagattgcacttattatttatttctccacagaaagcagtttcatggaggtagaggatgggttgctttttgggagataagaatccctgtctaccttagacatttcaaatacaataacagctttttatgtgaggcatcgtgataatcacaaatgattataccagagctatctttccaattggaatgcaaaaatagatgtggaaggattgtataaattcatgcattagaactatgttctaattaaaggatttaaaaaataaatttaaaaggaaaaactaattttcttatttaatgatggagaaaatttatattaatgttatttctgattacagtcttgaagattttttttttttttttttggtccaccaactggcataattgtagctttttataagtccaaagaaatgcctcttgttttgggggaggaaaaaaagtaaaggtttaaagtgtatggcaaaggaagaactactatagatttaactgacttttcagtgacactaaaaaacactcttttcccttctttacctaatggctcatggttaatctcagaagaaaaagttaagcaggatttttgttctttgtcaaaacggtatgtatgtatatgtttgtgtttagaaatatacgtgagggccgaaagcttccttattttcagaagagatgaacttcacttggcacatgatagagaacctggccaattcaagtgctgattttagacaacctcggaataattaagctcagctttttggaagatgtgtcatttaccgaatagtctactgcaggcagtcagcagtgtaggagtctcagagttttccagcatagagcgtgtttaacattttccacatgaatctcagtctggctttgtttttgcaaaatgtttttcggtgggacccgactgacctttctcagatggccactggatctgctccccttgctatctatctgagcacgttctgaagtggatggacttcagttgccagttggtgtaatcaggctgtttccagagtctgatcttgtccctttagtaactgttccaaaatacttgggacatttataagtaagaactcatgactcccacatatttatcctccaggtcagaaaaaaattcataaaaggaaagcaagcagtgttcatgattttttatttgagtaacagaatagggactgcatggattctcccacatcctctgagactgtgattttaaaaaacaaacaactcagtcagtgtgctccaaagcctggctataataacacagacttaaaagctagatttatgctatttattagctctgtgtcattgggtggtttacttcctcactataaagcctcacttttgtcatctccacagtggggagaagagtaccagtctcatggggttgttatctgtggtttgagttactcataagctttcttacacctcaagcttttagccctgggcctgggacagagtagatatttcaataaatatttactgaacgaataaaagtctcacattccatttcttcctgcaatgtctttgcttattctgctttttcctccccttctacttctatccaaattctaccctttcctcaaggttccattcaactttattttccacaaagctaagccatttgctccagctcagcttctccgtcttgactttgtgtctgcctggaatcctgcctgctcttcactttatctacctggcaaattcctacttatcctttaaacccagctcaagtatcacctctaccaggaagccttcccatgggtctctcctcttgttactgcccaggttcgtggtacctctttgaccacctacacatttcatcatgattattcatttaagtgccatttttatataaatatgtattgaacacctaatacatgccaggagctagagagagtccaagtgtgttttccctgagtggccatttcgcttctcagtgtgggcacctcagccttctgcttcagagcacaacctccaaacagtagagcatgtcacgtaggatttccaggcctttattcagagctacctttatgacttccttgtctaaggatgactgtttgctaaagcagaatgggccaccccgtggcaaggggatgtaagggatttggggctgcatgttctagtccctgtttcattatctgtccccgaaacagctaagctggaggctggcttactcctccgagggcctaggtctcaacatttggtaaggctctcctgcatgattggctacctttgcctgattgtttttaaagattttttgttattgttgttgccttttaaccttcttttgaccagttaactctacatttacacgtttttctcacagtggtttttttttttgataactttaaataattagaataataatatttacccagtatagaaattctagtaatatggggaaaaaaataaagaataaaataatttgtccatcatcctcacccaaaataaaaattttggagatatttctttccagttttttcatgttgtttacattacaaaatgaattccaatcttcttaaatttttttttcttatttttctatttttgcctttatttcattgtttacccttactacttatttaatgtaacactaaaacactcagggagattggggttacataaaagtttatatggtgctgttctacataaaattggagaaagttcagttgatttaatagaggtaggggctgtttttttcctcttaattttgataaggacagaaactcacacagtgatatgaaacaagttgacaaagagaatttgtattttaggctttgaacattgaagaggtgtaatacttattgcttcagacagtagacagtacatatttggaatgggttatctttgaaagtggataaagattgaaaatacaaataggtgcaaaagaggtaaagatacatttacagagctgtattggacccaatggcaaactaggatgtttcaaaagccattcaaagcaggttacatttttgaggacaaccatagcctcctgcaaacatcccttggtgtgctttcctgaaaccggatactggtttgaatagcctgtgagtctgccttagtatggaaattgccattttttaatgtggggtcagtgcacctgggttgtgtgttacaaaatcaaacatgaacttctttgggagttccttagcaggttcacatcctcccaggaaggagcaggggtggtggagagcataggacatctggccctagggtgttgcagcagcaggagtccagggtttctgcctctctgagtgttaacttcctcttctcaaactaacttcctgcatttagtgaaaaactggtttcacgtgattcccaagctgcagatccccccagtgtctgctgggaggggtctctcctcttagttccagtttgaaacctttcaaaacagccttctgactggtcctgctgtggtcacatgcagtcccaccctccaccacctattgtagccagggaggggcaggctgtaagcacaaggtgggagaggaggaggacaaagtgggcacttgaggctaaagagtgcttttctggaagaaggaaagggtacaggatagacagcagaggaactagctaccacgtcgtttcaccagtgggactctgagctctggccagaaacctcagccactcatgagctgtcttgcctatggccaacattaggggtttctcagttgctggtagtctgtttgactggcttgtatataggtatagcagaggtttatttgtatggagaattgggttctagttgtaacttgtacttgccttcatttagtcaaagtttgtataatttttaggaagcccagcttctaggcctgcaacttctagctgttataactttgcaaaacactttcatataattgtatttgaccctcttgatgaccttgggaagcagttaaggcaggctttattatcaccattttgcatatcaggaaaccaagactcagagaagtcaagtaatctgtcaacatacaatagaaatccagtggcagagactgtcagctctctcaagtccttttccaggactcctgcatgtgccagaggccactctgctgactgaataatgatgcctcaccactgtgggagaggccagaggaccaggaaaggctggtctcaaactgctctcagtttgatgactagggaccagacatacctccttccctggaaccaaacctggttgctctcagtcaccccaatcaggtctgtcttttctagcactccacaatttttcctgcttcccacatagttcatgctccatccatgctccatctcagtatgtttgctggtctttgtggctctgagttggctgtgaacctgaatatttttactagcttcttcaccagtgcacaggctgttcctagaaacatggttgttgatagggacagccctgaaagaatggagattttgtcttctatggtcctgctgaaggctagtttctaatttttatatttatttatttatttatttagagacagagtctcactctgtcgcccaggctggagtgcagtggcacgatctcggctcactgcaagctccgcctcccaggttcacgccattctcctgcctcagcctcccgagtagctgggactacaggcacccgccaccatgcccagctaattttttgtatttttagtagacacggggtttcactgtgttaaccaggatggtctcgatctcctgacgtcgtgatccgcccgcctcggcctcccaaagtgttgggattacaggcgtgagccactgcgcccggcctctaatttttatttttttctccaaagcttcaaaagaaagttacacttagaggaatctattacttcagtaatcacataattttcctggtgcatgtctctcttgctttcttggtttgcctcttgtagtctttgaagaaacaaagagcttcaaagccaggaaaatgacccagatctctttgacagcagtgctaatgttttgggaagtgaaggcatatagttattactgaaattagtgttcctggaagctgcaagttacttgaaaattatgctgatttgtcttgcatgcattgtatttgtgtcctaccaaagtgtttccaaggaagtatctggcaaacaggcaggagggtgccggggcagtgggacggggagggtctgaatatattctgatggctgaagtctaaagaaaatgaactggaacctatttaggacatcgtattgcataagcatgagagtgataatctcatctctctttttcttttttctattggatcttcttaagaaacctgaatagccttgatatgatatctaaaaataaagtaaatggtgctttgatgtctgtactttctcctccatgtaacagtgggtgtatgtttctcagagtttatctcctgtgtgccaaaaatcagagaggctcaggaacaagtgtccattgcttccaagtcataagaacaattggcaaaaatcacttgtcttgtgtctttgaactttaaatgcagtgaaaaaacttgtcttaaccaagagagggataagaaagagctgccaagtttgaaaaacctgctgataaataacttcataccaactgtacaacaacctgtactatatagtctgtagatgaaaaatcatgtaccattttggcttgtacaatactttgtggctaactttaaaaaatacggaatggttaagtctgtgcattaatacgtgctgtgtaacctaacttctcagcattataatgtcacagatatctgggggtggtggggagaagtatatgcagctatgtatagaatatacacagctctccctcctttctcttccttctgccccctggctgtgtggtctactggctggattgcaatagctggattgcagctggttagatgactctgctggtttttgaggatgaggaggacaggacaagagagggaaaattttaaatgtttatatcataggagaatagtcatgtcagaatcattgtgtttccaagctgcagtttgtgctttttaagttaagaggtatgggacttcagattaagagtttctttacagtattatagtttaaaacattggctctggataatagttgactgagtttaaatcctggctctatagttgacttgcactctgaccttcaggcaggtttttcatccaaaaaagtggaaattaacatagcacttattatgtgaccaatatagaggacttaaacagtgcctggtagaccgtaaatggccaatacatattagctgttatttttgattttacattcattagacacaattgtctctttgtcactggtatgttttctttaaagtacagatgtcaggaaagtagcaatcagagattccttgtttgttgagggtgttttgttttgttttgttttgttttgttttgttttgttttgttttgacagagtcttgctctgtcgcccaggctggagtgcagtggcgtgatctcggctcactctaactgcctcctgggttcaagtgattcttatcaagcgattctcatgcctcagcctcccaagtagctgggattacaggcatgtgccaccacacccggctaatttttgtatttttagtagagacagggtttcaccatgttggccgggctggtctctaactcctggcctcaagtgatctgcctgcctcagcctgatttcacaatactgggattacaagtgtgagccaccgtgcctagcctgtggaagcccagcagatggaagatttgctgccagagttaatggtgaccggtgggatatacaattgaatctttacagagaatatagagaccatgagataactactctggaatcagttagttttaaggaaccacaggggcagagcttgagataattgggaagtttaacatattattaaacctaaaatggccagcaagactgatagctgcttctcagttgtctgagttttttctttttttgtgaaaatacttttttagccagcatgacttatgtcatctcttagatgagagaaaagagtaaaaaagacaaagtgtatagctactcttttaaaaatagtgttggaagcatagttttggaagaaggtgtctcacatgagtcaattttctagacaagtgaaatttggctcttttagtatcaaaacttgcttttataattttttattgagttttttctaaacttgaacaattcatttatgttatgtttattgagtatatctcatgtgccagaaacactactgggtactttacattgccttgatttttacatataaaatgcattgtgttctggcttttaaacaagatacactggttttaatttaatattttcttggaagactaattgttaagccgttatgtaactctgtgcttagatttcgtgactttcatattttgatcttattattccctacgtgttctcgactttttccacgtagttgagggaagggttactgattgttaattgattatttattatgtgttctaggcactttcacatacatttcatttcaatctaacagaaacatgtaaaattattattatacccattttatagatgacacaatgaaccacagagaggttgagtatcttgcacagagtcacactgctgagtgaggagaggagctgagattggagtatggacccttctgattctgggtccaatgttctttctatgctgacatcattgaagaaatagacataagttaaaagtaggtttatagatcatgacccttcctcacactccctctttcttttctaattctttcccattgctgtaaaagcagggttttcttctctaattaatttagctattcttcacctgtgctagatgcaagtaaaagacagcagaagttagaaaaagggtggagcctccaaacctgttgggtgagaggctggtccatgaaatgacccaggattttctcagagtaaatggaaaatctttaactttgatagagttaatttatagttacaagtaattttgtgtgcctaataccaggtatagactaaggaatttatcagaaatattatagtaaatgagccctttttctcataccaagtcttcaaagttcagtgagggtaaatccaccctcccataaaagcaatgaaaacactagcaaagatagcaaaaagcaactttttcagaacccctgagattagccaaaggcttccaatagtttgagaagtgtttattcaagaaaatcttctgaatcttattaggaacagcagggtttgtgggattgtaactgaactactcccatttcctctcctcagctctgcaatagccttgaaaaccagcagtcttgcaaaacttgtaaaaacggtacttgtaaaaaccaacagccttcaaccattggctaggataggcctggatggaagatcctcaagaagtcccattcccagagcattgtccctatttgacttttctcacagctccttggaaaagtctcatttgcagggcatagttgttatttgacctaccttggagctcagagcttgctctgttcccacagagccctatcttcagggtatttgtcaaaaacaatcagtgacaattgtttaacgtcgtagcttctgaggggtcaataccagttgcgcaaataaaaacctggccaaaaacttacgggtaagatgtgaggaataagatgtccataagaggcttttaaaaaactcttttgacatattcctagaggattagaaggctacacacatatgcagggctatgtgcatgctcagaaggacctgagagggcctcagtgtctcacctctgactgagtatgaggtccggagaaggcaataaatacaagctaaggcagaagattaaagtgcccaactgttgaaggtatgccttaacacacacacacaggacccttcagcaaagattggatcacttattggttcacagcatcagctaaccactaagctaactaaacagagacatcagtggctgcacaccacaagaaatacagactttacagaattagtccagaaaagtcactaaacaaacaaacagcaacaactgcaataactacaaaaaacagcaataacaaatcctggggagttgggagaggagagtctgatttccagaattgccacatttgttattatctgaagtgctcagttttgttttgttttttaacaaaaagcatgagacatacatacacaaacaagacagtatgacccatacacaatagggaaagtagtcaatagaaactgtctctgaaggggctgagatgttggatttattctacaaagattttattcagctactatcaacatagtcaaagaactaaagaacatcatgtctaaagaatgaaaggaaagtatgacaatgaagtttcaccagatagagaatatcaatagagaaattgtaaaaggatctaaagtctggatttgaaaagtataataacaaatgaaaaattcacttgtgagctcagcagcagatttgagctggcagaggaaagaattagaaaactcaaagacaggccaattgagattatccagggtgaggaacataaagaaaaagaataaagaaaactgaacctgaacctagtcccagagacctgtaggacaccatcaagcctactattatatgcattatgggaatcccagatgagaagagaagggtggaagaggaatatttgaagaaataatagccaaatacttcccaaatttgatttaaaaaaatacttgtctgcacaactaatgagtgcaggaaactctaaataggataaactcaaggagatccatacctgtgtgtgtgtcgtagtcaaactgtgaaaagacaaagagaatcttgaaagcagtaaaagaaaaatgactcatcaaataaaagggatcctcaataaaattaacagctgacttctcattagaagctatggtggctggaagtgagtgggatgacatatttaaggtgctgaaataaagagagtctcaacaaagaattctatatctgttaaaattacctttcaaaaattaggaaggaaccaagacattctcagataaaggaaaaaagaatgtgtcactagcagacctgtcccacaaaaattatgaagggagtccttcagattgaaaggataaggcactagatgataacttgaatccacaaggagaataaagagcactagtaaagataaacacagaaataaacataaaagcacaaatatatttttgtaactcatttgggtgatagataactacatagagcaataattatgaactgtgttaacaggcttataatatgtaaagatgtaatttgtatgacagtagcacaaaggagaggagaggaaaaggaatatgtgcagaaaacttactactcttgaaactcagttaatattaatctgaactacattgtgagttaagatactaattgtaattcccaggataaccactaagaaaataactcctttaaataaaagaaacaacaaggtatcaaaaatggtaccctagaaaacatctatttaactcaaaataagacagtaataggggaatccaaaggaatatgacatacagaaaacagagctaaatggcagatgtaaatcctaccttatcctaccttatccataattatattaaatataaatgcactaagcacttctattaaaaggcagagattggcagaatggagggaggaaaactcctgacccaattatatcctatctactagacacacttacacacactttaaatttaacaacaaaaatagtttgaaaataaatgaatgggaaaagatatacaatacaaacagtaactgaaggagagctggagtggcaatactaatatcacatgaaatcaactttatgataaaaattattactagacacataacagtctattgggaagatatcataattataacatacatgcacccaatgacagagccccaaattacatgaaccaaaaactgacagaactgaagggagatatagacaattgaacaataacagtgttttttttagagaaagagtctcagtctgtcacccaggctggagtacagtggtgcagtcacagctcactgcagctttaacttcctgggctcaagtgatcctcccaccttagcctcccgagtagctgggactacgggcacatgccaccacatgtgtattttttgtagagacagggtttcaccccgttgcccaggcttgtcttgaactcctgggctcaagcaatctgtccaccttggcctcccaaagtgctggagtacaggcatgcaccaccatgcccagccaagattttcttttaattactgatttcaaagtattattgtgatgtatagttttattcctgtttcttatgctttgagttcattgagcttcttggatttgtagttttcatcaaatttggaacatttcagacttactttcttcaagttttttttttgttccctcttctccttttggaaactccagttatacatatattaaaatgcataaagttgtcccgtagtttactaatactcttttttcttcaatttttttctctgtgttcccattttagatagtttctattactgtgtcttcaagttcattaatcttttcttcagctattaattttatccagtgtatttttcatctttagaaattcaatttaggtattttttttttgcaatcttctatgtctctaattaactcgtctatgaggattgttgtttttaaagcctttgtctatcaattctattatcttgtatattaatacccctctttcagtaattgattttgtttactcattatgggccatatttttctgcttctttgaatgcctcatagtatttgattagatggcagacattgcgaattttgtctttttgggtgatgagtattttgtatttctataaaatacccttgaacttcattcttggacacagttactttgaaagaattggatacttttaggtcttgcttttataattagtttggtaggaccagtccagcaaatagttagggctgactcttccctactactaaggacccttttgagtactatgcctaaagctccatgaattgtgaggttttacagtctgtctgggagtaggcacaattcaagaccctgaggaagtatgaggtactgctccctcgaatctgtttagatgggttttctcctggcttttgggtagtttcatcacatgcatgcactgatcctacttaagtaggaccctctgcagatctctggggtcttgtttctttttagccctctcctttcctgtgtgctgacctgtgaaccctaaccaccttggtgtctctggaattcttagcatcatctcttcaattcagtgagtcagctaggctttactgggttctccctttctgcactgtggcctggaagctcttttaaagcagtaagctgggcaatcatagggctcatctcatttgtttaccatctctcagggactacggtcctgcatggcttgtgtgcagtgccttgagaatagttgtttcatatattttgtctggtgttttgtgggtttttgttgttgttgttgtttcagagggttaattgaattcctgttattccatcttggtggaaagtagaaatctcaattttttttttctgtagatacttaatgtcactattagtttaagaaaaaatggtcgtattttaaccattcatgggtaagccaacttgtaaaatatgtctgctctatttaagcttatgaagatctgaagtagagtaaagggagtgggggccatagaaaaataaaagagagtaaaatctcccttctttcattctttctcttttgctcttttggtaaattgttgctatgcccccttactaatcagagccccattgttctttttggtaataggaacattttaagagttctgtgaatatgccactcaaaatatatgaagagtgttaccaataaaattgtcatggtctttatgttttaatctatgtgataaaaacttgatggttttggtacaactggttaacttctcgaaaaaaatatttaaattggatttcctcttaatatcttatacccagatatagtccagataggttaaaaatataatttctaaatattaaatgaaaatataggcaattcacagaatcttaagaaaaggtctttctaagtgtgatacaaaggatacaaccataatgaaaaagatcaatatgattacatgaagattttatgtcttttatatggcaaaaatcattataagcaggattaaaaacatagtcgatatccttagtatataaagatacctcacaaagtagtaaaaaaaaagccaaatatcccactgggaaattaggcaaaggatagttgtgtaaaaaatataggtttcaggtaaatatgtttacaatgctgtacttcataatagtaacaattacaaattataatactcataataatagctatcatttatttcatgtttctatttgcttgattacgttaatgttttcagtagattggctaatttgatactttgaaaaacaagtatactattattgtcagtttataaatggcatttgagacaggagattaagacccttgcccagggtgacaaagctatccaagtggctaagccaagattatcacccaggccttctgattctagacccctgcttctcatcattcctcatagcaatacatttaaactacctgaaattcaactgcaacttgcagagaaattggtaatttgctcaagatcacaacatttgtaagtgataaattgagttaaaaatcttacaaaagtcatataagtagaagaaaggaaaacagggtaaagtaaggtgagcaacaaaacagctgtgtgttttaattttagatattcacggtttattttcagaatatttaaaagatgcttcaaagaagatgaaaaatgggctaatgtttgtaaaactggttaacccctgttcaggtaagttctcttctcataacttgaatgttcttaaatgttgtggctaatgagtatatacacttttatgtctttgtgtccttgctctttctgaatagcttttaaagttaagatggcaccgtgaggagaagaaaacaaggtgatgacattactagtcttcccagataattcatttgacttaaacattttaaaaatttcttctcataattttaattcacagaactgttcagccatcagaaatacgggcaaaacaaaaaagtagcatgtttgagttctctttaaaaacagattaattttctttggcttccttaagccaacttttcttagttattcaacattagcctccatttatatccattttatcttataaagtaaaataaacaaccagaatttaaaaaaacaaaaacagaaggcttttacttgacatgccaagattttgattaggttcagttttagctatacttccctattttcttctgaccaaaaagtagtactttttttctccgtcaggggacttttttttttttaaatgataagcattgtttattgaagggattcatatcttattggaaaaattttattttaactttatattcagtgcattttcagttttgtcttcacattttttaggcaaaaatattaaagtgtattctaaatattgagtaatatgggtgatagtgtttatctctgtgtgtaattgtttttccattaatttataaggttttgtgtagacacctgatacttgccatattagaggtttctcctggtgacagtaatacggaatagtaaaagtatgggagggccactgagtagtgccttgttgttatagagacatgtaaatagaagcaacaagagaagaaacacattcctgactttctccagtgttcttttcttcaaaatgaaattgactgtaattggtcagctatatttagaaatcttagttatatatcagactaagttgacgtgagaaatatttcttcaagagaagttttaggtagcagtaaaggttctaaagcatttaagaaaagtacaggtacagaagaaagccagccctcttttaaaatttctgttttatctaaatgctcatagacaacagaggaacaaatgtttttatttgctacattggcagtgggaaagtaaaggctaacatttgctgagttcttactatgtgccaagtattggtttaggaaatttacatgtgttcttttttttaattcttataaaaacccttgaggaggttcagtattgtctccattttacagatgtggaaacagccacaggaaggtttatgtaacttctccaagggcacgtgcccagcatatggtggagatagagttaaagtcagcatccttgtctccagagattgtgctgtggttaaaaaaaaaatttttttttcattagttgaagtgataaaacatgcagatgtgcacagtcttcaccctcttgtgcctcctcccttttttttttttttttttttttttggttaagaaaggaaaggaaaaaaaattcattcagttgaataaagctttactcactccctatggcttcaagcatgtctgtctttctcacttagggttggcctgtggcttggtccctgtcagaccctgtgtggggagagccacacactgcccagaggcagggacccacgtgccagctcatgtcatatggctgaactgttgtgttttgatagtttaggaatggatattccctcttgatctgatggaggatttaaggacaggctttgtattagttaagataaatgacttgcactttctaattttttggtttaagtccagtgaggattatggagctggaaaactaccatctatgtataatagctgtaagctttccttggaatcagttttttagaatagacctgtgtatgtttatgttcatattaggaacattcgtcagagatactggatagtcttttggggtgtgtgtgtgtttgtgtgtgtgtgtgaaaacttacaaataaaagacagatttgtcttaacaggagaaggagccatttacttgttcaatatgtgtctacagcagctgtttgaagtaaaagttttcaaggaaaaacaccattcttggtttataaatcaatcagttcaatcaggtaggtgactagtgtaagcatttccaataactaaacacatactccagcttttccattcttcacacgtggggttgtgggtctgtcaccgggtttggagtctggtcactggtttagccttccttggcatgagagcaggtttaatcaaggagaaaggaaagatcatttgagcactaaggttaagtcatctcctgtgtgtcttagacggtaggaagttttaaactagcaactctgatttgtctcctaaaacagtgacacatcctgagttagaagttagatttgtacatggggcacatattgtgttgattagaaactcttttgaggatctttgtgtttttaacatgttatttccttgaaactggatactgatatggcttctaacataggctagagcataacaaagtttctttaaaatgctttgtcatatacctgcctgcccacctgctcccccacccccatacacacatacaccccccagcaccaaagttctgtttcttgtggtgttcccttaatttgggggcagtgctgactaaaggaagagtaggccaacggaactgttctgcctcatgttctggggtgggggcagtcagtggctattcaaagaatcctacatccccctgcccacagaccacggaagggactgtgtatagagagaatggcactgctttcccatggctttgtcctcaaaagcacaggaaattacattttactgcagctttatagatagactgacgatacaggttccctaacattgccgtcttctcattctgtctgtgcttcctcctaacccctcgtttttcagggggttgggaggctgtgttaaaaatgatttctaaagaagaaatggaaagttaaagatcaatttcagggtcttggttctcctctccacacagggatttgaagctctttggagtaaaatctcatagagcacattctgccttttgagagaatcacatagactctgaggcctgtataagaagagatttgaatttggaatttcacatatatttttcaacactgtttttcactttgagattaaggtgaaatagccacattgtctttccaagacgtttaattcccttcatcctttttgtaatctgcaggaggtcttctccattttgccacacctgtggatcctctatttctgcttctccactacctcataaaggctgataaggaggtgagtttccagctcggagcatccacagtgaggaaacagaatcaactatttttgtttgatctcctctctctccttttaatgatccaaaggtggattctaccttcagatctattatagtgactagagaaaacatgaatcatatgggccagtgcaggacagagcactactgcacaggccagagaagcagcaccttactcttgatccagtctgaccctggcttgcttgtgacctctgacttgcctgactcactgtgctgtgcaccttactgcttgacaaagcctgacagctaacactcctttatcattaagtattccttacacttgaaatacaaaacaggtatttaaaaattgaccacatgtcttaaagagtctcttctttagtgagagactgtggaataggtaaactggagcgggtccaatagaagctcattaatggtgatgtgctagttgagacttaaggaatcccagatggataaaatttacctttggaatagaaataaagacacagcttactaatagtaataattttagccagaagttctgtaatattttggtctcaggatacatttacaattaaaattattaagggttccaaagagcttatgtttctgtgggttctagcaatactcttagaaattaaaactgagagatttaaaaattatttatttaaaagttaaaaataataaggccattacatgttaacataaataacacatttttattgaaacaaacaaccaaatttaatgaggcgtgtggcattgttttacatttttgcaaatctctttagtgtttggcttaactagaagacaactggattcttatatctgattctgcattcagtctgtttccatatgttattttggtaggattatatgaaaaatatgcggccccatacatctttgtagttagaaaaggaagaaataatgttacagcctttttagattattgtggatattcttctttaatactgcctaaaaaatcaacaagtagttttttaaagtttagttgcaatgtgaaatgtgaaactttgtcagttaactttctatgctctgttacattaaaatgcattggtctatcttgcacttaaaatggatctttttaccagtgtatgattttgtaacatcatgctttggtcatttggaaaatattgatttgctgagttatgcatatcttccaaatgttgacacatctcattttacacacacacacacacacacacacacactcccttttgttaatattaccactgatctcatcagaaagctctttaggtattgagaagctgtcatagtggcagatagaaattttctacaattctaatttttgcttgaaagctcaaattttattattggccgcaaatattgtcaatctttcccgtgaaatgacaggctcacttcgttcatattctgcctaataccggggtctgaatcaccgtaattcatagtgggtttttcaaataaaaatgatatccatgaaaaagcagctggttctgcttgcaactcagccagccccaggagaacatgctcttcctggtaatcagcttatctttggttaagcagccaaaggcctttagccatacctcactttcatcacagataatttacaagacttgtgttcaagggccaagatttaagtaaaattaattgcttttactacttgctcaaggatattcttaagtgaaactggcattttttaaactgcacataaatggcggtgaggatccaaatgatgactaggacagtctggtgccaccaccagactcgtgctaaagagccagcagttttacccaccattgcatttgaatcatctgtgcagatgtccacacagtgaaaatgcagatagcgtcttagcagtattaggaaaatagctttgagcttaggtacttcatgacccagggatccatcaaccatagttggaaaatcttttaattaataactttgagtgataagtgtcactcaaacagcttagaagaatctggtttttttggactctcatgtttgcataaagtttgaacacttataaatttcttacttaatccttagatcaaattcctgaaacctccatttggtaggtaaattaatttaagttgctgtaaatactgaaagtcataaagtatcaatgcatgttttctcttgatgcagcttagcctcttttagcctcctccttccctgccctccgcccttcactgtgaattagtgaagttttatcccttcgtttaatcatgtgtcccattatctggaagctactgtgatggccggtataacgagggcacacaagctgtgaggctggtaagcctcgtgtctttaaggaacagaaatggtcctaatcaccaccaggaacgccctggggaatattcagggaggaatttgtaaacctcagtggctcacctatgtggtgttttctaggataaattaatgagcagaaagacaccaaccagcctcagcaaatgtattgatctgcacttaaggctccccctcccctttttgatagcatttctccatctcccattaggaccatgactctgggggattaaccctgtcttggcactctgggcacctccagggtgctatggcgagctcacgttgacaagtgcagaatgaagcagaaatgctgttcagggtggcctttggctttcattttaaaccgtcgtacttcccaaacacgtcttcccaagtgccaaaaatgccctttaaagtaacatttgagatgtttaggtatttccttctctacattttagacatgatcatttcctatttagttaaaaattattgatacacacttttgaaatgtgacctgttcttttaaactttattttaacatcagtaaaaataactttttttctaggtatcccactgctactagctttatagtcaaggcaggttgcttattgcatttccttcaatgtatatatggtaaataaaaataagaatgaaacactagttaattacaaaattattttatatcatgattgtatggtagtccattacatataaatattgttttagagtagtcaaatatttaagatattgattgatcatggaagactatagatttaaggtagaaatctaaagacagtaagacttgggaaaaatctgtgcattattcttactatttgaaggaaaaagaacatttaaattgagatagttcatggcactagttaacctaagagaaagtatggcaagctatcacgtgttcttaaatgattgagaagattttacccttaaaacccaagaaagctgcatttgcagaaattgatcagatgcagtttttgtgtcttcaggaggagttgtcagtacacgagaggtagagcgagctagaagtgggtcatgggcaaggccatacatctggtacagtctggtgtccccaaatcagggggctaataccttaatttagacaaacttcacctctacttgctactagtacagttacgaaaaactagacctaattccaaagaatgatgttgtgaatccatatggtctgcacttctggcccactggcaaccaggccatataaacttctgtggctgagcctgatttagcctgtctgcagcttcccatgacttctccctctggctgtcttttcttttattctggtctaaatttggaagcattgtgaggcagctttgacaggggtagattcacttttgtattttctttttgtggcgggtgcttctttcatcatccctagagtgatgatggggaggcagatgtatgtctgggcctggtctgggcttgttccaatgtgacagtcaggactcttgctctgtgaccacagctggttcttcaaattgaatgggttggaccatccccaggcagtctccaccatctttgcaagcttctgtggcttccagtgcttttgtagattgattttcttccccatttcatttggggactgtacacccaaggtagatggtgtgctgtgtgggactccagtgctcacaggagcttcctgaagggagctggggtccgtcctagagcctgtcccattgtagggattccttagatggaataggtggcttctgcactaagtttaaaggcccagccatgagttaatgtgtctttttctctttttttctgaatgtctttgttgaatgaaatgcttgctttccaactaactgttttttcaggggaagtttcagccccttgatcaagttgtggtggataacgtgtttccaaattgcatcttgttgctgaaacttcctggacttgagaagttacttcatcatgtgacagaggaaaaaggtatggtataacttaaaggcttatggctggtagaaaggatggaccttgcctaagaacgtggctgcttacagacacactgaatgtaaggcttattctgtgtccaccatagggaaaactatcattcagatttgctaacactgccagcactgttcctctattgctttggagtgtttagtctttggaactacaaccatggcagtctagggcctacgtccacagggcaggaatcacaaggtgtggcttcagtctcacttcttctttgaactagttctgtgacatcaggcaagtcactcagctgccttctgcctcagatgtctcattgtaaaattacgtaaaacctgtaccttaatagatggaagcatttatcgagcaccttccaaaaagcatatgttgcacattagtgctaagctctagatacttatgaataagacattgtccttttcttcactttgcgcccagtctgatgggggtcaatgacaagctgagcagtgaccgcacagtgtaacggaagtgaactctgaatttactggggatgcacaggacaggtttctaatctggcggggttgggtggggaatgtaggtgggtagatgttgtgttgctttcctgggggaaatgacctctttatggagtcctgaaggatagtcagagaagcagtgtaacagaggctcagatgtatggaaaagtttgtcaggttcaggaagttccaaggagttcaaagtataggattctggggaaggatgtaggttggtaaggaatgaggcgggaatgctgggcatgggtccagatggtaaagggccctgtgtgtgtttggactttgcttaatggtagtggagtgtctgtgaagttttaagcatggcagtctgcagtgtggagagtatattggagaagccaggtccaccaaggctgttgcagtgatccagacaggagataatggtggccttgatcttaggagatagaacaagaagaaagtagccatttagagatggacccaactgcatctggttgttgggtggtggtcaaggagaaggaggagtcaagagtgacttctcggtttgtgcctgacccaaaggatgtgtagtggtgggatcctggacacagggaacatgggctggaggagcaggatagggtaatgaagagatgcgttttcactatcattcatttaatttttcagagggaaaagtaaggcagtgtgtgtgaatgtgttttgacaggttagaaatagtataaaaacttggctttggtgtcttaaaaaatcatccaagtagtttcagggttaatatggaaacaaagtgtgggaaccagagcatcaggctgataagttgtggctgtttgggtcatagatggtttggccaactatgacagttcttctgggaccaagaaagtggtgattccaagaagtgtaagcttacagtgggaaagagaagaaccttattgattgcattttatgtttaaggggtccagtaaattcatacttggccacacttggagctccagtttggaactgaggggtatatggtgccagggttttatcaaagcagttccattaaagacattccctgatgctgagtttggcagaagacagcagtctttttgtgggtgacctgaattagcccataaccacttttaaaagataaagtaatgaagaataatttaattaagccatgttaatttttgtcaacttaatgcaagctgaaaatgcagttaactcattgtccagaattctgctattagctgtataagaacaatcatcttaaaacccagaaatccagatttagaaacaatgttagtgcctcagcatttgtttccttacagtctgcagccgagagcaagaggctctctctgtgtcatcccttccctcttgtacaccgaactcctgaccatttattgcatcattatctgaacttgtcttagtctcctttgcttctcaatattgcctaacttttggaagttctgtacttccattttcaaagtagctatattattagcctttatatttgccagatttcaaaaaccctaggcctcaatttttttctttatttttaagtgatgggcaaaacataaaatactttagaataaatttcacacagtaaaagatgtattcaatctctagaggtttggcagtttctttttatcaaattcttcccttaataagctgcagcctgtgaatctcaaaataatggaagttttaaaaacagaaagaaaaagatttttatttttatttttttatttttatttttttaagacaaggtcttgctctgttgcccaggatggaatgcagtggcacaatcacggctcactgcagcctcaatctctggggctcaagcaatcttcctacctcagcctcctgagtagctaagaccacaggcacaagccaccacacctggctaattttttcattttttttggagagatgagggggtctctctatgttacccaagctggtcttgaactcctgggctcaagggaacctcccgcctcagcctcctaaagtgccgagattataggtgtgagtcaccatgcccattctcaaaaagatttttaaatggggggaaaaatacgtaagattctcaaatgcctcatccttaagaagatattggaaaatcaaatatctaaaaattaaatatataaaacctaagcgggctttattgcaagaattcataattggttgagcatttaccataatttaccatatttatgcattacaaaattgtatgattatctcaaaagacacagaaaaggtatttgataaaattcagtcatgatatatattatcagcaaatgaagaataaaagggaacttccaagggcatctatggcaaacttaaacagctaacatcatcttcattgtaaaagactgaacacaatcttcccccaagactggatacaagagaaggatgcctgctcttaccacttctattcaccatgtggtggatgtcctagcatgtgcaataagacaagaaaaagacatacagattggaaagtcagtagtacaactgtctttattcatagacaatattgtcatgtatgaaaaaatccaaaagaatctacaaaagaagttactagaattgataagcaaagtttcaggatacaagttcaatatacaaatattagttgtgtttctatatactgacattgaacaattggataatggaataaaaacataccatttatactaccattaaaaataacattctagtgctaaatgtaacacaatatgttcaagaccaatatgctgaacattacaaaatattgctgagagaaattaaagaaaaattaaataaatggagaaataggccatgtttgtggattggaagactcaatatttttaaggtatctattttccccaaattacactataattacactatataattacattatagattcagtgtaatacttagccagctccatttttttttctttttttttggtaggtattgataaactgattctagaatttatatgactatgtaaagcagcagaagcagcagtctccaacctaattttggcagcaggaactggttttgaggaagacaatttttccatggatggggcagggagggggatggctttggggtgaaactgttccacctcagatcatcaggcattcgattctcataaggagcacacaacctagatccctcgcatgtgcagttgacaatagggttcgcactcctatgagaatctaatgccatcactgttctgacaggaggcagagctcagccagtaatgctcacttgcctgacactcattcctgctgtgtggcccagttcctcacaggccatggattggtaccagtacatggcttagggactggggagccctgatgtaaaggacctataatattcaaaacaattttgaaaaagaagaatttggagaacttacacaaactgaattaaagacttactataatcaagaaaatgtggagatcaggcacaatgactcatgcctgtaatcctagcggtttgggaggccgaagcaggaggattgcttgaggctgagagttcgagaacagcctgagcaaagtagcaaaaccccatttctacagaaagtttaaaaattaggcagctgtgggccaggcacggtggctcacgcctgtaatcccagcactttgggaggccagcgcaggtggatcatgacgtcaggagatcgaaaccatcctggctaacacggtgaaaccctgtctctactaaaaaatacaaagaacattagccaggtgtggtggtgggcacctgtagtcccagctactcgggaggctgaagcaggagaatggcatgaacccaggaggcagagcttgcagtgagccaagatcgcgccactgccctccagcctgggtgacagagcgagactctgtttcaaaagaaaaaaaaattagccagctgtggtggtatgtgcctatagttccaactatttgggaggctgaggaggaaagatcacttgagcccaggaggtcggggttacagtgaactgtgatcacacaattgcactccaatttgggtaacagagtgagaccctgtccctaaatttaaaaaataaataaaaataaaataaatttggtgttggtataaggataaatatatagataaatggaatagaatagagaatctagaaataaacccacacttatatggtcaattgattttttttttccaaaagtgtgaagataattcagtgggaaaaaggatagtctttacaacaaatgttgatggaagaatttggtatacatatgaaaaataacgttgattcttacctcatacagaaaaattaattcaaaatggatcactatgttaaattcaaaaatgaaaattattgagcttctagaagaaagcataggataaaatccttgttgtcttgggaggcaaagatttcttaggacacaaaacccactaactgtaaaaaaattataaattgtattttatcaaaagtattctcttttgtttttgaaaaatgccattaagaaaaaaggagattgtgagttgtgggacagttggaacttacctacctggctgtccacggcttaaaatgatatagccacttgacaatttcttacaactcaggaattctactactccctggtacaaagtaaggaactactgctagctgcaacaaaatggatgaatctcacagaaataatgttgagcaaaagaaattggacacaaaaagtatatactatatcatttcatttctatggtgttccagaataaagcaagaattgccctataatgatggatgagtggtgacctgtgatctgggtagccatgggagaattgactacataagggttccagggaactttgggggatgatgcttacatgactgcatacatttttccaaactcctcgatttgtacatttaaaatgggtgtgtccattgtgtgaacatgaacattgcgtgaacacctaaataaaattcatttttaaaacaatatttactgatccagcactagaagctaagcctcctgatttctaacacagtatttatttttacttgcccctttcccccaaaataatattggctccttttctctctatacttcctacctcccatgggatggagagatggaatgtgggaggcaaggccagtgtgagcactggctctgaggtttaggcctcgatattcaggagagtggtgtaggaggaagatgaaccactgggttttagacacatggaggcttagttcagggctttgggcctcccggttagtttgtttagtcttgttgatctaggaggagatcacaccagatgaaaggatacagttgactttggaggagggtgaagcagagctgggaaaagaatcagataagtcattagagacataaaaaaatagaaagcaattttatatatgccatggaggagaggttgttaggaggtactgaggaaagtgcagacctagtgatcttggtaaagtgaacatcagatccacagctttgatgtcagcatggttgggagttgggtgctcttgcctacttcctcagtgacttaggagagtttacttcatgtcactcagagccagtcttcgaagatggggacaaatcatggtttattaattgattctgagattcattctgatcattcaataagaaaatgtataaaatgtgcctagcacagacctgaataaacattagtttcttatgttttattaacaaatcatatttttcatcacaatatcttagctaatattatgtatttgctaagtggcaggtgttgtgctctaggatttgtatggattatcacatttcatgctcagaatagcccagtgagaaaaaaacctctctttacacatgggggaacaggctttgagcacgaggcggcttcccaaggagacagcatgtgctggggtatgcatgagccctggtagcatggctcagtctgtgctctctgccccttcttagagaataattcccagaggtagaggagaagcctcctagtggggctcagggagtgggagacaggaaggaaaacagcagcagatggtagacattctttgagaaaatttggaggtagaggcaagaaagaagtgagatgccagatcagggtaggattttcaggagaaccttgagcagtgagcttcttttggagtttttttttcctcaggcaatgaacataacttctaaaagccattcagcgtcatatatttatttagtgattgctgtatgctcttaaaattcccctggtttgtacatcggttgggacatgggctccagggaaattgagtccggtctcattggctttggcttacagtaggctgtttgcccaggtagtcctggctccaaaacagcagacattgcaccttggaattctgacactcctgacaatgcttttgcacctgtccctcttttttgttactgtagtgacatgtcctgagaagatggctgcagatgtccagcccccaatccatcctgcctcatcttgcctgcagcattgacaaccataggctgaaacagagaggaaattcacaggaactaaggccagggacctcccaacctctctcccatacagtttaacagactgcagaaaatgaaccctgaatgggcagttttcatttcccatcaaaaggtgggagggagaaagagcctcattctatataactcagaggtggtaaattcacatcaggcccaagggttgctagtggtcataaagataaatcctgcatggacagaggaggctggaatagaagtgctgcccttgctaattgcacagacagaagaaatcccatgaatgaaaagggttgcagaggaaatcatggtttaatgtcatggtatataaggctgggtggattgtggggaagttaagtgtaatttataagaggtgaaacttttatctccataaagggccagattgagcctaccataaatctaaatcttctcaaatagctatgattatgttggtaatatgttaaaagatagatagatctttttttaatgctcccccaatccccaataccaggccactactgagtagttaacaagatttttttcctgaatgtatgtagtgaacttcatagatacctgcatttcgtttcaattttctttattgggattttcatttttattttaagaaaaaaagtggttcattgaaaacattgaggtgagcttaaaattattcagaacagttaagactgcttagtatgctaatgtgaacacaaaatatctgagacaggtctcagtcaatttaggaaagtttattttaccaaagttaaagatgcacccatgacacagcctcaggaagtcctgagacatgtgccccacggtggttgggggtacagtttgcttttatgtatttcagggagacatgagacatcaatcaatatgtgtaagatgtacattggtttagtccagtaaggcagcaacaactcaaagtgggggtttccacgttagacatagataggagacaaaaggtggcattcttttgatcagccttccactgaatacacaatgtagtctggcttgagtgtggagccattgctagggaccggccctcttctgcccagaatttccctgcctcctgtccctatcaacaagattattttcctttcacattagtttgctgaggttttaaaattaccttttctacagagttgtttgtataatttgaaggttttcttaaattcttactcatttagtggttgatgactcctgaggtagccacattactactaacatttaaaaaaacatttcaagtatgttctcaggtttgtaaattaagcttttcaagaatttaaacttacaaaatattctttaaatggttaacttgtatatgatacaaccttaggagtttattttttttttaattcattgtgctgagtcttttttttcttttaaggtaatccagaaatagacaacaagaaatattacaagtacagcaaagagaagacattaaagtggctggaaaaaaaggtatagttcctctctagtgccttgtggtaaaagtaaaaattcagttctctaagaaattttcagagaaggcagtaagtctgaatccagagaccatcttgtatattcagtgaaaagaggaaaattgtgtagagataccaagtatgagaagaaggctttgactttttaatcctccctaacttctgtatctctgaagttagctttatgttttcttgtgacctgcattctcgtttctccctgctcctactacggaatgaaataatttgttggtgtagatttgagtcttccaagtaagaggataccaggcttggcacttgttggccactgtcagtcctgcaggtgtctccaagggtgatgcttacacacagccaggcaaagggacccagggacacagccaggcaaaggtgttcaggtttagaggaagtatgtcctgctctcagggtctggacactgatgaggggtcatcttacaggcaaaccctgtatcttagtgattctaagaatcttgacctaatggatggactggggcagtgaatttcaaatcaatttagtaggtaacaaccagtatttctcttggaatgaaacagattgtgatgggatgggacgggacaggacgggatgggatgggacgggacggacgggacgtgatgggacgggacgggatgggatgggacgggatgggatgggatgggttaaaatatagcagaggaagggcaggtattaagtatggctctgtgaaatgtatttatatgtgtttaagtattgggttgctgtatatttcttactatgggttgtgataaaaaaaaaactttgaaagccactggtctaaggataatatgtactttcacattgattaagaatctcgctaaaccatatagaataatgataaagtttttgcaagatcagtggataccagtagttgtagtactgtttcctaagattctcttccatcttttgtgtgaaaagtcatgtttgtctgcatgttctctctcataagtgggagttgaacagtaagaacacatgaacacagggaggggaacatcacacaccggggctgtttcgggggttaggggcaagaggagggagagcattaggacaaatatgtaatacatgtggggcttaaaacctagatgatgggttgatgggtgcagcaaaccactgtggtacatgtatacctgtatgacaaacctgcatgttctgcacatgtatcccagaacttaaagtataataaataaaaataaataataataaataataaataaattgtgtttatttgtcataccatgttaccaggctcattgaaagcctgggaagctggaaatgagtccagtagaataatcagtctcctaatgtgcaaagtagtggaaagatttagagtgccatgtttcattttttatttgtgatatagtagtagtagtattccatgtaggcgaagaatgagaataaatgcggagcagaatccttgatgtttacttttgctcttagccaaggaaaatgacatgaatagcgaagaggagtttatacttactgattatatttcctaggaagtgggaaatttatattattctatttaggaagttattacatataaattttgtgccaggttctattgtaagggctttatttacatatattacctcatttaattttcacagtagtcttatgaggtgaatgctatttttttcccccatttcacagatagagccacagaaaggttaagtaactagccgtggttacagagccaagcccagcagcctgactccagagtcagctctcagttatcacaatatgttgccttctcatattgtgtaggccatggaagtccatgtattgagatcatccagatattgctgccactcagcctttcttcaaatgggcaaccatttctcatcttctggtgtctggtgaagatacttctaggttctcaaatacttctttgcagatctcttaaatggtctgaaggccacctatgaattcatagatttctaaagttaagttgaaaataccctgcctttcccctcttggttgcttcataggttaatcaaactgtggcagcattaaaaaccaataatgtgaatgtcagttcccgggtacagtcaactgcatttttctctggtgaccaagcttccactgacaaggaaggtaagtaaagcattttatcagaaaagatttttgtctggagtaagttgcttatgtgtaaatgcctatcttaggatttaaaaatcttaatatcacagaagcctcatattcctaccaatgcctcatacacattgtggcaggtgtgcatcttatttcagaagcgaagaatatttctaccataggttacttctgtcattcattgatacttaagttatttattcagcaaatatttcttttacattgatagtagtaacaaccctggctatcatttattgagggtgtattgtgtgccaggccctttgctaagttgccactatacaaacatgatctcatccaaccctcccagtaaatttcataatgagcatcttgaggccctgtgcaaagtctcacaactagtaaatgccaaagctgagctacttatggagcttgtctctgaagcccacacttgtaatctttttgtgatactgttcctgtggcacagttgtactgttccagtggctgcatctgtttgcattttcttctcaagatgcatgtttcctgatacagggatcaatatattttgattttagatgaaaattgatttacttggcaatttttcttttaggttattcttttataatctaaaaaaggtatattattttcttttccaagtagagtcctcttatttttatatgtatagttgaataagaacagctatataatgcagttaacaatctcaaatggtgagacagaaattattctgacgttaaactccaattcattgttcccttattcagggtatacatatggctttagtcattacataaataaaaactaggaatagtggcctgtttgtgattgatagtaattcaggcaatctgatttgcaggaatctaccttgcatgtataggtagttggctactgccattctgggagtggtggacagcacctttgccatactgagttaccagctgtcagtgtctttaattggctttaacaatagaagatgagggattgagatagatgattaatggatagataggtgggtggatagatgcatccatggatggatggatggaaccatagattttgttttaaaagtaggagaagggatgttagaggttatttagacagatcatctcattttttaaatggagaggtaggtaacttatcctcaagatcttctgttctaagtctagtgcttttaccagtactctacatattaaggttctgggcttggctatattgccatttagtgtcctgaccataaagtaaactttacatattttacattatttcattttttagatatttaggttggtttggtaccagaagcagcaaatgaactatatgttgactttcttaaaatagttttcttggtctagtcatgactcattggataatgactatcccagatccatgagcaattttaagaagggtcaaatgataactttcagttctccattgacaatgaaaatctcttactgaagactttttgacatcaggtggtccccagacggcagtcattttctatgtaatactgaggcaaattgttactttgacttgagagcagaggagaatggaaaaaaggaagtgagtgaatatcccagcagcaaacctggggtctgcttttggtgctttatatccccacgtggttatcccatcttatgattaagtttgattatctgcttgtattctacataaaatactgaattcaggaacagagttttgaaacattttattgtcttcttatgtaactgtatttctaattgctgccagagctgcattttagtactgagaatccaaatgctttagaattaatgatgataaattctgctgagttagttgtttaagtttaagtattttattagtttgggagtgtgtgtgtgtgtgtgtgtgtgtgtgtgtgtgtgtgtatgtagaactatgtatatagaacaatatgtatgtatagaactatatatatatatttcagggttcttataaagcaaatacctagtagtagagacatggtattttatttctcttaaatgagtacactcattactgttgaataattagatttattctttattgaagcaggcttagaaaagattacccttttaaaaaagacatgactatttcatattgttgtagatgatttttaaactttatttgtattcagtggtttcaaataagaaagcaaccctgagtttttgtttttaatgtcatttagggagcatctactgtattatacttgttttatcttatatctttggtatcatcacatgtcatatctcatccctcatatcttcccactagtctgaccgatagatattactatccccattttacaaatgagaaaactgaggctagagcttaagtgagttccctttatccagatagggtcagaatttgaattcaggtcaatttgactataaaaccaccataattactattttttttttttgctttcactcctccttctgtttctttcagaggattatattcgttatgcccatggtctgatatctgactacatccctaaagaattaagtgatgacttatctaaatacttaaagtgagtattgattatcttcagtcataatgaagtaccatttgcttcttggtttccccagcagtggggtttccttatggcttatcatatcactgtttatgatacaagattattcttcagctatgtcatatactttgtgctttggggatgatttttaatggatgattggaatgaactgatttgatggatacggattgcaggaactagtgaatgtcaagattggaattatggcttggtctgattttagaggattaactatgttaaaattttatcctcaattatacttaactaatttggttctttgtgatcgttttaagaggaagaaaggagggatggaaagagtagatggaatatagacttttttttaatttacaaaatattgatatcattttcactattatcactagatgttcactaaagggactttatgccaaagacttggaagtcaaagtaatatgaaacacaatctgtgtctttgaggggcagaagaagggttttaagaatggtttaatgtatgttcctttctttataaagagcttatacatttagactttaagttgaaaaagaagtgttagaagtgtttattttctagatttttgcaaaatcgttacttaattttgttgttaagattttatgtgtgtgatgatttaatagcttttcctgatccttataaatcctttttatcctctgagtcatgaagataaaatgactttttaatagatacagttgttggttttagcaaattccagaggtcctactttaaaaaacaatgattggaaactggtttctataatagttaaagtgtgctgaaagcctgcttcaaattgataatcatatccttctgcttaatatatccccagatttctatgctgcttgtcttgttagagacctcatgtctttgtactccattgtttgtatagattcctttctttccactaacatttttaagttttggttgaagagttcagaagaaaggtatgccaattaaactgctttctaatggaagaaaagttgaaatttatgtggctttttgtgaacagttaaaatgattttcacctttaaatatatgttagcatcttcactatgaagaaaaaatactccaacaccgaaacacaaatttatagaggctaaagaaaaggaactctgttccaacagatgggttctaattttattttttagttcagacaacaccaaaacaaggacttacatatcaaaataaagactcatttattgagaaaactttcattctttacactgagttgattgaacaggaagatatatggaggtaaagctgtaagttgaaaagtaggacttactaagtcttaagttggccctgtctttctgtttgtttgtctatgaaaaacgatgactttgattgttatttttaactttcttaggcttccagaaccttcagcctcattgccaaatcctccatcaaaggtaagaagctgtgactaagatatctttgggggacttagaaaaatattacactcttaccacatgagtttagttggttctaatatattttaaggtgtactaaatccattttgcatggagtgatgccatgtggaataaagattgtactgggctctccatcactattttttatttttgtggattccacctgaatggtaaataaagtgccatgaaaacccaagaagagttggttttagcaaggtacccctgtgaaaatattaaagacatatagttaaaattaaatcttcctgcattagttagatcacttaattaaatttagtaatcactaagcatactctatatataactaaaactcattttgccaaatctaattgtcactggcacaaaggtgaacagaaaacaatttccataatacaaagaatcctttgagcaaagatgatcactttttttctgaatttgaaatgattgatgaatttacgtgtaatctttgttagtggaaaatcttttcctcattcattctcaggctgctacccacagctcctctgcagctggtatgtttatctcctagatccagagaatggagaagccaatcataaaccacacctgactgcaaattgcagcgttccttcagcccaggccagatctcagatgagttaaactctgctccaagacagggaaataaacatgtgcaccagcttgtcagtgaggtcatttcttcagccagcaaagtaacggatgccttgagaatgtaaaatggacatattgtggatgttacaaactttccttctcccttgcattgttttcttggccttcaaggtagctaaaatgctcataattttttatgtcattccctgtataaaggtggtggtggctccaaagacattgtccttagaaaaggacagaaaattgaaagtacagcagtgtttgtttgggcctatgttcagcatgttgtcaaaaaaaaatgcatgttttactctcttggagaatagcactgggcagaagtctgttgctgtaagatctaaggactgctctaggccagacccatgcgtctttcattccggtagttaatctctgacagtagctctagaggacctagagaggcacagttgtcttgctgaaactaagagggtaggttctcagcgtgcttcttatttttcttcatccaaaaatgaagcagatttttttctcccaaatatctatcttccttagtaacttagagatcattcatgaattgatctaaacctattcttgaaagctttaaccttggataccttttggagtaatatgtttcataactttattcttctctgctcctgatttctgttttcttattttaattttcagaatttaagttgtttgtgacttcatcatttatgatttagatcagagatcagcaaaccttttcttctaaagccagacagtaaatattttaggctccatgaagcagatggactctattgcagctactcaactctgctgttgtattgtgaaaacagccacagataatacataaacgaatgagcatggctgtgttccagtaaaacttcatttataaaagcaggcagccagctggatttggcccctgggccatcatttgccaagccctgattttgattttggcatcttgctcttcctaaaccccagccttgtcttctatattatttgagttgcttttcgaggtcttctactctgtgtctttctggggttccagtgtacacatgacaaactatactagacgatgtaccatcgtttaaacaagcgtagaacatatcttctgctagctttcctgtctgtatccaggatttgattgatttttacagtaatatagttgactgtttccaggaaatatattccagtagtcattaggtatctttgtatctatgttgtaatcgatagcgtggagcctgtcatctttaatatgttttatattattttcctttactatcatatgtctgcctttgttgaaactcagcttccaaccctcacttgctccagtcttttcaatttgtcactgtcagcaagcagagttgaatgcaaccagtgggtttggagatgttcccgagttccttcttgcaaatcatttgtaagaaggcctaacattatccctgtggtactctgcagtttgttctctttccagaactgtatccatttagtcatagcctttgttactgtctttctgagccacttctctgctgaaacaatctcccaaatccatagggatttggtcttttaaataacaaaaattttagtaaatgcttcaatcatctttttttccaatatattcaacagtgcactgggaataacatacaaactagttatatgtagaggctaccacaatcattttctttttttaaacacttgtaactggtatcttgttttgttgtgagctattaaaacacctgaacaagtcatttctccaattaaacattttatgtccatacaaaagtacctttcatcttaagttcttgtaatgaacactttttatttgaattatcaatgaaaagtgaacctcatcagttcagtggcacacacttgtagtcttagctactcaggaggctaaggcagaaggtcgcttgagcccaggagttcaaggctgtagtatatgatgatcgcaactatgaatagccaccgcactccagcctgggcaacacagtgaaaccctgtctctaaagaaaaaaagggaataatgtctaagtgtttataatgacatctgtgttaggaacattttgccatagagaaggaacacaagcatcctcataacttcaagctttttgtgttttgaaaatattttggccttcagcattattagctgtgagtttcaccctcctagctgaagatacctttctagtaaaaaatgtgcatcacctaaacaccctttgctgtcttaatttaaatagaaacatgtatttttttttttgagacagagtcttgccgtgtcatctaggctggagtgcagtggcacaatctcagcttactgcagtctctgcttctcaggttcaagcaattcttgtgcctcagtctccggagtagctgggactacaggcacatgccaccatgcgcagctaatttttatatttttattagagatggggttttgccatgttggccaggctgatctccaactcctggcctcaagtgaccgcccacctcggcctcccaaagtgctgggattacaggcatgagtcactgcaccaagctgaaacatatattcttaacaaagttgcaaatatacattcacttggtgctgataggtggttcatttgtgatggattagtctttttcttttaatgattcatttgctagaggttgctgtgtggccaagaggttttcctatagtgtgtggtatattcccaggatgagcctctgtttttttacagcaaacaattttaagacatggtgttttatcctcttgggttatgggataaaacaccatgggctgtggaatcttttagcaccaactctacccgttctttgtttagcaaagcaggggcatgaagaatgaagctgggaagaagtctgtttcctaggttagatccatgttgggtctggtcaacctggtgtctccataaacagcctgaaaattataaaaatctgggttgtgatcaccatgcagtcaattctccatgttcaacagcaagacttgtcttccctgcttttgtaccttttacataataagtgtggcatgatttcttctatattgtgatcattaaggccttgacaagattctcacattcactggtgtaaaatgttcatgtgaaaggagaaaatattaagtaaaggtctgacttagttgcattgggcctaatggaaagaacactgtatcagaattgaaatcttggccaaagtcctctacttggtgaccttaagctattcatttagcctctctgtgcttccctctcttactggctgcttgcttgtgcaaggttgttcttgcatggataaagtaagataaatattgtcccttcattcataagtggacattaaactggcccaggaggtaaatgaaatagggattctggctggacacctggcccccttcaagagactattctcattttgacttctgtgccttgcattcatctggtaattagcaatcccctcatgcccaccacacctggcacctacaaagcctgtgtttgctggaccagctaaggggctcagccatgtacttacccaatcatatccaccatcaccaaggctgcttcttaggagtgatgtgtggctcaattccctagatgattggcaaaatgtaaaggagcctgtaaaaagtaagccctttgctgggtctgctgtcccattcgcctctgtagaggtctaaattatacatgttgggtttttttttaatggattgatgttgtgtcaaagtgacatttgacaccacttcactgctctaatgttgcagaaaataaagttatcagatgagcctgtagaagcaaaagaagattacactaagtttaatactaaagatttgaagactgaaaaggtatgtgggttcaggtgtagtggtgtttcgttcatactcagtgcgtgatgtgcatgaatacatgaggaacagttgcacgcttgattgtgattacagttttgaccaggaagaattattaacttgcatttctgtgacttaataattaagaattgcatatgacaatgaaaatgttaagcaactaagacttattattagtcagagaaaaacaatatactacttatcaagagtgtgcctaaattttgctatgtattcatagagtgatagggtgggaaaggagggaggaagctctacaggtaattttttgtcaaccctgctgcccagaagcagaaattatgatgataaaaattaataatttcaccattcagcattcaccctggcaaatggcattttggtaacagtccttacttagttttatacatgcattataaatacatatgtggcctttaacattggcattataatactcagttctgggctttttatttaacattaaattgtgaaaatgttcacatatcattaaacattctttgaaaaaatattcatgtttttatgatattcagtcatgggtgtttgtttcaccatatggaatgtaatttaatcatttccctatatttggacatataggttacttctgatttttttattttttgtttttattgaagtgatagacattcttatttacagtctgtatctccaatcatttcattagacacaattttgaactaagactaagagcttggagaacatgaattctttcataattgaaatatatatagctaaagtgcttttcaaaaatggagaaagttgtgcttccaaacattattgccaatgagtatttatcttgcatttttgacgacattgagtattgcttttattcttgaacattgttgcctgtcaaattaggctacatttctttaactagaaaggttctttttccaaatgcttatggcccatttgcatttttgcaaattgttggttcctgtcgcttgcctgtttttatgttgagatagtaatgtttctctgttgctttgtatgagctcattctaaattaaggctattaacacttttcatgaaatataggatacaaacttgttttaactttttcatttgattttttaacagtgttaaatttttctgagtgttaagtacagaaattgtttccctttatgatttttccattgtttttatgcttaggaaggccttgcccatctcaagataagttaactttcacttagattttaaaaatactaactgccctttgagtttaatgttttttagaactgttattcttgaatcaatatgtaatttatttgggcatatgatactgaggatagttcgatttaagatctgcccaaatagcgagttatctcgatgctgtgtcaacagggacattgtcagtttctctgagagaaatctttgtgccccgcccttctgtgggagtgccacttattgtatccacttgggcacagcatggagaatgtcttaaatgcaccagataagtctgaaacagactgttgctttgcaccattgagtcaaaaataagcctactaaattataagtgacagaatgtgaaaagcagaattgtgggaatcatatactgtgcctctaaaaaatactttatcaatgactttgtcttacagttcccagggagacaggtgatttttttgttttctgattcccatcatttatgcttcttctgaacaatttgtggtgcatctgcatcaaagttaaatcagctgctatttaccttctgcaagtgctttatataagacatggaagaaaaaaattcagtgaccagagagagatagaaatgtacagggcagaattatttggagtcagctttttggaaagtattgctttgttggaggaaaaataaggcagctatcctgctggtctgggatgctttgcaacacaagtcatcttttgaatatcatagggttgtccttggtttcccatggagcaaatgaataaaatcagatggtaaattggtgtgaattattcatcatgtggtaatacaaggctgtaattcctacctctgacaattgcggcctgtgtcagttccattgtttgtgttattgtactttatgcaccctccagaattatctaccccctccccagtgtaaaccattggttggaacattctgcttcttagaaggcagcagttttgtcttctgcctcttttaacatattctgtctcttaggtctgaattctgaatagaaatcagaactttttcactcccttatgaagcatgttagtgggggatgcttaccttccttaatgaaacttgagacatgcagtcttctttgatttccatatatgattaataaatgttacattcataacaatttttctctcttattttcattaacagaaaaatagcaaaatgactgcagctcagaaggctttggctaaagttgacaagagtggaatgaaaagtattgataccttttttggggtaaaaaataaaaaaaaaattggaaaggtttgaaactttgaaaataaaatctagcaaaaatatttgctttttacatgtttcagtttgtccttcctgactgttaatgactacctttggttgggggaaggaagaggccaatttcatgttctcttaaacatttctttgcatttggtttttgtgttcctgaacaaaatatgggaaagtgtctaacttcatggctatggccttttggagtctcatctgacataatgaaaagtaatcacttgaagagaattaacatatagcatcatgattttctcaataaactgatgtgtgacaatgttagagtgtatgactgctttttaatgcaactttgcattcagtaggtttagtaataatattttcaatatactgagagaaactggattacaaaactgtgaggtaaattgttactttaaaaaggctttagtttttggtaaattttttttttttttttttgacacggagtctcgctgtcacccaggctggagtgcagtggcgcgatctcggctcactttttagaaaatagagaaaataataagaacttcaatctcccatttcttcattacccagagataatgtattgtcttataataatttttagaaaggaattacagttactttgtaaccttttttttttttcaacttttattttagactcagggggtacatatgcaggtttgttacagaaggatactgtgtgatgctgaggtttgggatgtaattgaacctgtcacccaggtagtgagcatagtacccaatgggtaatttttcaagccttgctctcccactcttcctccccttgaagtccccagtgtctattattgccatctttaagtccatttgtacccaatgtttagctcttacttataagtgagaacatgtggtatttggttttctggtttttttgcattaattcgctcaggataatggcctccagctgcatccattttgctgcaaaggacatgatttcattctcttttatggctgtgtagtattccatggtgtatatatgccatgttttctttatccattccactgttgatgggctcctgggttgatcccatatctttgctattgtaaggagtgctgtgatgaacatacaggtgcatgtatctttttggtagaataatttattttcctttgagtacatagccaatagtggccaatagtgggatttctggatcgaatggtagttctgtttttagttctttgagaattcttcaaactgctttccatagtggctgaactaatttacattctcaccaaaagtgttcccttttctctgcagccctgccaacatcatctgttatttttttacttttaaataatacctgctctgactggtaggagatggtatctcattgtggttttcatttgctttgctctgatgattagtgatgatgggcgttttttaatatgtttgtgatcacttgtatgtcttcttttgagaagtgtctgtttatgtcttttgcctaccttttaatggggttatttgtatcttattgatttgtgtaagttccttatagattctggatgttagtcttttgtcagttgcatagtttctctcactctaggttgtctgtttactctgttgatactttattttgctgtgcagaagctctttagtttaataaggcccccacttgtcaatttttatttttgttgcaattgcttttgagcacttagtcataaattgtttgccaaggctgatgttgagaagggtatttcctaggttttcttctaggatttttatagcttgaggtcttacagttaattctttaatccatctttagttaatttttgtatatggtgataggtaggagtccagttttattcctctgcatatggctggtcagttatcccagcatcatttattgaacagggagtcctttccccattgcttatttttgttgactttgttggagatcagatagctataggtgtgtggctttatttctgggttctctattctctttctttggcctatgtgtctgtttttgtatcagtactatattgtcttgattactgtagccttgtagtatagtttgcagttgggtaatgtgatacctctggctttgttctttttgcttaggattgctttggctatccaagcttttttttggttccatatgaattttagaatagttattttctaattctgtgaaaaatcacagtagttacctttttataaacattattttgttactattttcccagactactaactgttcttcataaatatgttttttaatgacagtataatttttgattatttggatatttgattatttaataaccatgatcctgtttggacatttggattattcacaaatgttcactatttgaagaatcagattataagtaaatatttgtccacatattttattgtttccttataatggatttttggatgtgggcttattggattttcaaatatatatttatgggaatatatttcatggaaagtttataagcttttgcactctaggcttattttaatggtcttgcactctaacaaacagtgggtgtgaaagcttaatgccaccttgttagcattggttgttacctttggaaataagtgtaaaaacattttattgtggttttaattcatatttccctgattagtagtgattttgaacattttttcatacttactaatcaattgtcatcttatagagaattgtcttttatattctttgctaaattattagagtatcaatatttttcttattgactaaaagtattctataacttaaggacattaattatttctactgtgtttgttgtaaatttcctttcttggtttatactttgcctttaattttgcctatgatttttgacatgcaggtgtttttagtttttatgtagacatatatacataaacttttcctttacacagatattgtacttagaaagatatttcattttacaggaaatttaaccagacacttttattttcttctgatttttttaatagttatgtttttggttcttttttgttttttttttagatggagtttcgctcttgttgcccaggctggagtacaatggcgtgatctcagctcaccacaacctccgccttcagggttcaagtgattctcctgcctcagcctcccgagtagctgagattacaggcatgtgccaccacgcccagctaattttgtatttttagtagagacggggtttctccatgttggtcaggctagtcttgaactcccaacctcaggtgatccatccgccttggcctcccaaagtgctgggattacaggcgtgagccaccacgcctggcctatttttgttttatatttaattacttaaatcatctagagaatgtgtaattatgtttaaatatgctgtgaggtaaagctgtaatttaattattttctcaccagtttagtttttcatttaatctgtaggattattttgtcaagttctaagagtaagttccaatgggatttttactgagattttgttagatgcataacttactttgggaaaacaaacatctttacaaacttaaatattcttatttgggaatatagtatttctttttagttactcaagtcttaagaatacctttcactaatgttcggttcttcatcttcaataggttctagacatatctttgtatgagtatgtgtagatattttcattgctattaatgaaatctgtttttttccagctaggtctaccaactggtcattttgtggtaaagttttatatttttatatatttatcttttaaataaccagtttactaaactattaatggaaaaattttccattttatttattttgggttttagtacataatatagtatgtaatttagtttttaaaaattgcatgcaattctttctaatagttacacctcttttattatatattttacattatattacatgggctagaatatccagaacagtattaaagagtaataatagccgtctttgtctaattggtgattttattgatgtgctttaccattaattctgacactagctgttgctaatatgataaagactatccatccttttatacttagtttccttaaggtttaaattaataattggtgttggttgttatcagaaagctttttggcatctattgaggtgtctataaagtttttactacttactatcaaactgtacccaaatgtctaataaactcaccctggcagtagataaaggatcaatagcataatggatacatcctatctttcttaacctttgtcaaatatagttttcaattagactttctacacttttattaaggaattttgcagacatattcataagcaatgctgctgttaggctttagcgttagaattaggctagctttccattttttccaatgttctggaaggattcattttgcattattatattctattgctggaaaatgtttaagaatcttagaggtaaaactatctagcactggagcctttttgttgttatagttttctttaatctgcaagagtttctcatctgttctttgtcttacttgacatttttgagtacagggtaaatatttgctggaatatttcttattctaatatttctttttgattaaattcaagtcatactcttagggcacctccaggagtaatatgtctttctcagtacaccatggcaggaatcacagtctatcccaatatcagtgttgttgactttgatcacttgattaaggtgctgcctacagttttcattgtgaattattgttgattatttttataattaataagtaatttgtgggtaagtattctgggactttgtaagtatcctatttcttatcggatgtttgcccactatttttaggatctgatgattttctaactttcatttcttctatatttatcagttggcattcttctgtaaggaagaactttcccttttccttgcttcttccctcatttatgaattcttaacagtatggatttatagatttttattttatccagtgggctatattgcattattattattaattttaatgctcatgttgtttcagaagagctagtgggagacccttcaagctgacttgtgtatcttttgggtatgtttctatcattctttaatacattcctgcttctgcgactggagtttcagcctcttgtcctgtgcaagccctgaatccacctttttttcaaagaaccctggttcctttcagtgaagaatggtatttagaaaccaagatctaggcagtaggtatgctcattgctattggtatgtcattgcttaggagccaaagctaggaaatgtgtgtgtgtgtacaacatgtacacacacatatatacactatatactcgtatcaacatttctaaatctatccatgtatctatcagtatttatctatgtgtgtggttttttgtagattccctttatcaggctgagaaagtttccttctgttcctagttcactgagagtttttatcatatataggtatttatcatatgtggatattgtcaaataatttgtatctactgagatgatcaagtagttttctttttaatagaggaatgtcttttaatatatgaattataatgattgatttttgaatgttaaactaattttgcattcttgagataatccctacttggtcacagtatattattctttttatatgtagtatggggtttttttcctaatattttgttaagtacttttttgtatctctgttcatgagggatattggtctgtggttttctttacttgtaatgattttgtctgattttgatgtcagagtaaaactgggcttataaaatgagttgggaagtattctttcatcacttattttctgaaagagtttgtgtgaggttggtgttgttgcttccttatatgtcggacacaattcaccagtgaagccatttggacctggaattttctttgggggaaacttttaaattactaattcaatttctataatagatgaagagctattctaattttctttttttttcttgtgccagttttggtaatttatgtctttcaagaaatgtatccatttgatctaggttgtcaaatttattggcataagttgttcatcacatttttattatccttttaatgtctgtggatctgtagtgatattccctttttcatacctgatgttggtcatctgtgtcttctttttgctttctctgttagtatagctaaaggtttgtcaatttcattgatcctttcaaagaatcattgtcttctggcttgcataatctctgatgagacatctatgatatttcttatatttcttctcctttacataatgtgtctcctcctcatgggttcttttaagattttcttctttattactagttttcagcaagttgactatgatgtgttgatgtggttttctttttgtttatctcatttgggagtgtattaagctccttgaacttttgagtttttaattttcatcaaatatggaaaatttctggccaatatttctttaaatacctttttccattctttcctcccttttctccctatcccctcagcttctggcctccaatttcatgtatgctggaacacttggtattgtcctccaggtcctatcactgagtttctgttttgttggttgtttgtttttttatgttccatttttagacagtttctaggtgtatcttcaagtttactttgatttatagcatttcatcttctgttaaccttagttatttaatttttactttaaatattgtaattttatttatttatttatttatttttgagatggagtttcgctcttgttgcccaggctggagtgcaatggcacaatctcagctcgctgcaacttccgcctcccgggttcaagtgattcacctgcctcagcctcccaagtagctgggattacagtcatgcgtcaccagacctggctaattttgtatttttagtagagatggggtttctccatgttggtcaggctggtcttgaactcccgacctcaggtgatccgcccacctcagcctcccaaagtgctgggattacaggcctgagccaccacgcccggccttaaatattgtaatttttagttctagacgttccatttggttcttctttatgtcttcccgtatctgttcttattatgcttgcagttttctttaaatacttcaatatagttaaaatagctacttaaatgtcctcatttgctagttctattatctttgttattttctatcttctaggtctatttttctcctctctcttttactttattttgaaataattttatacttttctagaaaagtcacaaaaatagtagagtttagatatgatgttcacccagcttccctcagtattagcatacatgaccatactacaaagatcaaaaccagaaaatttaccttattgtactttcacctatctttccactaatacttttttaatttcagaattcagtctgtgatggtacattgcatttagctgccacatctcttcagtgttttctaatttgtaagagtcccggccgggtgcgttggctcacgcctgtaatcccagcactttgggaggccagggcgggcagatcacctgaggtcaggagtttgagataagcctgaccaacatggagaaaccccatctctactaaaaatacaaaacattagccagacatggtggcacatgcctgtaatcccagctactcgggaggctgaggcaggagaatcacttgaacccaggaggtggaggttgcagtgagccgagatcacaccactgcactccagtctgggcagtaagaggaaactccatctcaaaataaaaaaaagagtccctcaatattcctttgtctttcaatgaccttgacacttttgagagtagtagccagtttttttataaatgccccttaatttttgagatactttgaaactatgttaatatcctatttcttttacgatcatttcactatactactaactaataatactgacaaacactgtatagcatttatgtgcttggcattgatctaagcactttacatataataactcatttaatccctacaaaaattataatcatagagtgccatacgagccagaatagtgacacccacccaaagctcaaaagatgagaggaggagctgcttaaacacttgcattattatccctgttgaaagttagcttcttcacaataggaactctgtaccattcaagcttgtgtcttgcacggtgccgagcacacagtatgcaattggtaaaggatgagtacatgatagtcagacaggttgaataatctcagcaatattctcactaattgagacttgattgttttttccagcaaagtcgagatctttatctacctttaaagtgcctaagctgttttctgggtttcttttgggtccttgaatatgccaagctgtttccacactggtgcctttgtatgactggtttgtctctatgtgcctttttctgaatcttcacaggactggctccatcttgttattatcacttatcttaatcacttttccagagacccaatccttgaccttcctcccctacccccacccagctcctactcagtactctccataccattttcctgccttactccctgcataggaccttgcctgactgcttcacatatagtcatgccccgcacagcaatggtttgattgatggcagactgcatatgcgatggtggtcccatgagactataacacagagctgaaaaattcctatcacctagtgagttgtagccatcataacgtaaggttgtagcacattgcattaccttttatatgtttaaataagtttagatatacaagtacttactattgttttacagttgcctacagtattcagtacactaacatgctatacaggtttgtaccccaggagcagtaggctgtaccatatagccaaggtgtgtagcagactacaccataggtctgtataagttgtataagtacactctgtgatgttcacacaacaacgaaattgcttagcaacacttttcccataacatatcccatcattaagcaacacatgactgtacatacacagcacctaacttggggttgcatacagtagaccttcaacagatgtttgttgcatgagagaattaaccaaccaaccaatccatcaatccatcctggacaccccagacaggtgttcagcaatacagtgttggagtccttgacagccttgtggctaaaccttgaacttcaagagtcgttctgagaatgagttttctgtgatgcattagtatttgaagtccaaggacttattcataaactcactcataaacttgtatgggccttaaatttgtgtgttaatgttgctggtaataaatgaaatagatacagtctttaatctctctggataaagggctgtgaattttcttctgtcagttgattgaactgcacttactggagtcattttacgtagcatttagagattatttatattaagcccgcaacctaaattattgcagtttgagaatatatgtggtttttataaactctttgtattcacagaggcttgaataggagctcatattatgatttagctacaaattatttgggaatttggtaaactggcaattttgttttcttgcctgtttcactttacctttgatgccaagttgaagatctcactggcaatgtacaacataactgagctgaataataattgaaaagtgaaaaacaaaaggtattacacataccaggtgccattttggggaataatattaggaataaatccatgtgggtttatagttatacataaaatgttcatatacacacataacacacataaacacacatatatacacataagtacacacaaacataaatgcatacccacatatggcacagatacagacttaaatctacatagcctgtcctttagaattctttaaggaatttcagactagagcctttttagactcttgtactaaacattaggatacgctagcctacttgaatcctttggccctttgcttctcttacttacatcatttttctctttgattaatgtgccaagtttgggaaagcttcacaacatttccacaaactgcaaaaccacttgggtacatagacaaaagcctccatctttttcatcaagccatatatttttttttttctgaaactgatcacaggttgccaacattcttttttatttctagtttatcttcaatttaaatttaccttgtagtctcagaccctgtcatctttcaaggtttgtgcttctcggttctgcactgccaaagagactctcctctgtaaggcttaaattggatgtcaagtggaattgtcttttgtttgttcgaatctgtttcatattgtgctgctgtccattcccaaaatcatatttctcttatttggggccttagcaagacacaaaggcaagctctaagtgagaacctaaagtgtacctgttttcttactaaatgtacagtgttgtttatattgtatgcaaacttctgacaacagtgaacaaatatcttaatctttaaaaatataaataaagtgaaaaaaggacttcacatcaaccatgtttcagtactaaacagactaattaatacaacatggcaggattgttcctggttgtagtctcagttccgccttaattctgtgagccatggaggaagtcattggcatctctggcccccagtcacttctcagcatgaaatgggactatatcatcaagattttttatgtctttccctccagccgctggtgcttggggagccatgtctcctttacacctgggaggaaagtgcttttagagttatctttcatgcagtgcttaccatgcactaggcactcccctaaactctttagatgaaccagctcatgtgttttgctggaagaaagtctggaagaaaatacaacaaaatgctcatactgggttttggggtgcccatgatatgtgtatatgtatatttcttttcttcatttttcaaagattatttcactttgccatagaaagaaatacaaagaacacaattgttggaaagtaataacaaagactggcaaagcgcattgtgatttttaaagcaactttgacatgaatttatgtgtttaatctttccaggagccatatggcacaaagggtattatttctcttgttttgcagttgaacaagggaaggtcagctcatttccccaacatcacacagctaatgagtaactgagccagaacttgaattcaggacctctcacatccagactctaccacatcaaattccctttccccagtggctctaactttgactctgttacatcctagaacatcacctctttaccagatatgaaagacaaccttttcacatagtttaggagttgactttctctgttcttaaagctgatctaacttgactagctgccttgtattacatattttctcccaaacacccctttctctaggacgaatccaaaatttggcaatcttgggagttagctatgtcatagtcagatctcttggaagacaaagagctccaggtctagagaagcaagtgggagggtgttttccaagtgtacttagaaaatgtttatgagctttgtcctcatctgaataatcagaagatatgatttgatttttacaccttggtatacacttggagattacacagtcctgaggtttatatattcctcagagccattagactgaccaaaagggttcgtccctgtgtttcatagtatttttacagttctcacagcaatcacttatcagtatttaaattgaccttagctgggcacagtcactcacttctgtaatcccagtactttgggaagctgaggccagaagtttaagtccagcctggacaacatagcaagactgtttctacaaaaaaaaaaataaaaaattagccaggtgtggtggcacacacctgtaattctagctacttgggaggctgaggagggagaattgcttgaggctaggaattcaaggttacagtggactatgattataacactccacttcagcttgggtgacagagcaagaccctgtctcttaaaaaagtaaaataaaataaattaatctttacaacaaccctccaaggtagaccagaaagaggtggtatccttattttattgatggtctgtgtgaggtcatacagacagtaggtggccaagcccagatgccaagcctaagcctcgttccttttgtttacccaaggttcctattcataccattatatgaccatttagccttaaataatctgttttaattgcaaattttattttaagaaaggaaaaaaatcacatttattctgctgcatcttcttgctttattcataatgaattctgcaggtcaatttatcctcaacgatggcaagccagaatttaagtaaagcttctacttagctggtacatttgcatgtcaaatctttaattcagctgtcagtgttttagcatttactgtactttcattaataaatgttattttgatggtctcaggctaatcaagactatttgaaatgggggacggcaccaaatgaaatttacagagaaatcagagcttcttcatggactttaaaataattgttactttacacgtgtttgaaatcagaatacttgtaaaattaaagttagacatgttgttcttgcataaacaagcaaaagaagctaaggaatcaacttagatttatttgttcctttaagagcatgtactgagcacctgctgtgtgctagacatgttgtagatagaggaaatgcggatatcaacatggcaggcaaaaataacctgccctcaagaatttccattctagagcgagtagacagatgatatctcagatagtgccagggcctatggaaaaagctgaccaggcagggcactgaattctggggagtgggtggtcagggaaggccttgcttccttctcatccacattctggcatagaagtttgatttccatgtacatgtttttttttgtaacatatagctccagaatacgttatttttaactttgcactcaataaaaaatcaacttgtagtaattaaacttgttcagtacattcttcacagggacattaggtgctactacttctatcagcaacaagtatatgcttatctattttttatacattggagtctacacaaggcttcctgctttttataaaaggaactgcctctacaaaaaaaaaaaaaaaagaaaaatggtttaagaattactcatctcagaacgttactttcgtgcatttcttgtattttattttttttcctataagatggtgcccatcctgtaagtttgggccaccccaacattatatttcactccctttgaacattcaaagaaaaacatacttcttggtgtgctctcgaggagcctgctatgaaccctagaatgagatctcggaggctggccacgatgggaaccccttcctgtgtctgaggtcatctcttagaagcgaaaatgctcagctgccctcaggactaaacccgccagccctgcgttctgttctaggagctgcagatggtgcttggggtttcaggtgactgtttctcctcaccaggacacaccacatgttttcctttcctctctagatggcagcacaaagacagaaaaggggcaagtgatggtggtggctccacgcaaggcttggcggttttccctgcaacttcagacactcccagaggactcggactttttcttctgcacttttttggaaaatcgccaggtgccaaaaggtgcattttaaagcgctgactgtaaatgctttatttctttgattagtaccactagtctatgtgggcagcggcattcctccctggagcactcagctaggcggttccgtccaggagcttgaaagcatcccagcggtgcacctgttcagtctgaggacctcaagcttgggtcaggccagcatgttttaggtatggatgtggtgacttaaagtacttgattgtcttgatttcaccctgaaagctttggcaaaccaagtttcaacccttactttaaaaatctgacactgctttactccatatcaatttggaagcttctaattcataaatatacctaaacgttggcattttatctctccaggagttattaaacatttcttcctttttagaa

SEQ ID NO: 693 - DNA, 71647 bp, Homo sapiens
ttgtgtttcatttctagacttttattctcaaagggatgatgaggaagagacacggcttaagaagttttgagctgagaaatgaaaagaagtcacttttctttgctgccacagaactaagtagggggaaaattaagcccaggggttcatttaacctgttacaacaaaacacagaaaccagacggcaaagtgtcatttgcaaggtgatgtgtctttgtcggagctgaaggctgtcgccggtcggctgtctccatggagtccccatctggccctgcactccccacagggatgatttcatcaggagctgaaagaacacagaggggtgagcaagtgatcgagcctcagactgtctgtctgggccagaccctggggaacacgtgtggacactacgggcctccttttctactcagtgtgatcctggacaggaagaattcttcacagccaaggccaaacagcccggacagaccactgccttgtggctatatgagttctttgaactgccctgtgccatctttttggtcatacccacatctttgcttctgcataactcacacaatagcaccaagtctccttgtcttctggcctgtggctgtctgtgacttctgagcagcagacacggaggctgaaggtcagagccagcattgccactacttgacctgtaaccctggatgagttactgaagctctctgggcctcagttttcctcatatgaaaaatggagaaataacacctgccttccagggttgttatgatcattaaactagatgatttataccaagtgagtcacgcaatgccccatagagcacaaactcaaagatgccaattagtatttctaagcatgggagggagccctgggagaaggccctggagaaaaaccgcctccgggactgtgagccaaggcaagagagagagtgggatcagagaaggaatgggatagaggccgggtggaggacactgaatctatctcctcccgcgttccctgcagtttcatttggaagggcagcgtctgagattttaaagtcatatatcattgccatttccttttttaaaaatataaatcattgtcccagagatattcaagttcagaaaggcgcatgtattaggtctgaggctcacgtacatctagtattatagaaagcgggaaatcaagaggggctcctgtcttcggccttctcttcccaaaataatggatgacttttttttttcactattagaggctgttagcactcagacttcatcctgaacctggattagtgatcggttttgttttaagatcctaagagcacaaacaatgagacagaaacaggctccattcgctaatgcactgctcattgaggaatgtcagtgatgacatacatgtggaaaatttggggctaccagacctctccccagtctcatctcagtctcaggcccagaatgaggtgaaaattggagagagggccctggagcagagaaagggggattcctgggacatgtagggccatgtcactgaggcaacttccagcaatgatttacaggaagcgtttagctcatgcatatattggggccaatctgaaaaggaatcaaggttcatgaaactctcaactgtgacattttatagggtatggcgcaaccagagttagctaagtacagatatcattagctatatgttcatttgattgctattacatattctctctctctgacacacacatacacacacacacacacacgcacacacacacgactgaattatattcagcagtattttatgctctttggaaactgttacttattcagatacaggatgttttgtttttgctttttgctgattctctactaattttattattcccaatactctctttcattttgaattatggagtttattgcagtattgtattttttgagatgtaaaaactattataattagaactaaatttttcaaaaatggaaacatgcaggttaaatgataaaaatagtgtatttgtgaaatttgggttccgttttgttttgtcatcatagcaaatagagaaaaaatgagttgattacagatggaagtgtaatttttttctgttgagaagacctggtcatctgcctccacatccatcaccacccaacagcactacaaagagcagctgaactctcccccaatactcctctgtgccccagtttctccagatgtaaaacaacaccacacaacacatctgtctccccctcaactcaaagaaatgttataagaatctttgagagaaaaaaatatccacaaaagtgttgtgatcccagaacttatttgttttgtatgtttgtaattgtatgaaaagtggaggtcactctagtgaaaatgaaaactgagctggaaagggctggaattgctaaaatgagcagaaatacggtaaaggaaaccattccctgtacccagcagctgtcaggctgtgttcatgatctgctcttgcttcctgagagcaccatgatttctttgtaaccaaaaggaataatctattttctggcctaacctctcataaggtattttggagtaagctcaacactaggaaacaatattttacagatatcttcgtctcctctttattcaacactctaattttttccccttgcaatttctcttctcagaaatgtagcttttcagcgttgattcatctctcctgcctcatagcacatttttctctcttctagcctgaccatttttcatttctctcacttgtatcttaactggatcttccatctcctccacttctactcctatttcctttaaattcattttcttctttcccttttctctccctaaagagtgaacagagaacagacagaaaggacaatcagctaggactgtgctgagaaaatgaactgaaacagcacagtgaaagttggacaagccaaacctgactccatcaatttgggttgatgcctctgacaattcaaacaagacttggtcagcgcagaactgcaaggctgtcttggaattttcacacatatatgtttgacattctactccaattcagttccacaatccagatgctggaagaattttgtttacttgagatggattctcgtccatcatctttcgctcccacaaaaccattgttcacaacccccaaggactgcctatgagtaccatcattttgttacagttaatgctcattgttgtgcacagttgggaaatgtagccttctggttaattacattttccaattaatagaaattacaaggtacatcttccatgtgttgctgacatctagacacctgggatactctaagcaccaaagctaacttgaacaagtttagtctttcttggaaaatttagaggaaacttcaggactcatggaacatcaagggtaccaaagtgtgttgtagatgtgggtagtataagataattgggattttcatttggtacaatgtaaaagtggtttgggggtatgtaatagcacaagtcacatgggaaataagggtaccatgtgaagcacattatatctttttaaaattatcctcctcagtattattaagtgtttaaatgttcaaaggaaagaaattcatgccctgccagattacaaaacagtatatacatgacaattccatttttgtaagaaaaagcatgtctgtatacacatatacacagcctcccatataaaagtcagggaagatatgacccatattttaatagtagtctctctgaatgatgtaattataggtgctttggttttcttcttttggtttatccatacttattaaaaattaaatatttcttctataatacaaataaacaaatagtctttaattggaaaaatcacatagctcagtattaaaatcagcacagaaatctatctcaatgtagatcaagaacagattaaatgaaaagaatggttgcagaagaaatcttcccatttggaaaacacctatcatgtgagattgtcaaacacaaacttggaggctggggagttgggggtggtagtggctgcagcgatagcagcatggaatgtgaggaaatgctgttgccttggggaatagaggtgggatgtggatcatcacctgttatcacaggcaggctctatgaatcatacacgatatgatatggggttacaagaaggattcttacaattgccattaagataatcacttcatagcatttctgcatctgtttctaaccttctaaacagaataagatatggaagaccacatcttggtttcaacactgattctccacgactggggtggagggtttggcctgagcctgaaatcaggcactcagtcttctccagggccctgcaccaccacggcttcaccccattcaccgcttcaccccattcaccgcttcaccccatcctggtccttgacagcacagggcttgtgccaccgtcccacctctctccccaccctggactggcctttgctctgtgtggtctccacttgtgcagagccctgtaccgctcccacttgcttccatctcagttttcccagcgttcaccctcatcctagaggaagagcaggggatgtgtgaacagacaaaagagacacaaattccaaaaatgaaattttaggggaaattctaccagtgagtgtatacttctaccctagcgatacaaagagtgcagtggcatttccaggatgagggaaggggtggctgttctaggatcacactgcctggttgcctctttccatccatgaacaaaagaggccatgccgtgcaggaaataaattcccagcttccagaagtccccacattttccagagaccagagcagatccttgcctattcttgtttctgctgttgcatgcaccttgtctaagaggttttccaaatcccagtgtgtgtttcagcatcacttgtgcacactgtcatgctggagcgccctgcacaaggctgggagcctgacttcccatgtggattcctctgtcccatttgtctgaagctcttcgcacacaacagatcgtatttaaaaaaaaaaaaacaaacctctgcagtacctcttacagttttgtgttaagacccatatatttgttaagcgaatgaatgcccaagtgactcagcagtccgcacacctgacactctgctgttttcaggtgctacatactatctcatctatttctcaaagcaaccctgtgaagaaggcccgccattacccctgccttcaggatgagaaaaatgtcttgaagaggacttgcccgaagtaacacacaggtcgctgactgccaggacctggaattctgatttcagtctattgccctttccatcacgatggtgatccccaagccagttggctcatcagaatcccctataaagttggttaacgaaccagtcacagccctactgcagacttgccaaatccctctcaggtgaggctcagccgtctatactatgaacaggttgttccacagatggtctggctgccctcccacccatgccgcctgtgctgaccagctctgatttgacatctggtcgatgctatcaagggtgtcaacacaaaacttcaaggctagccctgacactgaaaatcctatgttcctccattagtcacctccttgtgtgtgaagagttcatttatacctcccaggatcctccttctgtaggagctaggttaacggctcaacttctagaaaacccaaggttaaaaatagctgtgacactcattagccccaagggggaaaggtcagcaaagtttgacagccacacttaggaaggactgagagaggctgcagaaagggctcggagctgagaacagggacccagccttccttagaagcctggctccaaaccagctgggccccccctaattggccacgtctgggaaaggtgctcgtatagtcacgactctgtaaagcaaggggcaagggccctggtaattaagtgaccacaaacccatccaataattactcatcagggagactgcaaatggtggaaaagttcttcctgtttggaagagtgagtgaaatttggagggaatcagcaacccaacccctccagcagcagaccgctaaagtctaacctcatcaggagagagaccctcaccactcaagttctccagaggaacaattaggagttgcttgagaagtcccccaagctgacttaacctgccatgaacccagcaagcagacgccctctgactgtgatttataaggaaggggtcgcctccagagaggggcctgggctgcttgcctaagtgctgtgtgcaggtcagcctggaaaccattattgtcatcaacaggaggatcagttaggagacaagttgaagcaagttgaaatttgaaaaacacattaacagcggcctgacgagatgccagaagagtctgccagcagggacagctggaaggccaatttctgagtcaatactgaaaggtggttgcttaaatatctgagtcaacacacactgatttctctccggctcaatactcccgtttaattgcactagggagtctctccactgacaaatctaacaccaagatatatagttaagtgaaagaaaagcatgttattgaagtgcaaatgaggtcctccatgcagcctgcaggcctgggtcccgctgagcgctccctactgccctggcagaaggtggttgggccttgcagggactccctgtggccccctttttaaagagggtcgagatacgcgtgagccccaggcctcagctggccagcagagagaagtctaggtgcgctgcagctgcacaggctaccaagactctgagatactttgtcaggatccacggtcctctccggggagagggggccaggagtgcccgtttcccacccaagagggccaagtcagatggaatggtgtgccactgaagagccatcatgtttggcagccaggtgaccacctggtgagattggtggcagagatgatgaacgaagcaagtcttgaacgtccacccagctgcctggagcctgagaagcaggttggtctctgaggagtcctgacaggtcatggctactgatgcagacacttccccatcgcgatgcccacataggggccgggcaggatggcccaggggtagtgacgaggctgggggctcccacagtgaccctctggcagccttcactgacttcagagctaagcatgatataggagacctagctagacctgaaaacccatgagaaccgggacccgaaccacagtgaagaggcagctcccatgagcaggtggcatgagtcctccactgctaaattctatgtctgctgccaactgtcaaagatgaggaagaagcccatgtcagtggtaaacccaaactcaaattactggggcacattgtgaaagggcagtttctggttcagtacgtctcggtgtgggtagctttgggtccagtggcactcctggtgcacaccagtctgtcatgaacccacagtgtgggagtgcttcctcattaatacacctgctaatcacaccgaacaatcagagatctgttcagatggggcccagaggatctgagagacaaatggctgggccattgtcaacccaagcagttcaagtgcagtggccaccacttagggaaactatggaattgtcttggtctgatgctcaaaatgaactcacacggacgtgatctgccctagacaaacaagtctgaaatgaagatcaaatgctatttcttccacttactagttgtgggaccttatataactgttgtgtaaataagataatgtgggtaaaatgcctggcacaaagtagttgccaaaaaaatgccagttcaccgctcgagtttccccccaaaactgaggtggcctcaatttttccttctctagttcagtgttgctttttgtccaggaaagccacagttagaagaggtgctgtgaaatttctatctctcacctctaagcaagacatccagccctgctggtccctgtggcaggacctccccatctcccacgcagcagaagtttgaaaaattaatttactcatcttcctggagcataaagagttttttagaccttcccttctgaactgtttatggaaccgccatttaggaattcaaatggcagagccgttctccctctgaaggtctccgggagccccagcgcctcctcacctaccccttatttcatgctcatgcttttttgcacgttgataagcagtctcaaggccaagactgtcccaggccccgacacacctgtctgatttcatccctatgtctcccttcctcttgcagccctttccaggcacactggtcttcttgtctcctgtgaacttgccaaggctgtttctgccttgggcacagcgctgcctggaagcccctacccaggtagccacatggggtttcttccttcatccaagtctcagctgaaatgctgctccctctcagaagacttcactggccctctactgagttttatttttttcttaacattcatcactaccccaatgatcttatttgtttagttacatgttaattgtctgtttccctctactaaaccacaagctgcccaaaggcaggaatctcatgtgtttagttcagtgagcattgcagatcccaggacagtgactagatgctttgtccattcctgcagcagcaacagttttccaaggaacactatcaaatggacctatgagtgttataattctatcctgtaatacgttggacaactattcagggttttgggcactgccagaaacatgcaactccaggaaggagaggagtggggacgggagggaaatgcctccaggcaatggcaaaaactttgctttgagcttctcatgtcccagaatgcaaatgtccatctgaccccaggatcagagtgagagaagttttgctctgtctcctctcacctgaaatgaacaggaggctgctattcattccctcaacctcaggttctaggatcaagctagagggaagcctttgggcatcagggcagtgccaatgccaagggctcaagcaacactcaactttagagatattgtctaataaagataacgagagctagactttttatatggattattaagctgttctaactcatcacatggatcatttcatttgtcttaagaaattgtctcagtgaccagagatggtttttagaaaatgcatgagatgtgatcccctctatactgtggccgtgccgcttttaactccacacggatcacctagcatgagggttctagaaaaagatgggggagctgctgctacaggggttcatgttgtccacccatccctggttcttcattattcctttgtgactccatactcaaaaaccaagccttgtcagtcctgagaatggctctggctctgagggagctgaatgactgccaaggccgtccagaataagcatgaattaagcaaaccctcctgtccctacgaccctcaggacaaagtggagaagagagtaactgggctactctgcggaagtgtcaatgccctgaggtctctgtaaagcaccagatagtgcaggaagaggaagtctcagctctccttagcaagacaaggcaagctactgagggccacgctgtccagagaaactttgttttgtggatgcacagaaagtaatacgtttttctggtattagagattcttttggaagcgagtatagatggccctgccggaatgagagcccttgggacacctgggataggggtgctcaaaacaacagtttattcaaaatacagcaagcaagtcagtagcgtcctgccccgggacaccaaactccacctgtgctatcccttcccggctctttctcactgcctatgaagtgacctctgaagtgtccgattgtctttatgagcaatgcaaggctggaagtattttagaccaggcctgctgcactcaccgtctgcatctgctgcgtttctgtcggggatcagctgctgactgtcggcatagctcatgacggcagcagttctcctgtcttcatttccctgagcacttgcttctgcaaaaaaccgtgagaggaaggaaaagtgaggacggttgcatgagtgggcttcatggctgccgaagtgggagactttttttggatgcctctgaacatcggctgcccctggcaggtttcccacaggtgcccatcatgtgaaggactggatggaagttccagctgttggatgtcgtggtagggaggctgaaggacatttaacgtgtttcatgtactcattacctagaacgaggaaatgcactgtcttgagaacgaagtggaggagaggaggctcatttgaggaagagctctcctggacactatcctttcttgtttctgtcaccttctgggtctttttgtgctagggtggagtggggcacaagaaagaccctgcagggccctttcttctgcattgctttggtcttagacatagttcttaatgctgactgcacactagaatcactgaagtgccctcgctgctgctcctccctaagtaacccccccaaaaaagtcgtgtgtgtcccatgggagataatctgagggaatagacccatgtgaaaagagtatcagtgaacataacagtgtttccatgcccctcccccatcactgtctttgagaggctctatcttgcctcatggagatgtcagtggtcactgggagaaaacaccctggaccccggaagttaatggggttccttaggaagcagtatctgcatgaggtctcccctgagagttcctggccttcctgctagagcccccatgctgcagatgaaggcaggcagggagagacagactcaccctcccccagagcctggtggctgaggctcacagcaggaaatccaaggctgctggggaaagggagaggggactgggaaatgcacagaagcatgaaaagggttgggatccttccttcctgggaccacatatatgtttgtgcagttttctctacatggaggcacctggccaaggggttcagggtgaggactgacctcagtccacacagaggttgccattttcctctatgataagccatgtctgggggctgtcgaccccatagcccacaaaggggtccttgttcttaatttgcacagagacactgactggggcctcgggggatgggggctgctatcccctgccctcctttcacacctaccctccctcctctttctcaggctccattctgagggctcccagttgaggcacccttcctcactttctactcagggttgcttttccctagctcagaactgaaagtgggtttgattctactgactcagaccttgctccggaatactgtttctctaagaagtgtgggaaccctcagtgaacgagtgggagagagcagtgtggggttacagccaggcacagctgagacccatctgccctgtcctgtgccaaagcctccagccctgccttcccctctccaatgatcacgtgatatgatgccccctccccactttactttgttcatttcttgacaacgaagaagagaaaagggggggatgtttgtttgccttctctctagaaaccctctgtactgtggggctggcatgatggtgggtgggagggagtgggagatagcagtggatgaggtgcccagagcctggaaattctggggctaaaacctctaatgaggactgctcctcgtccttattaccaaagttatttcttgttttttatttagatatttgtatctcagtgtctacaacagtaaaatgtggcctaaaccaactatagctcacagggatactacagtgagctgatattagaatgaaagcattatgacaacaattttaaaaattcttcaaataatccatcttttctttgggatagccccacttttaaaaatagtcatcataatccacatgtcccaaagagacatactgcgtgtaatagctgtgtaaataaggaacctctggactttgagattccccttgtgggcctctggagtggctaaagattagctcctgtcagaaggaattcattcccttcttggaggttcagaaaggcttgcctcctattaccaggtttccccttcaggtcagcacttctgtcttagccaggctgtggctaagggaccctgagtgtgtgggactgatcagccttgcagctgatggagagctcgccattggattccagcttctttttgggggtaccatgagccaaacagtaatccctggtccagcttagtactgggtttttttaccctaaactcccaccctcttgtcattcctggagctgggtgagtcacaaattttgtccctcatcccagttttggaagctagaacaaaatgtgaaaaaggttccagcacgcgagggaagcctgtgctggagcctctgaggctgtggagcagaggaagcactcacaaatcattccccagctaccagagagctgcatgggaaacgcccagagaagaaccttgaagactaatgtatgtagaactcttcagctggatctatcggcccagctcaaagaacgtcataataaccaggatgcaagagaagagtgttcagggcaagatggttgaactgagccctggagcttggtggtgggcaaggatgctttctgtgttgaccctgcaaataataaacatatctgaagtggttagtggaaaaactactcaacactaatgacaaagcttctcttttttgcttacccttgtgatcaactggggttttagatctccccatgatctcatcctctgtggcattcaagttctggatcaaaaagtatgtggtcattctccctttacctttcacttcaatttcacccctctcaatgattttaaacccttgatttttcaaggctctgcacagagaaaaaaagtgcatcagatatcaaagattgtgggtctgtaactcaagagttggctacaatgcaaagggctactcaagaggaaaagtccaggacacaggacacacaacagcaggggagggaagatcccagacatctgcctgctgaagcaggacagaggccgtggggaaagtgaggatgagatattctgaacaggatgccaaaggccaaaagagaacacagggacccatcaaaaccctcccaaccctgccaccaattttcctccctccagctcaaccctcatatgggcatctctcacgtttctacacaccatgctgtcagtgcccatgtggacaccacctttcatgtttctgccacgtaagactcttgggtatcaacactcttctttccatcttccccaagtgcaccatataccccatgcttgctactatgctcatcctaactacccaagctttctccaccacaatttctgtctgccaaggaactgaagaggaggactatagggaagggaccatgaaaagagacagagctatggggtaattacaaaacgtttccctgtttatttatttactagccaccaagtgatgttagagaaaagccaaagaaccactcagaccaatgaggattcaaattcatgaccacctgcctcggcactccatcgagccttcccttgcccttggccaggttggtagagagttcagaccttcaccacagtcctcatgggcctccatttggcatctgctcccctcactcatacgctggtggctgtgcctcctactttatgccctgattcatctacaaaattacattgattacaggtgagagcctgtgacttctcaccccatgaccacaccatcctgtcccccaatctccgaggatgaggtatatttcttgtccagggtctcctcaccctcacccccttcccaccacctctgggccttgctccattggccaccccacgcttatcttcatctcccattccatttgcctttctccttctgcttttcagtgtgcttatgtctcttccatcctaaacagaaacaaacaaaacagcctctcacctgctttaatctcatgcaaactttctcctctttttattcttcagcccaacgtctatcccaccattctactacaaccacttttgagaatgtccccaaaacctctagtgagtatttttcagtccttattactacatttgacatttttgttcaattcttccttcctaaagtcatccacaagagtgcttctcaccctcaactctcctggtcctttctgagtatttcttctcctgtctcttccctgggctcctcttccttctgtgccacttaaatattggttctgcacaggattccattcttttcccactgttctttgcacactgcatccttccctgggttgatctcatcaactctcatgactgttattaccacctatatgttgcttactccaagtctggatcttcaataactcaactccatccattttatggcacctctagctgaatgttccacagttcctttgaacccagcgtgtccaacctaaactcattgtctgcccctatgatctgggatacttctcatttgtcccattgcagatggccaggccaccattcaagccctagtcacccagaatggagacccgggctccccccttcttctcatcccccatttctaactactttagctggttttattttcccccatattcccaccactaatgttctgattcagaccaaactcctaacaggtctcatctgtctcattttctggttctcaaatatgccctttcagggtctctagagtggtcagtgtcaaataggaccctgaccctgtcactgtcttcaacctcacattcgttgggggcttttcctcacctacggcatagggctcttgcccttcagtaaggcatgtgcagctctcactgctcctgcctcatattttccaatacagaaaacctcgggtgtttatagttctctgcacctattctacatgtgagcctctacccactttttactcccaataccccaattttggctaaattttactctggaactccttgctcaagattcagctcaggaatctcctccatgaagcccttttttactgggtcaagcacccttgccctgggctctcatgacacccccggtgactaccttgaggataagagtgcagcagttaaaggggggacactgaactctgactccgtgggctgcatctgggctattctccttcctagcctacctggtcctgaggcaaatgattaacctttttgtgccttttctttcatgtaaataataataataatgtatcttcacagagctgttgcaactgtaaatgaattaacatataaaagaatttagaatagaatgtggcctattttaagtgctcaagaaactataagtattgttttatgcacatatttgtcattgtacttatctcactttaaaaataatcaactacaacttttcttttttcttctgctagaccaaaggtcagcacgctttttatataaataaagaccagatagtaaatattttagactttgtgtatcatatggtctttgttgcagtgattcaactctgcctttgtagcatgacatcagccatagactatatgtaaatgaaagtgcatggctgtgttccaataaaactttatttacaaaaatgagcagcagactagatttggtctgtggggttatactttgctgttccctgaactaaactatatgctccttgacagtaaaaactatgctacagttagaagctcaactaaatttattatctgccacaatatcttctgtaagccattgagacatggaaggaaaaacatgagtttcctgcactaccccaacccatggctgctaggcactctgtaagttctagaaagaggaagggacaaaggaaggcatgaataaatggaaggctacctgtaggctgtgggactgaggtgcactttgttgggaagcccatgactttccatcctagaagctgtgttcacagtgtcaccaaacaagcagtaccgtggcatcttgtctcctacaacatctgctaagactggtccagtatggatccccactctgagctgtacagagacagcatcactgaaaagagaccatctaatactcttgattttatttgtaagttgagatataatttacataaaataaaaaaagatattaaagtgtttggctccatgagttttgacaagtgcttatatccctgtaaccaccacccaaaataaaatgtaaactagttccattaccttgcaaaattatcttgtgccccttctagttaagctctctccccatcttcttcagcagagataactacattctcatttcttctttttttttttttttttttttttgagatggagtttcactcttgttgcccaggctggagtgcagtgtgatctcagctcactgcaacctccgcctcctgggttcaagcgattctcctgcctcagcctccagagtagctgagattacaggtgcccccccgccaccacacccgactaatttttgtatttttattagagacagggtttcaccatgttggccagctggccaagctggtctcgaactccggaactcaggcgatccacctgcctcagcctcccaaagtgctgggataataggcatgagccactgcgcctggccttttttatttcttttaccaaagaatgatttgcctgttccagaacatcacatatgtacaatcttatagtatatactgttttatatctggtttcatttactcaacataatgtttttgagattcatctatattgtcttacatatcagtagttatttttatcactgaatagcattctattgttagaatacaccacattcattatccagtctccttttcatgaacatttagattatttttcagtttgaatctattaaaattaaggctgctataaacattcctgtacagatatttttgtagacatgttttcctttctcttaagtaaatacctagaagtggaatttctgagtcccaaggtagatacagatttaattttattttttaacaaaacaagccaaaaaactacccagcaattctccaaagttgttttactgttttacatttctatcagcgacgtgacactttcagttgttcccattttcaccatcatttggtcttctcgtgggtgtgaaatgatatctcactgtggttttaatttgcgttaaattggtgactaatgatgttaggcacactgtcacacacacattggccattcatatattttcttttgtaaaaaagtctgttcaattttttgcctgttttaaaaattgagctgtttgtcttttattgttaatgtgtatgaattgtacacatatttggatatgtaatatgtatgtattacaaatatttttatcagtctgtgggtttgtgtatttattttctttaataagcagaatgttttaattttgatgaatgtattcatctgcttaggctgccatagcaaaataccacaggctgtgtagcttaaacaatggaaattatttctcacaattctggagcctggaaggccaagatcaagctgtgggcagggttggtttctcctgaggcctctctgcttggcttgtagatgtccacctttttgctgtgtcctcacgtggtccttcctctgtgcacatgcattcttagtgtctctttacgtccaaatttcatatttttataaggacatcaggcacgttggatgagggcttactcttaaggtttcattttactcagtaaagcctctagctccaaagacagtcatgttctgaggtagtgagtactagagtttcaaaataagaattttgggcaagacacaattcagcctgtaacaatgaagtttatcatttttttcccttcatggtcagtgttttttgtgtcctatctaaaaaaaaaaaaatcattgttttccccaaagtcatgatgctattctttatttccatcaagaagctttgtgattctagattttatgtttcgatttgtgatatatatcaaatgattttttttgtatatggggtaaggtagaactgaggtacattttttctttccacatgatattcaatggtaacagaatcattttttaaaaagaggttgccttccccactcaattatttggtgccttggtcaaaaatcaatggactaaacatggagtctatgtctggacactctgtgctgctccagtggtctctttgtctattcttctcccaatctcactctgttttttttttactgttgctttagaataagtcttaaaattagttgtgtacatcctccaattttgttattttctaagagtgttcgggttagtctagattctttacatttccatataaattttaaaatcagcttgtgaatattttctaagaagcttgcagggattttgattggtattctacggaatctatacatcaatttggggaaaatggacagcttaaatatattgagttttccaaagaatacggtatatctctctatttaattaggtcctctttaatttccctaagcaataccttatagttttaagcatagaggtcatatgtatcttttgttagatttactcctagaaatttaattaagtttattttctttttatttcattttcaattttttgtccttaacatataaaaatttaattaattttcctgtatttatgctatgaccttgctaaactcatttattagatcttgtagtttcctgtagtttgtataagagtttctaggtgcaccattatttgttctgtgaataatgataattttatttcttcattcatttccaaacttaatgtcttatatttcttcttcttgccttagttcactgggtagagtttttggtatgctttaactagaagtggttgtctttgtatttattctgcttgggtttgctgagctctggatgtgtgcattgatatccttcatgttgaaaaattctcaactattatctcttcaaatatttcttcttacccattctcactctgttctcattctagcatttcagttacatatatgggagtccatttgatattgtcctacagatatagagtgtcttgttcccctttttaaccctgttttcttctttgcatttcagtttgggtgatttctatttctctgtcttcaaattccctgatttttttctctattgtgtctagtcttcgttgagcccataaaattaattctttatttctgatttctgatatcatagttttctgttagatatagatatagatgtaaatatagacagtatgtacgtatttcccatatcttcacacttgttttgccccttttcttatagaccctttaaaatatttatcacactaattttaaagatccaacatctaggctatttctggacctgcttctattgactattttctctattggctatccactatattactattttcttgttgcttcttgcatctcatatttttcattatctaattgaatgacccatattgtgtgtgaaaatacagtagagactgaagtagataatatttatccaccagaaaatgttacatccctacagaattaggctgctggaatgggcagtaagtaaatctaatccatatttgagttgggtcagggcttttccagaaatattggtagattccatgcaccactggtttcaaatattatgaaggctgaatcagaactttcagtacagcagagcttagaatctgagcaccagcaagactctgaggaccttgaatgctgtacagccaatccacagcttttggagttgtaggagatctcctcctgcattacagcccaacagtgagattttcagaagtctctttgctcttcagtcccaccctggctctctgcaccttgggaaaattttctctgccattcctccttgccctcatacttcaaaaggtcatcgtagtgtacttggtgaagacgaagagtacttcagttggatttctctcagttctcttactctaacattagcctttaatgggccactgctttgcatttgggaaaggccccaaacacctcagggactcgggagttctctcagctctcctctcctgtcctagtttttggctgactaatcccctgcacttggcctatgaggaagagttggtagatgggtacagactctgtggctgggactctttggcattctaacctgttgtttcagccctgtgaccattaaaagtccactaaaatttagacgggattatccctaccctcacctctggtggattacttcttctgctgccctgccaggattgaatgcaattatgggtgtcttctctttgaaaggtttgtcacttcctggaatttagtttattttgattcctttgctttctggtgggggaaaaaaaactgctagcatgggaacaacagtctcttacagctttctacatcctaatcagattgcttgttgtttttacttgctagattttcttctgcttgaaataaaattataatttctctaggaaaacaggattctctgaacccttcaaagcacctagtaatactgtctcatacatggatggatctcagtaaatgtatattaaagctatatgaataaaataatagaatatctcagtgcaaaataattgcacaattctgttaagagagaaagtgtttccagttctctcccctacatccttgaataaacccatatgatatgctgtttctggtggatatttaatgatgctcctaattatgtccatagtcttaccttggaattgctaacatcctttcctatttttttcttggtaaatccaccttgagagtttccaacaattcattgtctaatttcattcttattggtgtagcattattttcatctctggcgctatgcccctttcatacacacatgcacacacacacacacgcacacacacacacacgcacactatgctttccatttttatttttatttttcaccagtgacttacacaagcatcctttaactgaaacatttatctcttatctaaccttcttatatctcttccctcattgcctctcatcctgattttttatttattacattggatttttattccactgatgcacactgtgtttacaatgagtcattatggcagctatcttgttcttgtgactatctaaggccagcttttacttagaagactacagtggatgctgtagccatgatctgcactgtttctcagcttctaactcaccatggtcagagtgagtgcagcagattttcagaatctcctgtaaaaagttataatgtggaaaaatcatattccatcttataattggctttgtttattttgaattgactagtttattttaaatttctgactgatattagcagaggaaggacctagaaatcaaaggcagagagacgccactctcagccatcccaggagcattaggatctgctgagccagcggaggaggacattcatttttcacctccaaaactgttcaacttttagagtgtgaacaaacttccagacttggaagcgtacttttctgtgagaaaggcgagcagatgtctcgctagtggccacttggtggaaggaaagccattctgaatatcttacggcatcacggtgcctggcctgctgactgcaggcagcctcacacctcagcctgagttctgaacctgtcagatggcatgttggagacacaatttcctaagcaggaaaagttggctgctcattaaacctgaaccacttgttgaaatgcttgaacataaaagcaggaattataaatgagctggtgtttaagatggattgagccctgctaggtaaataggaagaactgctcagcactgtcctgaattaccaacaaaggaagcttgcagtcaatcgtaggaaaaccttgagcaccgcagcctcctctgaaatttgagaaaagttgagactataggagccttaggaatatctctattagggacatatgcaagagaagaaaagggctaggatacattacccattttaatgacagcaacttacccagtaatcacctaagcacataagcagaattctacttttgtgtgtgagatgtttggcattaagccaagtactcagttgctctctacctggatgggttctccagtaacaggattcgtcacttcctttgcagaaattctcatccccaaggcaaaattagccactctttgagcatggtttccaataggcactggtacacctcctaccaccatataagcatctcctattgtttctacctgtcagggaaaaaaaaataggtattcagagggattccttcatgcactaaacatgtcactacactttttttcattttccatatatagacaaagggactatactaaagctggtaattgattctttgctaagggtatgaggagcatgagggaggaggtgagaaagaaaaggactcaggaaacaaccatgagagagccaaaaggcctttctgcttttggtggaaacaaatcccagaaaagacgaagctcctggggtagtcatgtgatgctatatatgagataacacattgtttagattcgattttctgctgaatttaggagtaggagaactacactctatgaaaacacctgacatctaggtgcccctcaagggcaccagagtgccatcttagcactgagcattgtaaaaagaatttctaaaaactagaattcctaaaatacttccaattccctttcagcttttattctgaccccacactcatccacaccaaaccccagaccagtgcagacagaggcaaagggagacttagaatcaagcactcgccctgcgtgagcacaccgtgaaacaccccacactgcacagacacttactttatagactgcgtgcacactggttaatctgtcaaacttggagtacatggaattcagcacgttcactatttgtataggttcacaggcagtacagatgttagtaaatgtcactacatcgctgaaaagaatcgtgcagcttttaaattctcctacaacagaaaccaggtatcagtgagaaacaaggagatcgactaataagtccatgaattctggattaagaggccctgtgagaatcaaacctgccctgtgccttgtgggaaaagtagctggatgccattccccattcagcatcacccagcacacgtttactgagtgcccgctgcaagctagtcgtagtaggagaatcatatcacagggggcaagcagaccaggccctcgcccccaaggagcccccagtctaatgaaggagacataaaagtgaacaaatccttccagtaaaatgtgaccagtgctgtgggaggacagaaagggcccctagcaagtgggccaagcagagcctgagctacaggagacctggggacagggctgacagagactggtcactgtgaagtgatgggtccctgtctttgaatggcaggaaacctaccttgtcctgaacacttgctcctaaatcatgcccctgattccaccttggcccccattcatgctaacttccacatagcagccagatgccctgtttaagtcagatctcccattcttcaatctcaaatctttcatgacttccatcacacttagaatgcaacccaaagtcctgaccatggcttacagaggggaccccccacctctgtccctgccacctctctgaccccatgtccctccggctccctccactctggccacactggcctcatggggtttctccagcatgccaagtgcctcctgccttcaggcttctacacttaaaaaaagaggtgtttcctctgcctgacacttttctcaaatatctacagggcctgttactcacatttcaaatgtaaccaactcagtgagaactctcctgaccaccctgtataaaatagcccctagactggctatccttttagcttgattgccttccacccactccatacatttgacattatatgtatatacatatatatatatatatttttttttttttttttttttgagatagagtctcactctgtcacccaggctagagtgcagtggcatgatctcggctcactgcaacctccacctctttggttcaagcatttctcctgcctcagcctcccgagtagctgggactacaggcacacgccgccatgcctggctaattttttgtagttttagtagagacagggtttcaccgtgttgtccaggctggtctcgaactcctgagcagaggcaatctgcccacccagcctcccaaagtgctggtattacaggcgtaagccaccatgcccggcctgatattttgtatggaatggtttatttggttattgtctaccaccccattggaatacaaagctccatgagacgggagactgtcagtttagatctctgccatatcccaagcacctaaagcagggcctggcacatagtaaatgctcaataaatattgagtgagtgaatcaatgactccttgaatgcagccgggtgccttctttgttagttaagcctctgatggtaatttcccctttgtggaactttcccttctccttggcttctggcctatcatcctctcttcatattcctcctacctttctgatctccttgttttatatctttccttggcttctcaaccttcttaagcactagatgttccctaaagagtaatactccactctcttctcacttcctgtcctctaggtgatcttatccaccattcagagtctatgattaaccccgcccacattgcaataactcccagatgtatagctccatgccacaatgttcctatgagctctcactaagattcctaccactgatcatgctgtgtggagtatcccacagacatctccagctcaatggttctaaaatggaccttatcattctcccccaaccctgctcttctttctggccctgtcttaggataaagcatcccatttttccatgcgagaagcctcagacccatgcctgcctccgctgtcttaccttccccatctggtcagtgaggaaatcctgctgattcttcctcaggctgccctaattcaggcctctaccatcaatcagctgcgcccttatggtctttcagcaccccctcatgcattcattacactgcagccaaaatcggatttataaaactcatcctgtcacttccataataagagaagaaacttcaatgaattctcactgcctacaaaagacaatttccttttccctaatagtccaaattcatcactgcatcacctgaaccccaccctacccactcagcgtcaccagaccccacttttccacataccccacgctctgggaacatgccccatggtattcgtttgcacattgccttaactttgactcttactagcccattctccaaaaatgcctttttcctctttgcttgctgaaattcagcctcaaggcccaactcaagtgtcacacacttttgagaggtacctccacaactccaacccacccccctatctcttatctcctgacatctatttattattaatttccctgtccccatgttgccatagcaccttgtgtgatggaaagagtatggattttggagttagatggccttaacgcagttagtttccacctctttcatttatcagctgcgctgaatgtcaatttgctcagcaatatggtatggacaacacctccttcatagaaatgttgagaaaatttaatgaaactgcacatgtaaaatgtctaacatggatcctggcacaataattgctccttaatgcaaattagtttcttttcctttggtcatttccacccccattaatttattctgcatatatctatcaaactcatgaggctgtaaactcctctgtgtccccagatctggaacagcaccctggcacagagtaagttcaccaggcgtgtctggtgaatgaacacaatcccatgacaaacggaaagtgagttcagggtaaacacagcatccctgcctccataaatagtatactgtcccagaatggtcctcagaggaaccctatgatttaactagtgtgcgagtgtattatttctagttaaagttaagaaccctactcattgtcactgagtaatgaggccagtctcaggacatatccttaaattcttagagaatttaatgtgtgtgtagttgacaaccatttttatataattcatgtttcactcctgtattatttttattattattattattaatgtagagagaacaaagctgagaatatgcaggtggagtaattaccccaagatcatgccacttacaagtgacagagccagaattcaaaaccacttctgtctggcttcaaagcctgtggccctgaccactaagacataccacgctctgctcagaggacgctgtggaggagagggtgccttacctgcagccacctttttgccctccctcagctggttggccacgtgtttgggcagcatggcataaagtaaggtctctgttttcttcttttcaatggccaagtgcttggagaggacctgtagctcctccttcttcctttccagctggttggacagctctatctcagccagccgctgctggttcaggaggatgagatccctggtggtgtcgttgggggcgatgtcagaaagatgcatattgagttcttccagctcttgcaggctgcggagcttcggagagcacaggtacaccatgcaccacatggactccatccagatcatctggccttgccatcatggagagaaatgcaacagtagagtatgtcaccagtagggactgagacgagctcgctggacaaccaatcatctcccacactgtgtgcttctagttactgcacagtcacgctctttctcttttacccaaggtctgtgagaccttacttatctcccctctgtccctagcagctgtgtccattgcctacattgaagtggctcccatctatcaatggcctccatgctaccgatgccaacacaagttccttggccttttctttactcagcctttctgctgtttgatgatgttaaccagacccttcttcccgaaatctcacttcctaggacttctctgacactgctttctctctgagatgtcccctaattctttgaatttttacttacattattttaatctcattccttaaatgttagtgttcctgagggttttgtcttggtattctcatttagcatcacacaactgcatcctacaccacgctgactgcatctgaatttccagagaaaccttgcttcctgaactcaatatgtgtatttctttaaaaatagatatgtttgttatgttattgtaaaagcagtacacattcattgcagaaaacaaaaaaagtgaaagaaaatagtaaaaatcacccataatcataccacatggataattactgttaatattttgtagtatatctttgttttacaaaaaaacagggattacatggcatcttcttttcataatctgaatttttcacttaaaatatataacatattctttcatagtattaaatatagatattcatcttaatttttgctggttaccttgctcatactgtcttttattaaataataagctagtattgattatattttatctagcttatcattgtataaacaacattgtgatgaataagcttgaggcagtctttgtgtataatcatggctagttagtttgttaaaaagatatattcttagacacgggttacttagacaaagaatatcctcatttttaaggcttttgatacgtattgccaaaatacactctaggatgattctgacaattaatacctccaggaacagtgtttttttttcttctgttctccctattaggtatctgttcatggatatctgcactgaactcaacttcgatcccctccacaaatcttctctttctattagttctttcattacatatgtagttagtccctgcgatgagctaggcacactgttttaagcattgaggatacagcagtgactcaaactggcaaaaatccctgcctcaaggacattacattatgtctttttttcagttaattgcaccttcatcacccagttacccaatcaaggaagctaataattatcctaacgattctcttccaccccccacatccagtcaccaagtcctgccttaattatcttgtgagtctatcctccaattgccactccagtgccactgccagagtttagcactttagagtttctttcctggactccagaagcagcctctgtctggcctcccaggatccattttctctacactgtgacccatccttcacacacctccagagtgatcattctaaacatcaaatctgatcatggcagacacttcagcatgtttccagctgcatgatagagttcaagtcctcatcttgccagcctcctctcccatcactccactctacacctcactcgggttcccagaacatgtcattctccccttggacatcccccgagttctgcctgtgcttatccctggaataactaaacatccctctaatagaaagatagctcagaatgtgtgccctttcaaggcatatgcaaaaatttgctcaaaaggaatcaaagacctaaatgtaagagctaaaacataaactcttaaaagaaaacatagaagaaaagtttcacaacatcagatttggcaacaatttcttggatatggcaccaaaatcactggcaacaaaaaagaaaatagataaattggatttcatcaaaattaaaatcttttgtgcatgaaaggacacaaccaacagtgaaaaggtaacatacagaatatatttgcagattatatatctgataagaggttaatattcagaatgtacaagaaattcctacaactcaactgcaaaagcaaacaactcaattaaaaatggacagaagacttgaatagacatttttctgaagaataagtagaaatggccattaaccacatgaaaagatgctcaatatcactaatcattagagaaatacaaatcaaaaccacaatgagataccacttcacacccattaagatggctactattttttaaaaagcagataataagtgttcatgaggatggtggagaaattggaacacttgtccattgatgtccatgatgggaatgtaacatagagcagccactatgaaaatcagtatggaagttcctaattttaataaattaaaaatagaattaccatataatccagcaatgccacttctggatatatattccaaataaatgatggcagggactcaaagagatttgtacacccacatttgtagcagtattattcacaatagcaaagtggtggaagaaatccaactgtccattgatgggtgaatggatacagaaaatgttgtatattcatacagtggaatattattcagccttaaaaaggcaggaaattctgacacatgctacaatatggatgaactttaaagacattatgctaatcgaaataggccagtcacaaaaggacaggtactgtattattccacttatatgaggtatctagacttgtcaaattcataggaacagaaggtagaatgctggttactggggaattgaggaaggacaaatgaattattgtttaataggcagagtttcagttttgcacaatataaaaaagttctggaaatggatggtagtgaaggtacaacatacaacgtgtgaatgtgcttaataccaatgaactgtacatttaaaaattattaaaatggtaaattttgttatgtaaattttactacaattaaaaacaaaatgtgggccctactaatagtgagttagatgatcatgttgctacataaaatacagacattaatttaataccaatagcacctcatgcattctgaaaattttggtaacatatcagaattttataattacataatgtatatacttgtataattatgtatgtaactatattacatacatagtttacgtctaagccagagatggttgaggaaataaaatatattctttacagatcaagtcaagtggaaacgtcagaaaaaagaaaacgtgttctcaacgtagcccctaccctactttttaggaaattggaaaactgcctcttccctttcggatcaatctctcaaacaggtggggagcaacaggaaaggagtgagtgattaccttgaagtttgagtgtagtccgactttgccatgctacaggcatcatttctcttcgtgtcttcaggacaaattgactgttgataaatctgcggatgctgaaaatgttgaaggtaacttgaggatgaatgatggagaaatactcatccagttgaatattctgggtttggagtcctggtacgtacttctgaatgttcactctggcttgcttcacctgtagctatccacagaggacagatataagctgaggaatagaaagcaacctcccttcccataaacttccccttggaaataacattctagccatgttctgtggctcactatcgggaaagggggtcagtaatggaatcaacatcatggaagtaataaatttttttgaaacaatcaaatctgtgctaatgtctgaaagagaaaagaataatacgagagtgctcagaggcttatttccgactaaagagaaatgaggttacagctctctgttgggctaatagttcctccttgctctctgagacaactctctctctcactctctctatcatttactaatgaagaaactagcaaattctatagcattggatctatcacccaggcctgggtgaagaaatccatcaagggggtgggggaatacctttcactgctatctccagtgaacacacagaaggaagaagtaaaataggtgtcctttaaatgagttcctaatcaattcagttgacatatattttatccatagaaatggattaacaatcaaacttaaatagttatgctcacaactcttacagagcagtggcttgagttggcatgaccccttccccatgttcaagaggcagaatgtgaagctgggtgggatggagacatacatggtggtcacaaggatgggaagagttcatgggtagaattccaccctattgttgctactgactgtgttctgctgtctctttatgtagtgaattttagtgtcacttccttttccccttttttctaatggtaaactttcccatgcattcactagttcaaacctccctttctaccctatcaagaagatcctgcataatggattctggaggataccacaatatgaaaagcaaatcaatggtcctgccaggataaagcctagtctcccaagccctgggaatttctcagggacttgaaaatctccactgttcatgaaggactgtaaatcatgctcacttccctggcttagccccaattctaagctacagagggaagagtctcttactgattcatcgaatacaatgtggaaaggaaaagcgttgcagaatgtcttctcttcaatccagagtctctcaggataaattggctcaaaggtgttcatgagatgccctggacatagaaaaaggaagtgctgatgagaagcagctcccgcctccacccttgcacagagcagagctcgggatagggatagtatcttaagtgtttcacaagcaaagtgcaatctcacttcttttgcatggactccctcagcatctccagatggccacagcaattcttcttccaaattaaaacaaacagaaaacttgctaccaggttgagaagccctcctgccccctgccaagtttctgcctgccgctgaagagtttctgggccaattgagtatgtctcgccatgaacacagagtcggcattgaaatggtgacagccagacaatgagctagcagagcagagcgtgtgctccgggcccagcatcagggacatttgccatggagctttttagactgacagttttgggtggcacgtgaaaatttaaccaacagtcctatttggcagggggtagagattcgaaatggagcctttttgatatgaaaatctcctagacaaaggatgtcaattgcgtgtttgactcacttgccatggcttgaaggacgcaaaatgcagccctttgagccctgcagaccttctcccagatgcgtgtcacctggcccattgagtcgtgacgcagagcaccctaactcccttctcccaatggatcagagcccttattcagactcaggcgttaggtgctaatcgttagacgggctcagtgcccacaggggtaccttagcaagcctaatgcctgcattttgcaaatgagaagatggagactcttgtccagggtcacacagctccttaggcacagagccagaaacttgctttcttggctcttgatctagtgtcctttgcttgggcgactagggttgttatccacagatctccagtccagaaatgtgtccaaatggagaaggcctgactgcagaagacgagctgtggaaaattcattgttcctgatggcacatcagtgctcatcttccttctctccacccatcacctgttgggagtgattccaattgtgtctccaaaaactttttcttaggacaggggagatgatgtctccatgtcacccggcacaaataatgagaggcaatggaaggacaattagagcctgacattttaaagttaaaaaccatggtcaccaaatccaagctttgcagaaactagtgccaacacaatcacagagggcttggccctgtcagtgtacactggccactactcctgagaatcaagcaatctttctgatctcagagctgagcttgggagaatcactcacttaccttttccaaacatgactatgcttctcacaacatcccagtgggattttttcacaggacaagcagagacattcaaatatttctccttcatcttgaggaaagctgcctggagggcctgcaggtggcagggagacaggtacctggtcacatgactggagaagcacaaaccccatttgctgtgatggggtccacctttaaataaggaactgtatccatggccagaggaacagcatgagggcttacaagatcacttctaccaagactttagcgttcccggtattttttaatcaaattagtcctcatgctgtttctctatcaaagaaagcaataactttttagaaaatctcaagagggaactaggatgatatctggcaagaaaatcatgcacgaacatttcttcctgtggttgaagattctgcagtgaacagactctgagatggactttgaaaatactctaaggaatcagagactaatcctaatctgggtattttcacaagctatgtgcatggagagctgttcagctaacatacatggtaacttaagcaggtaatgatcaccctatcagttgcaactggggtggccaagtacagagtcttgagttgactcaggacctatgactggttccagctgcagaagtgggcactgaagactggaaagatcaatttatttgaggaggattgaaaaaaaaaagccatcaaattcaaatttcaaatccttcatatggttattgttataggtgaaaaattgtccaggctcaggtgcatcccagaatgcttcccagtatatatccacttaaccttaacccagcaattctcaactgggaatgattttatccattacccccactacgcagacacttggcaatgccaggagacatttctttttctttcttttttgtttggccacaaatgaggggatgaggttctactagtaggaaaagaccagggctgctgctaagcacactatgacgtgaaagacaccccatcaacaccaaagaattatctggttcaaaatgtcagcagtgccaaaactgagaaactctgccttaattccactattagaaggtccagttggtctcccatccaagcactaaccaggaccaaccctgcttaacttccgagatcagtcacgttcagggtggtatagccgcagacactcgtaagtgggaggtgaacagtgagaacacatggacacagggagaggagaatcacacgccggggcctgtcagggggcagggggcaaggagagggagagcattaggacaaatacctaatgcatgtggggcttaaaacctagttgataggtacagcaaaccaccatgacacatgcatacctatgtaacacacctacacattcaaaacatgtaacccagaacttaaaggaaaacgtaaaaaacaaaaacaaaaacaaaaaggtccagttgattctgttgtttgcatagatttttccaagactcgtagctctacttaagtgcaactgttctttctaaaggcacagcaaacccagtacctcttggtctctctccatgccctgactgtcttgtaacctttttggctttgtctttctcatcttcctgtgagccttctgtacaatcagaaacacaacatgctccttcttccctgtcctctccacttcttcattcatgtcaagaatgtccatgattacatcaatatcaaagaagtctttggccacagcctcaatgatacctgcagcagaaggacacctattgtcgagggatggccgaaggcaactttatcagcaaaaatcataaaataatcaaatggcaaaacttctgatgaatattctgaagttcaccaagcccaggccctgcttcaaatcagacatcagtgacagccaattaaataaaaatatgcagagactgaagttatacatgtttggataccaaatatatccatgccactttaatttctagtttggcatctattcatttgtttgttatttcaggtaggcatttaactcattaaacaaacaaataaacctagagataatgtaagcaaaattcagttgtaaaagcattaaggatcaagttcaaaaaagtgttcccctgggaatctatcccagggttatatacaaaatatagggaaagagccaggcacggtggctcatgcctgtaatcccagcactttgggaggctgaggcaggcagatcacaaggtcaggagatcgagacgatcctggctaacacagtgaaaccctgtctctactaaaaatacaaaaaattagtaaggtgtggtggtgggcacctgtagtcccagctacttgggaggctgaggcaggagaatggcatgaacccgggaggcagagcttgcagtgagccaagatcgcgccactgtactgcagcctgggcaatagagcgagactccatctcaaaaaaaaaaaagaaaaaaatatataaatggaaagcatgtatgaagatgttcatgatagcactgtttacaaaagcaaacgattagtatcaatggaaaatttaataataggggattagttaagataattacaatatggaatatcattcggccacttaatatgtggttttaaagattatgtggaaacatgctttttctacaatgctaaatgcaaataaaaagctgatacaaaataatatacgcagaattatcacaactatgtaaaagcctgtatgatttaaaatgttgaaagaaaagtacaaattactcatttttgtggaattttggaaacttattttaaaagctcaaggacattgggagcagtggtcaagatgatatgaagtcacacattctaagagttttaacttcttacccgtagccagttattagccatcctggagaatctatggggaaaccttcctcacttcagaagccccatagctctgcggccagctaagccatttccatacctggtacaatgtggcacagaccacttctatccgagtagtaatggagaaacattttcccatctgctcctctctccacacgaaacgatggtgcattcatctcctaattaaaagacacacatttttcccagtggacacaaattgtgtaaattatgcttttgacgctttgtgaaacaatagtatttacccattacatcatacagagctatatgccaaccctctctccaatcacatagaaactcccactgtttctgctcctgtatgtcaggaattttatactatacctactgtactttaaacaactctatatggcaagtactagttccatttgaagaggaagaaactgaggctcagggaaggcaaacctaggttaatggtagaacaacatttgattcccaaatgagcctttgcaccgtgccatgctgtttctacccatattccaaaagcagctgtctgctggtaacaggaagccttagtgagtttccgccgcgcttggcctgtgaccaagtgaccatgggcatcttcactttccaacacatcagggaatcagagaatttgcaagtagaattaatcaatgtcttgttctgaaaggataatgtcttctgtgatatcaatttgaacatttagaaagtagaaccttccaccgggcgtggtggctcgtgcctgtaatcccagcactctgggaggcgaggcgggcggatcacgaggtcagaagatagagaccatcctggctaacacggtgaaaccccgtctctactaaaaatacgaaaaaattagccgggcatagtggcacatgcctgtagtcccagctacttgggaggctgaggcaggagaatcgcttgaacccaggaggccgatgttgccataagccgagatggcgccactgcactccagactgggcgacagagcgatctcaaaaaaaaaaaaaaaagtagaaccttcaaggatacatcagaagagatcctcccctttctccagaaatgttgacattcaagtacctatcatttcacagtaaatgagatgtatactaggaaagaaggatagagattttgcctaggggagtctctagctagttagagggcaactcagcaccctggacacacagcttttggtccaagtgagggaataggtaaaggagatgggttccttccaagatctttgtcgtcttccatggtgaaatgttgttagttaaaatgggtttcttttttttccccaaatacttttttatttttattttttttaattttttatttatttttatttttttgagatagagtcatgctctgttgcccaggctggaatgcagtggcacggtaacggctcactgcagcctctgcctcctaggctcaaatgatcttcccacctcaggcttctgagtagctgggattacagtcacgccacctccatgcccagctacttttttttttttgtattgtttgtggaaatgtggctttgctgtgttgcccaggctggtctcaaactcccgggcataaatgatcttgtccacctcggcttccaaaagtgctaagattacaggcatgagccaccacgcccagccctcaaatactatttttttctaattccaaaagtatgtacctagagaaagtacatatatttatctgtatgtatgtgtgtttacatcttgacaaaatgtaaagagtagttgaggcagcacatataaaaagcataaataaaataggaaattaacagttaatttaaaaattatatccaaatcctacatagtgaaaataaagtaacagaatacagaggcctgaaagaaagtccacgtgatcctgcttcatgcccctcactccttaccccctgcccagagacacttccaaaagttcatgcttttagttcttctggtcaatgtcactaagtctctaaataatataattacacttttatttcttgcttcaaatagggctttttaaaagtggagaattagggcaaagaataacagaataaaaaaaatgcttttgcctaaagagacaatctataatactttgcccagaataaagcactatatagctgttaggtatcattacagaacagaatagaaagcccagaaataaggctgtacacctaaagccacgtgatctttgacaaagttcttattattccaaagaataatgagaacagcacagggcaggatctttggagacaggtgtgggtttgggtccagctcagccaccatgcctgggtgatttggggacagttacttgaactttctggacctcagttttctcatccgtataacaggaaaaataagactgcctactcttatggcatcaagaaggtaagtcaatgttgacacattacttagcccaacacctgcctcataattagcactcaatgaagtttggccaaagcataacaagattaaaggctcagttataaccagaaatgtataccttaaaggcactgccaaattactagatagacacaaaaaaagtgaacattatcttactttgttatttttgcctaaagagacaatctataatactttgcccagaataaagcactatatagctgttaggtatcattgcatgtattttcttccaacttgtatattataatatttaaatattttatttacctcattatgtgcaaaatgtcctcaaataccaccagataagttctattctattgcttctctagcatcacttataagtgagagctaaatattgaatacacatagacataaagatggcaacaacagacaccgggaactactagaggagggaggaagggatagggtcgagggttgaaaaactattgggtactatgctcactacctgggtgttagcgtcaatcataccccaaacctcagcatcatgcaatagacccatgtaaaaaacctgcatatgtaccctctgaatcttttttaaaaaattgaaattataaaaaagcaaaggaaaaagatcataggataaaaaatatatgtgttataaaaaaatattaaaagggcctaactctatttctttatatcctaattgttgtgctttagctaagaaattgaaaggaagttgtcatgcaaattatcgttaattcttaaactggccatattgaacagagagaaaagaaaggggaaggaatagagttattatttatttatggaaagctgatttttctgggctgattgcaatgctagacttttccatcttatctcttgtaatccacatattgctatgaggtaagttatcttttccctatttattcctttttgtctctgtttgtgtccaataccttaaaaagtacttgatacatagtatcactcaataaatattagttacccaataaatattattaaataaaataaattgagattcagagacggcaactaacttgtccaggatcgcacagctgttaagtggtagagccagtgggacagtctcatgggcccatctgaccccataagcagggctgtttccactccctctacccttgagtagttcacatgataacaataggacaggcccagctattcatgcccaactattcatgattcataattgaagtcagttaaggcttccaagcctctgattccttatatgaaaaatggagaaaataatacttttcccatttatcgtctatgggggggtgtaagggttgctgaggctttttaacatccacaatcccattttgtccccatgacaaccctgaaagggtggatatgaacaccaatatagaaatggtgaaggaagatctcggtgaaatatataaggccttaaaattaaactatgttctctaaagcaataaactattattatgatatgtataaatgctctttcaccttttcttgtctaaaaaataaaagagaatctaggcatttgaatttccagtgatctctacaaacaagaaacccaaggaaagaactccagaaggatatatcccagtagggaaattagtttcctaacacctcagtcagtcacccatgggttaatcagagttggatggtttccgattctggctcttagccctgtcaagtcttcccttctgatacatgaataacatgaatctggctgcatatgcaatttatcagctccatcctggccaggaaaccttaggagagcttttgcaaatgcactgaaacctgactgttttccagcctttgttccaattgtaatgagtctccaggatttaattccaaatcaacaccacaccctatctgaaaaggccatcccttcggtttttgtgagccagtttataaaagtggccagcaggtgtttctttttcattctcttccaaaaagaactcctgagcccaccaacaccaggtaccaaggattctgcagatgggagggttctcctgcaaccgtgcctctgttgggggaggcggggagctggcccaggactgccacagcatttgcttcctcttgggcagccaagaccagactcaagtggccttacctgataagagagtgccaggtaactgtggagggcatccaggttttcaataaactccatgagatttcctcccagtgtccgtagcatcctgtcatagccagacatcttcagaattgaaagtattctccaaagagtttcaggatggcttccatggagacacctgtagaaaccaaagcataccccctaaataaaatctcctggaggtgtgtgttgtcctttgtgtggtcttcatttatttccaaagggttcacatcctggctgtgtgacactatcgagctactctctaagccgtcacttgcctcctcggtaaaatgccaataaccacattgatgtcatgggcccttgggaggagccccgtgcagcctggcactgagtaggtgcttgtgaaacataagtctccttgacaaatacttcctcaaagtcgagaaggggatgcagagatgctgtacccgcttagctgctgaagccagtgcccagaacaagcttcactctgggtggggagggcgcgaccctccacgaacactgccaacacctcccacatctttaaatgtaacagtcagtctctaacaagaatacaaggatgcctctgagaaataactaatacacaatgaaaaaactatgccttcaaggctacaggatcctgatttaccaaaaagatgataccaaatacttgcagtgtctttccctttctctcctgacctccctgtgaggcccagtgttcctgttccattctccataaagatttctctgaattctctcttcctaagtgttgcatttttttttcttcctaattcatggtaattctggagagaagcaacccgatcctacacgttttctgtgctaaacacagcataggtgcctgatgaacacctggaggtagatttgcggcattagttggagctgctgcccacctccccgctccccagtctacactgttggaatagacagtaagcaagtgtccactttatgggaaagacagcaaacattttaaaagaatgttttatagttctgacaacacacattaattactgttctgttactcaatgtttgcccagctcttataaggtagctaaccttattatcatgtcctttttacagctgagcctgttggggctgagtcatctttgtgaattgactgcagtcacatagagttgcagaggccagatttgttgaagaggctccaactctaagtttagcactttttataccacatcccccagcctctgaagcagcaatgagagaagcaaggagtctccccaagggaagcgctgcttatgcgttggcatcattgacacaggagacagggcatccatccatgctgctggtctggagatcctgtgagaaacaccctcttatttacaatggggctgtgacacatgtaagtcctgggggctggggcaaatgtctgtaatgcccaggtttatggaaggcctgaagagctcaccatcaccagtatctgtggttgcatccttgaaaaactctgtgatgctctggctggatttggaattcacagcaagggacattccaggtctcatgagctatccagggctaaatcctacagaggacagacgaaggaggtctgggcactctccagcccctgcttgcttcctaggatggtctgaagagcagtttccctacagctcatagtccacagccagaccatggggcagataattgttctgtaatctgagcaggatagagtccccactgaattggtctagttttgtcagagatgagttgtacatattttccaagatgagttatacatattttccaaaaattgattagtcggatctcaatctagacgaagcttgggatggtagagaagccagtggtaatggcctgtgttaattgcctccgttggcttctttgcttgtgggtgcatcctggccggcctcaggcaggcttgtctatacactggtataaattcaaggaccacctgctaacccctaggggatctgagacaaattctaccaagttcctttccagtgcttgagtctctgggagggggactgctaaaaggtaaacagacagatgggaaattgtccttctgctctcctgcttccatccctctgttacctctgatctagcttattcagactaagaaaaaacagctgtgctgtgcatcctggaggctggagctctgagcaggtgcatcctgttacctgccaggaaaagcaggggtcccagcggccccccttctcccaagaacctctgccaggaggactgggctgcgtgtaagccaagcaaagttatattcaagtaagagtggcagctttgggtaaaagactgcctgtttgactttcaaatctttaaacttaaaaaatccatgaagctgtttgttccaggctctggttattttgtttgtggatgcccagctctgttaaaaggaaaggacatctggctgagagatgaactgtttcccaaacaaggatcttgggtttgagtgtggtgttttccacctgtaatgggtttggagcttcttctagaattcttagttgagaatgcttgtccagcagggaataaaggccgcttttttaaaaaaatcagcacctgttttagtcttttatacagtttcacatcagtgtatttaagattccaagaacccgctaagtcataggggatccaagatatacaggaaatggttagaaactgcaagaaagaactaaactaacttaggtgccttaaaatgtttttctgatagtgcaggggagactttatactatgcttagtattctttaatgtaagaaagaagggaaaacaaggaaataatcatctatctgcctacttgtgcaaaattaaacaccagaaggataaacctggatctattgagattggttacctacaggacattggtagggaatggggtggaaagattagaaaaattgtggagttggggaaaatgacatttttctgagcataactttttgaacagttctggtttggggagtcatgttaatgtttcatatgcttaaaataaataaaatataagatcaacaaggatagagaaaacccctaagatggagtacaaacagaaacaaattcacagaacagcatttcaacagaacagttttgaataacataatcacccaggaaaaaaattaacccagtaatatttgaacatagtatttacactactgtgtcttcaggccaaaaacaaaaagaactttaaacaaatattttactgtagttagtaggcttccttttcacagcagtgtgggttagcaattctgaaactatgttctgaacaagtaaatatattgtggatagtgggagccaggtttttccctatctgagaatgaagttacaattatggaaaggggaggaatagaatgaaccctgtgcctctggattagaaaatctaacataataagacaatgaaatctatcatggttttagatatatctatattttatatatctatatctatatctatattttatatatctatatctatatctatattttatatatctatatctatattttatatatctatatctatatatagatagatatatagatagatatagattatatctatatatattatattatatctatatattatatatagatatatattatatatatagatatatatatagagagagaaagatggatgtatgtgtgtgtatgtgtgtgtgtgtgtgtgtgtgtgtgtgtgtgtatatgacatgtattttccagcactgtccactaagagggcctaaaagcagtgatatcccagtagcagtggggttgcctaatgtctagatcttagtttttaaatgctcttctcctgtaaaaggaatcagggccttggagaaatggcagattccagggctggggcagggaaaggatgagatcagcctataacatcttgttatgcaagaaggtaaagaagtgatcaaagaatgatggggacatgtcaaaaggacacaggggccagtttagggtggctctcactggctaactcttgcacaatttgagcatcaaaataaataataaaaggaaaggattacagcctgtttttaaaaaataagaatcacaaatctacattgatataagtaaataaatacatgggggagagggggaaattcttccttacagaaactcaatgaataaatacaaaaggaataatattcttagaaaatcaccatttgacttccatcataagtatcaattcagacaagaatcacaaataaatactaaaactatgaaagagggagtttgagaaatgacaagatatttgcataatctgaaagtatctcctcacaaggtactaattacaaagggaaaatgtaactttacagtggagaaagctggcaaattctacgtaaatcaagtgatcaaagttagcctcactaataataggacagatcaatgaatggaatatgcctcctgatatgataaactgggaaggaaaaagatcacgtctgtgatcttcctgccaggaaagcataacctgaattatatcatgaggaatatcagataatcctcaattgagggacattttgcaaaatgtctgaccagaactttccaaaaataccaattttataaaacataaagagactcagaaactgttccaagccaaagaatactgaagagacacgataagtgacatgattcaggattttcttttgttctaaaggacatcactgggtcaactggaaaactctcaataaggtctatagattagataatagcactatatctatgttcatttcctgagtttgattgttgtactgtagttatttaagagaatttttaaggacaagaaggcatcacatttgcaatatactaacaatttcaagaaaaaaagtataaatctagatataaagagaaggatagacactatatggtaaaatgtcaacatttggggaatatggataaatactacatgggaattctttgtactattcttgtaagccttttgcaagtttgaaattatgtcaaagtaaaaaagattctgttgattgctctgaaaagaccatagggaatcttacataataagaccgtaaagaccatgtttatccatggccagctgaaatacagctgcagcccaggcctctgtaatgttatgaattttgttagttataatcagggcattatcagtacatttttaatgtctttatcttgttagagactaatactgaaatatttatggatgaaattgtgagaaacctggtaattgctttaaaacactccagaaaaaataaaactagaaaaagagtggaggaatcagatagatgaaataagactggcaaaatattgttaattagtgaagctgggtggagggtatgtgggcttctgtacacaattctctctacttttgcgtatgtattaaaacattttttttaaataaataaaggagttgagttttttttggttggttgtttttttttttgtttggttgggtttttttcgtttgtttttttgtttgtttgttcggttttttgagacagggtctcactctgttgcccaggctggagtgcagtggtgctatcacggctcacgcagcttcaacctccccaggctcaggtgatcctcctgcctcagcctcctaagtagctgggactacaggtgtgtgccatcacgcctggttaatttttgtattttttgtagagatgggggttttgccatgttgtccaggctggtcttaaactcctgggctcaagtgatccacccaccttgacctcccaaagtgctgggattacaacacccacccaagactttttttccaggaggaaaatgatggtcacaaagcttctatgcttgattccccaggtgtggagacctctaacaagcttttacattggagtgttgcatgaactcaaactttctgacttaacaagcatgggtcttctttgtcactgggaaacatttgcttcttgctgggtttcagctcaaggtactggaaagagtagagttgggctgtccagggctgggggacagagagcgcctgttgaagccccagtgaggctggcagggacaccatagccaccaaagcagagcctcctggacaaacagcccactcagggccagacttgcaagacccctgcccacctcccgtcacccaagtcacaggcaacaagagctattcctcatggcactcttcctgagtcacccagcaaaacatgtgctcttcaacaggaaagagaagtacatgctctacatttgacaaagttttccgttgaaaatgggtaatttttcccccaaagcgttggtatccaaaggattactcttcagatacctgaaaagagccagaatctcacatactctttttctccaatgatatcactaatgtcaggcatgagttagtttatggggaaatattttggagtaggagaaagagtagtctaagaaaaggaaagaaacatctgcccatgtccatgctgtagtttgcaaggaggaagaagactctaaattaggagggttgggtttcagaagtagtcgtaagtttatacaggcacagagaaaaaataaactggaagtcgattaaggcagctcaggaaggtggtgctctgcagggatgaagcaattccgctgaagcctggtagagaagaagcctcctggttcccgtcaaaccttggaacagagtagtcagccctaccagggccacagcagggggccaggggtctatctggtggcaagcaggggtgagggacagggcgaggtaccttgttgtgtacccactcggtgtcaggcattttgctcaccttatttgatttcttctgtaggacagatgaaaccccctgggttgttgtcctacagaagaaatcaaataaggtgagcaaaacgtcacaggtatcattgctgcattaccaggggaacatttaccccaggttacattatcaggagccggtgtagccagggggctcacccaggtccgtctgattccaaagcccttgctctagacattgtcgacttcccctccagtctgtgggattaagcatcagccttggaatcagcagacctgaattcaagtctccattcgtggctggttgcacagcctgggttacttgtcccatcctcagaggagaatagtgaagagcaaacgttataatgcctgatttcaagacgttgtcaattttgtgttgttcttatttttaaagatgtgagtgcagagaggcttgctggcatttgctgatagctaactgttgaaacacattttactgtgggtgtcttcgcaagcaaagtctagacggacacagctgtgccaaatggctgttgtgtgttgttttgaattttgtcgcttcagatcactaataacccacttacacactaagtaggcacttattcatatacagaacaattccttatgcaatgctcaacctgccatctggtcccctcctgaattatgctaattggaaagcacagagctatgcagtggcagagcggtctggaaaagtcccagcaattgcttcaaggtagggaaattgcattctgaagcccacatggaaagcaaagccctcactagtggtgactaagcacactttttcccttgtcaaagggaggattttcaactgaccagtatattttgttagacagtaaaatgtccttcctgtagcctttcctttggatgggtcttgctctctcagactcatgggagttggagacatacagaatcacgacgggcttcctggggctgtcctgattccacatctcatacatgtgttcactcgattttgcatcccaacttcttgtttgaaaaatgcattcaccatactcatttactctttcagatagatataggccaatagatgttatggaaataaactacaagaagaaaagattcctgacattcaaagctaggcagagagaaaccacagtgatgtacgttggctttcggtggaaaggtgatgtgggccagcccacacattggtctgtagactggctgctgcctctacacatgttggttgggttgggaatgtgacggcagtggggcaggtatgtgatggcatctcactgctggaggtactgccacaccgtttgatgtacatgagcacagacagccacaaaaatggactggggtgatatgatatatacagagtatttctttctggagatatacaagctgattcaagttcttatattagtccactagggccaccacgacaaaatgccatagatggggtggcttaaacaacagatatttattttctcagagttctggaggtcggaagtctgagatcaaggtgataacatgattacttgacttatagagggtcaccctctcaccatgttcccatgtgacagggagtgagagagccagtgctctggtatctctcctataagagctccaatcctatcaagagggccccaccctcatgagttcatctcaacctaattatttcccaaaggccccatttccaaatatgaatttggggcatgggggcacaattcagtccagagcagttcttaggttaaaagatatttttagaatcttgaaaaagatctgcatccacccttgagagcatgaaatgaccaacttttcctgtgaagggcagatagtaaataataaatgttttcggctttgtaggtcatatggtctctgcgcagctactcagccctgccactgtaacacaaaagcagccatggacgatgtataaacaaaggggcacggctgtgttccaataaaacgtgacttacacaaacaggcaagggcccagatctggcccataagctgtatgtagtttgctgaccactaatcagagagctcagaacataatttttttttttttgagacagagccttgctctgttgcccaggctggagtgcagtggcacgatcttggctcactgcagcctccgcctcccaggttcaagtgattctcctgcctaagcctcctaaatagctgggattacaggggcaggccaccacgcctggctaatttttttttttttttttttttttttttttttgcatttttagtagagatggggttttaccatgttgcccaggctggttttgaactcctgacctcaagtgatccacccacctcagtctcccaaagtgctgggattacaggcgtgagccaccgcacctggcccataatttattttattttattttattatttttaagttccaaggtacatgtgcaggatgtgcaggtttgttacatacataaatgtgtgtcatggtgctttgctgcacagatcaacccatcacctaggtattaagcccagcacgcgtgagctaattttcctaatgctctccttccccccgacccccacaacaggccccagtgtgtgttgttcccctccctgtgtacatgtggaacataattttttaccacagccatttgaagtgaacagcaaagcctgtcttcttataagggacagtatctagaggtacaaaacatagaaatacccccatccttccttcagattcaacatttggctgacatttaccaaacacccagtatgtgccatgcatgttgctaagtgccttacatttgttatttgatttaattcattccttcccacaaccctgtaaggtattattccttttgcaggagatcaactctcagtgaaattctagcccaaggtcacacagctggtgtgacggaaaagaatccaccctccattctcattctggaataacaacgagatgttctttcgcagagggctcagaccaaatcaagactacacgatacagccactacgtccttctgctgctgggatcccttggaataaaatcaagaaaagactaaaggtgggcttaatttcactacccattgtaagcttttttgccgttttatttcctaagctctgtcaaaactccagattttcagctcaaaagtagtcatctctcattacagaatttccacctaatgatttgtattcttcctgtggaaggaaggttactagatgctcctcttacttagctagaagaaaggaggtaattgcaaaccactggacttgctcgtggacctcctgccctcactaggatcacagatgtgcagaattgtcagccacaagggcagcacctaggctttgcctatgtggggtggacatattaggatcaagaggggatctgtctgtctggtttgcaaaagcatatttaacatcgtaatcgcatacttttaaaaaaaattaaagtgatgcttaagaaaacaaaacaggtaatctctttggcaggtgtgtcaagcataaaggctgacaggtgaccctctggggtggctgtgctgctgccacctgttgaacaaaaaggccatagctggggagcagagctgagtcgagaacccaggtctccaggcctgcagcccctgggagcagcacagtgctgtaaagaggacacatcccgctctcagactcgagcgcagaaagctcgatgctgtgtgctttttgataacccagccccacagaaacctcccctggtgttagctgctggagagacaaaagggcctgggagtccccccaagacaggctggacaggataggggtgaggtttgcaggtatcactgacacttcccagttcctgggccagctttggcctagaatctctctctgtaagcttctttggagagcggagctggttggtggattcggggagaggcccagccgtgattcttgggaagccacgtgagccctgtctgccagctgcctgtgtcctccctctaagtgctgccgtggtggcaggctgggaactggctttaggaagcatccgggaggtgttgctgctcttggcgcctgagttccaggagctgaaggagcaaatgactgtttcactccttgtgccttatttccagcctcagacacaaccttggttctatcaaaagatgcaggtgggaagtgaccaggggctaacatacatctggttggaagttgttttaacaaccagttgggacaccagattcctcctagctatgatcaccatcacctgccaggcctcgttggcaactctggcccctgcttgtctctgtggctccaagagagcaacatgatgagatgagacagcaggtggcccagagtggacaggggaagcaggtggcccagagtgggcaggggaagcaggtgaccacctgttaccagagaggactctgagcaccacacacatccagcttcctcagcctcaatgacttccccctcccagcttggcagagactttgggcctctcctggatatggatccctggaaggtcttctgcatccaggagatgaccaggaacatgagaagagatgtagatatcagtcacagcgccatgtgaaagccatgggaaaagccctctcatctgtcagatccagttgcctgcaagtaaagctggcactatctttttaatcatcagataatttttctgaaatccaaagggaagggaaataagctcaatacctcacacgacacgggcactttacacatcactgctgcgctctggagaagctgcctgtccctgcgggcttagcattagctagctgccctggtgtgttctcaggcacgcctgctgggctgatgactgtgatacctgctactggcttaaacctatatcatttcacaaattgttcctgagaatggcaagccaatttgctaggccctcagaggcaccatgaaaccaactcaaaaccatggcccctgctgccagaccctctgcaggctgcataagagccagcttgcacactcccagggactgggcctagcctgacacttccaacagggctatacccggtgccaggtgacaagcatgaggcctgatgcagcgtctgagtgagatcatccttaaatgccatctcacactctcacagtgacccaaggcagcaccgcctatgaggaatgggtgaaggaagttcaacgggaagggaaagaggaacctcatcaaagatcctgggtacagaggggggcttcggcttcctgcatagatccctggagcctgggacggtggaggctgcctgcccctccctcccctcaggcctgccctggctcattgtgtactcagtgctggtgagaaggaaggataaagaaagcgagggtgtattgggttgaatagtgtgcccccaaattcatgtccacccagaacctcagactgtgaccttatttgaaaagagagcagatgtagctagttaaaataaggtgaggacataagggattagggtgggccctaaatccaaaggctgctgtcaatatgagaaggccacgtgaacacacagggaagaaggcctgtggagatggggacagagattggggagatgtgtctacaggctaagcggtgccagcaactgccagaagttgggagagaagcaagagacaagttatccctagagcttccaggggaatgaacccagccaacaccttggctttagacttctggcctccagaactgggagagaattgatgtttgttgtttgaagccacctggttgttggtactttgttacagcagcccaggaaacacaaaggggagggaaggaagaaagaagaaaggaagggaaggagggagggagggagtgagggaaaggagggaatgagggaagaagggagggagggaatgttttttgaaagcctattatatgccagataccacatatgatattttcacatatattttctcatttaatcctccaaataactctgaagattagatcttgttcaaccaatgagaaaactgtgactatttaggtcatttgtcctcggtcattaaactagaaagaggcagagctaatttcttttttttttttcttgtttttttttttttttttttgtcctgtaccttgtcccctctgggcctggggagtgagcagattaacaagataaaaaaaatccagtgctaatacatccacaggaaaaaccatcctgggaggacacgtacattgtcagtgggaccatccacacatggtccccctcctatgaccctgtcaatggcattttcatgtccaggcagatgggaaaatatgcgatggagagcagatcggggaagggccctcagcacactgcagagcaccccacgtccatttccaggtaagcacgagtgtaggtggcataggcggattctcaatgttgttcctcctgacacccagagataatcatagcagaccattctaaaggtattgcaacacctgtaaagccaacatcgaagccaaacatgatggcagtggtgcagacggtgctgctcatcatttttgtctgtaagaagcctaaggccactcaaatggaaagggtcatacctgagccctgtactgggttagagtgccccttaaaattcatgtctaccaggaacttgtgaatgtgacattgtttggaaattgggtaatcaagttaaaatgatgtcatttaggatggaccctaaatccaatatgcttgatgtcctaatgagaagatggaaatttagacacagagacacaaatacagggagaagacagccacgtgaagacagaagcagaggctggagttatgccgccactagccaaggaaagcctggggccacccgaagttggaagagggaaagaatttttcctgagagccttcagagagagcacggccctgccagcaacctgattttggacttctggtcccctgaaccacagagaacgaatttctgtagttttaagccacccaggttgtgatacagtcggtcctcattatttgaggatttcatattcacaaatttggctacttatttatctgtaggcccgaaatcaatactcacagagctatcaaggtcattcacagacacagaatttccaccggccaacatgaatgcttctagccaaggtagaacaaggctgtgctctatgttcttattttagtttgaactataaccaagtgtccttcttgcagtctatttagtgtcatctttttcacatttttctgcttttctgttggtgattttgctgtttagaatgacccccaaatgtaggctgaagtgccatctagtgtccctaagcacaagaagactgtcacatccttccagagaacaggcagtgttagattagcctccttcaggcatgagttacagtacagttggccagcagttcaatgtgaatgaatcaactatgtatattaaatacgtatttttttcacagaagcacacatgaaacaaagttatgcattgattggttggcaaaaatcttgtgaccagagactttcaggaaactaaccctgtatttcccctaggaacaatggtgcagtattcactaattcaggattgcagcagctttatagactataaccaatgcaaataatgagaatcaactgggttttgttacagcagctctaagaaagcaaaacaagttctttcatacttacccagaatgttgcaggcctcttggatgagcttaatggtgatgacgtcatcatacattgtgtaggtcatgaaggcatcttgtacttctgcagaagttctggaggataaatcgaggtgcagtgaatgctcatcagctggagctttgccccaggaatatatccactgacccagcaagatataatgtaacaataatcttcttgatcataaggaatgtgagacactggagtgtttgggtgtcaactcctccaagaagccttccctggacctcagtttgagcccggagaccccttctcaagtacccaggataggctatgcatttcctcaacttatataaagattgttggtcttacccactagctggtctccttgaggatgagcattgtgacctgtttttatctttgaacccccagcaagtggcactgtactgagcacatgttcagaacttaatatatggtagtaaactggaactcaatggtcatagagtcttgttctctgaatggtagagcagctgcttgagtttctcactgttttgcagtgtagttggctatgttgcaggagttatggatggactttagtcttcaacagatagccaagcctgctgaaaagaggcttagcctgggagtctgagacttgcacccttggcttggcccttatgtgagtcatcaaactgtagttggcaactgagttaacaaatgggggaaggaggttggtcagggaatgcttctctaagaaagggagattttgctgagactgaaggatggaaaggcaaagaagagccttctggacagagagaacaggcttctaggcagcagagaacatgtttgaagaacagagaggggtcagagcattcaagcttatccagagcacaccatagaatcttgacactgcgagaagtatggaattttctacatatccaattttctaaatgtccaatttcttactgcacgctatttctgactgctggttttccagtttcttcttgaatgcttccagtgacaacaagctcattcctttgcaaggcagcacattccacttaccaactgctctctttgatggaaacgtctttcttatgttcaaatgaaacccccttctgggccctcataatacctcctatttattaagcatgtgcttttggcccaagagatgaccaatttattacttatcattcctcgtactgttgagaaggctgatgctcagagggattaaatgtcttgctatggtcaccggttgacaagagaaggatctgggctctgaacttcaaagcccacaccactcctgtactgtgctgctgggaatttactcactggccttagttctaccctttaggaaaatgcagactgggctggtccctcctctggatacctaaccttctaatgtttgaggatccttattcatcactaaatttaactatctctttatcatctttctggacttcatcttcctctctgtaaaatgtggcaattattattacctgcccttcctatctgccaggagtgttggtaaggataaaacaggataacaaatctgaaagagcttggggaaaatgagaaccaccatgcagatcctaggagagctgtgatgacaatgagaacaaaggggctgcgtagtgagtaggaggtgaccagggctggggtttaggagactttggttccaagcttataccttacacaaataagctctgagggaaaaccactttccccctctgggccttgatttctttatccgtaaaatagaggaggtactgggcaagatttgtgtttctccatcttttttaacctctctgctacacacacatccactggggattctcagacagccccagaaacgcttgtgcacgcagttgaggatctaggactctagcttctaggactagaagctgcttgaattctccttcacctgtaagagttcctgttttggcccatgcctatacagtgctttctaagcatcttcggaggcagctgttcagagaaaccggctgtaggcctgctcgggcgaggagtgctgtacaccaccactgctgcctaagtggggcactctccaccatgttggagttgcctcttactcgcccccaggggcccacaagtctctgtgaaaacatgtgccctccttctgcacctataagcaaaacagaaacacgtggacgtgaccccagtttaaacttgacacattgtcataatgtgttctgaagaccttagaaagggttaagtgacctccaggaccgtcagaaatgtaacaaactctgtggcgctccctggccctctgatgggaccacccattcaccaatctctggatctggcagcctgttctttcctgtaggctgaactgatcatattttagtgtcaaatatttatttgggtttgtatatatgttgcacgttgctgggatgccagacgtgcccagactgttatgattatacagggattttcagccttgtttattgatctccacgatcctgcatataacatttcccacagagccagtgcacacttgcatatgtagtcattcaagctgctttagtaaaacagtatgttcaccaagaattttttttaaataaataaaccaattgatatcttccaatgagatgacagagcctctcatatgcagaggagaaagagagaaaaatgactattggaaagcattttgaagagatcgagttggagatgcaagaaatgtgggaaatgaagtaagagttagatgtttccagctcacacaaagaggagtacctgtcatggaacatgaaaagtgtcagccacataggtgcttgtatgcatccatgtgcaggagactgaggaatcagtgtttaattggcaccagcaggcattcaatatatgttcctctttagttagttccaactagcgatacccaaaatatctgagcagaaaatcagggccaggctgcctatagcagagcaactcacagggcaaaataaatacacagattcctgagccccaggaggtagtgtctgaaaatccatatatttttaaccactcgcctcagacgactgtccaggtttgaaaaccactgcacagaaacactttttaggattcagtctggcaaggcaacaggttacaaatgatacattttacgtggttcaaccttactaaactgatgtaatggttattcagagtccagggtgagccataaagcccataggaaaaatgaacagcactttgtagcaagattcaggccaagagaatgggatcaatttaagccataggaactcattttttcaacagctctcttaatggtaggtggggaattcatataacaaacttgcctgtcactgtgtgactcaaggtgtacttggggaaagagaggcccagagaggcaaaagatttgtcctggtgtcacaaccatctggaatttagaaaaagcaccagactgtctttctagcctgtcctccagctagcctgtctggctccccacagctttcctaataaaatctagacttcttaggtggacatacccagcctccacgacccagcctctgcacccactcctcacctccagccatttatcccatacatccattcctccagctactcaaactcctctcttccctgccttcccacaggctctgctccactagaaaagctctcactttccctgatctggctaacttgattcttccttcccaactcagtgtcagaatcccgattctggacattctcagccacttgcagatccgggcgtccctgctctgagccccccgtgctctctgtatcacctgtcttcgtgctaactgcgagtggaattgatttgcccatctgcatgcttcctagactaccaagttgaaggatcatgacaatgtcatttgatttaatatcttcaatacctagccctgtacctggcacacaacaagtactcaataaataattgtaagataatttcggtgagagacctaacttgacagaggctcacagactctgtgtgtcaggaggagacctaggagttaaccctggctctaccaccatctagctggatgacttggagcaaatctcactgtgcctccatttcttcatttttacaaagatagtattcaactaggtcattgtcatgaagactgtcatgtctggtcctccccttctctccctcagccaccaatgatgtctccttccttgacctctgattcacttagaaggatgcttaaggcatttaagccagcagttctcaaagtatgacccatggaacccctgcgaatacctaaggtgtttttaggaatccatgaggccaaactattttcaaaaccaaattaagacattatttgccttttgtactgattcatatttgcactaatggcacataagcattggtgagtaaaatttggtgccttatagcatgaatcaagacagtggcacaaaactattatattctttttttaaatcttcagtatattatttatagtcatcatatccctcattgtcacatatgtgcagtaaaaaaaaatgccagttttactttaggttgttcattttgaggtagtaaaaattactaatgttatgaaatcttgaccctgagtatacatcttttgaatattttgtgtaacagaatgggaagtacgcactcaaataaagtacttctcctatatgcaggagtgtgaatggtcacttccaggaaaagtacttacacgattgagttatgagatgaattagccactttttttaatggaacatcatttccacttaaaaaaccactgacagacgaactatggttactcagacttggatatttggcacacattctcttaagaaaataacaaagttagcctgtcacttcaaggaaaataactggcagaatgtgttgccaatgacaaaactcaagtttggggaaaaaagttgcatcttatactgtaagcttattagcatcccaatccttagaggctaaggtgatgatgatattgacaaatgcaattttgatattgtatagtgaaacatgtcaacatttgtaagattagcacaagtcagtgagctaatagtttccaaataactcatgcaagctagtacaaaatgatgcgaaaaaatttctatccaagtgtaacacagatcaagagattttaatataacagagtacgaagaaggtcatcagtacagttacagattcaacattataactgacctttgagaaaatacgatttgtcaagcttttgtgaggtttaaaagaatagccacaattatctgagaagagtattaaattcttcttccttccatattttcttcacaagtttcaaccaaaatcatatcacagaatacatacattgcggaagatggaatcccacttccattacttccattaagtcagatattaaaagagatttccagaactgtaaagtaatgccatcttgtcattaatttatttgaataatatagttatcataaaaatgttacactaacatgtactattatgtattacagcataattatataacatataattattttagataaatttaaaaatgtttttttaatttgttttaatttctaataccataaatacccatagattaaacaaaagctctgtggggtcttcaataatttatgagagtataaaggcttctgaataccaaagtgtttaagaacttctgatttaaatcaagagtgcttcaggtttgctttggaagctaatgaagctgaggtttccaggacagggaggaagcagcctcacctggccccctctagcttgaagccatccccagcctgaggggtcaccttatatgccctggtagtggtcctggatgcctgtgggtggggctgcagaccacccagtcctcaggaccacttgcttctggtagactcaacacacatccagactctactctaacccccaaaaaggcatctgaaagagaggctgcgcattcccagtggggaccgcctggtccaagaggacttgcgtaaaagtaggggagatgggtggaacaggtcgagggagatcaaacgctggagttttcccaggacttgccaacatgaaagaagcacacttcagcaagaaactgctgagaaagttatggatgtgcataaagaaatttgtctaagctaacaatgaaaacaaaatacaataaatacaattttcagccagccatgctagaatattcattctatcctctttatagaaaatgacattataaaatcattgtccaatgaacagaaaaagcaaaatacagccaaagatgcaggaaagtattataaaagagggttagttaatttatgatactaacaataaaaacatgtttccagcttttgatgtttatgttatctgtcagctttaaagttttcttccttaattctaagaagagtacttatttttgtagctaaatttttattggtaattatattctttttaaaggaggcttcccaaattatataagcttcaggcctcgtgatatctgtttctactcctactaagtttatcttccaggccctgcgcagtggctcatgccagtaatcccagcactttgggaggccaaggtgggcagatcacttgaggtcaggggttcgagaccagcctggccaacatggtgaaaacttgtctccactaaaagtaagaaaattagccaggtgtggtggagtatgcctgtaatcccagctactcaggaggctgaggcaagagaatagcttgaaccctgggaggcagaggttgcagtgagccaagatcgcgtcacttcatttcagcctgggcaacagagcgagactccatctcaaaaaaaaaaaaaaggaagaagaaaatttatcttccatatagtcatactaaacaaaagtatttctcaagctttacctttgacagcttttgttagaaaaaaatacttctgctttgtatatttaatattataatattcactatatttttagaatttcccacagatattctcatatgatcttttggaggctgagtcctccaggtgaaatgctctgaccagattgatttctaagggcccttctggctctgaggggctgtggtttcaggcagctagatgaaccagcaaaaatgtttgtggccaggaaagggacagaagtggggagacaagcaacatttttggatcaaagttaaaaataaaaactctctgctttcagctacttttaaactagactttatttatgggaaaagtagataacatggagggccaggggttttcagtcttgaagagagggtgagaaatttggtgagtcaattggatggacgagggatagcagaaaagggaatgaatgaattctgactttttctggctcaattagctttgcgatatactgggctcgaaggaatgcttctcaggatgtcacaatgttaacagccttttttttttttttttttttgagatggagtctcacactgtcacccaggctggagtgcaatggagcgatctcggctcactgcaacctccgcctcccaggttcaagcgattctctggcctcagccacccaagtagctggtgttacaggtgctggaccacacctggctaatttttttatatttttagtagagacgggggtttcactatgttggcccggccagtctcgaactcctgtcctcatgatctgcccgcctcggcctcccaaagtgctgggattacaggcgcgagccactgtgcccggccagcatttcctatttagcaagaacaaaaatcccaaggattcataatcagggttccttgattttttttagattgtagagttcttagagattctgatgaaaactatgaaccctctccccagaaaatacatatagtcacatgtacacgacattttaatagatgacttcggagggttctcagaccttctcaagcctatccatgaacctttggttaagaacccatgacatagagagaagccatgtaatcccacccacctctctcctaaatgggttggttgggcttggtagtcatccatccacctctcattcatttattcatcttccattcatacacacatgaatcatccaatcattcattccgttttcatgtatttatttatacaatggagaatatacgtcagtcctgatggctctacccattacctcttcttagagaccccaccctccaaagtccatctgaatgggatacatatggactccagaccaaagaccatcaaaccctctttctcaggcatctgcaattgaggcactgagaaactgagccagtctgatgatggtgatctcttgaatccaaagggcatatagaaaagcttggaagaaacagaaattaagtccaatcatggtggcatatacctgtaatcccagcactttgagaggctgaggcaagaggatcacttaaagtcaggagtttgagaccagcctgggcaacaaagcaaaagcctgtctcaccaaaaaataaaataagataaccaggcacagtgccatgtgcctcttatcctagctactcaggaggctgaggcaggaggatcacttgagcccaggatttgaggctgcactgacctatgaacatgccactgcactccagcctgggtgacagaaaaaaaaaaaaggaacagaaatcaaaagactttcagagagaagagataaccaggaaaatagagtaaacgtgaagggagatgcagagttggaaacagacctgctgactttctgtttcctctgagatttatctgtacttcctgcaattgagttctgttagagtcttctgaatctttatagtaactcctttaaacattagcttacatagtggattgctgatccttggaagtaaaatcctggactaagttctgcaaacaaagtgccaaggggatgttagccacctcacctatgctcacaagtggatgaggtgagcaccatgattatctccattcacaagtgaccacaccaaagctcagaaacttcagtaacccattgtcattagaagaaaagttcagctccttctcatcttctacacatttatatgtcctgatccctaaaaccctctccaccttcatctcctatcagactcctcacatatgatattccaagcatgttagatttttttcttcactgagttcagtctgacctcaggacctttgcacttgccattttctctggaacacatataacttctctgtcttgaggctgactccttccttcctttcagttcaaacattacctttgccaagaggttttctctaaccagctcagggcaactggcatcttctctgcccagtcaccactaaatactctaaatttagctctttgcacaacctgagatttatttgtttatttgcctgtttactgtcctccccattggaatacattcccagggaacacagcacttgcctattccttttgcctctattcccagtgcctgaaactttgttcagcacattctagaagctaaatacttgttgaataaatacatttgcccaagtcaaacagcaagtaagtgatccaggcaaaatgtaaaggtttatctgattccaaaggccttactcttcctaatccattagttccttctcattgttaaatttcaataaaggttttaaccaaaagattataaacaagcaatttaggccaggcacggtggttcacacctgtaatcccagcactttgggaggctgaggcaggaggatctcttgaggccaggagttcacaaacagactgggcaacatagagagattttgtctctaaaaaaaaaaattttttttttaaattagctggacatggtggtgcattcctgtagtcccagctactctggtggctgaggtggaaggatcacttaagctcaagggtttgagactgcagtgagctatgatcgtaccactgtactccagcctgagtgacagagtgagaccctgtctcttaaaaaaaaaaaaaaaaagagtgatttataattagaaatctacaaatctagactataagagaggaaaatactgcaagcaaaggaggagaaacatctgtttcctatttcatgttaagataaaatttatgtcataaggtctggaaacatgcttcattttacctaatcatttcttcttaaaatttctgtaggaattgatgggttttttctttctcagctgaaattctactctaaaagcattagggaatttgttatttaaatgtggcctaagcaaatccttttgcacagccaataatctcaccttaatttctcctttaaaagctgagttttctgcactagtttttttttcttttttctttttagtaaattctaatatgatgcaattttcatagctggtggacttcttagattggctttatttttggcttaaagatgcatttccaatgcaatcgtatagatgtctagtgctctgtatacaaacatcctgagacccagttaagcagataattgaaacttcaagatgaaagagataaaacctaatgacacaagcgcaggatgtaccctgctgggttctctattcccagacatatttctctggttcccttgcattcttgtaccctcattcaaatgtcctttatccccctggaggtcatgtggattcctgtttgtttgggaatgctatgagaactgctcttctaaaggaagaaagagatgacattccagcctttcagagaggtcgcaccaaggatccaaaaaggaaaaagtctcttccatccacttacacatggaaagctggagattttttcccccttgatttggaaagatatgctgaatatctcaaccaatgaaggttccagcagctggccatgctatctgtgttcagtcatacccggagggtgagagtccctccttaaacaacacatctcagctgcctgtcgtaggcagagctgaacatgtcattttacctctgctcatgtctaagtgctctggctatttctggctattttcaatgatttccagagccctggcctttctcctaggcaggacaggttcttctaagcagcagctgagctgaggctaaatgtcctaaccaggaaatcacatggtagaaaattcgtaagtcaaaaatcaatcaacaaaaatccatctctccccttcacggcctggtccctagcatttatgagggttcctcaaggcagggctagacagtggcccacactaggcgtcagggagatcagactgaaatgaggagtggagataaagccattcagcaaatcacactaactttaggaggcaaggtctcctctgggcaaagagaaagcctttgaggaatatctgcttcttcaagatggaaagcatcattatctgaccagcagcaaagtggttctaataatgtcaagtataatgtaatcttaatgtagcacctatatctcagagaggaggaaggatgcttactgagtttctactaggcacttctgtgtagattgcaccactcaattctctccttaaccctagaagataggtacattattccccctttatcaatgaggaaacagagcttcagagaggtgaagcaacccgctcaagatcacacagctctgagcagcagagcccagatgcaaatccagtccagtgggacgcacgccactgccccccacctctcccccaacccacgtgaggacgagcatcttgaaaataagccaataccaagcactgaagcagccattatgcaacagcagcttgcatttgttgagtgctcatcctgggccactcattttttctaagtgcctggtttgtatcatcaatctcagttaacacttgcaataaccccatgaggttagctgcttttattatttttcttttcagatgaaatacctgagtcgcagagtggttaagtgccatgccagggtcatacagactgtaggccttgcttctgggctttgagttcagcattgtagccccagagcccccgctgaatccaacgactgcttcctaaggacttgcaacaatgccgtgtttctgagaatatgagtatcctatttcccaagttggttccccaccccaccatgcagtgtccacccaacagcttggctgagcctgccatctctccttcctcctcctaagacgccttgccctctgcataggagcagctgatcctctggaaggcccaggtgtgcatggctggagctgacctgcccctgtcaagtttgtagcagaggaaacgatcccagtttcccatctgacatggcccttcagcaccctagttcctgtgttccaggcatacctgtaatgtttccacagattctaaagccatccaggccaaaaggcttatttgcttcttcaatcctccagtgtttttcatagtaccaggcctactatgggagctcagtaaacacatgtttaaagacacacctctcttatttcacccagagcccctgaaaatgaattcccacgtggtggcgggtgcctatagtcccagctgctggggaggctgaggcagaacaatcatttgaacctgggaggcggaggttgcagtgagccgagatcacgctactgcactccagcctgggtgacagagtgagactccgtctcaccaaaaaagaaaaaaaaaaaagaaaatgaattcccgttgccagttgctcttcctttccccaggtagaatggcctaatagaaaggagtctttgcagttaccgacctggatttgtgtccccaccccagcccccttatgcactgtgcagtcttcagcatcatcctctccgggactgtttcctctttggtgaagcagggcaataccttgccttgcagtgttcttgttgggctttcaaaagaccattatataagaggcatggccgaaagtaagtgcttaaaataagaagactgctctttcctgtcctctattcttactgagtttagcctttacaacgcaatggctgttacaaaaaataaaaaaatgaaaaagtcttcagatgcttctcttcccacggccgcatagggggctgaaaaggagcactttaaggttctgacagcgcatcctggccctgttgctcccttgctgtgcagtcttggccaagtcacttaacctttctaggcctcagtttcctcacctgtcaactgtgaagatctgggctaaataatctctcaagggtccacgagtccaaggtttccctgatcatagttactcagtgctcctacttaaaatatttggaaatgaatattcttcgcctctatgaggccagagctcctttttcccatctaaacttgtggagctgtaagcaatttaccccagagatgctgatttacccctgggctgccttcccgagaataagatggttgatggtgtcctgtgtgtgagcagtgggctgcagtgaccaggcctgtgcagggccatgggtctgggcaggacctacctgtggcaagtcactgtgctctcagctcgatttattttatttttaaaatgggggtaggaggaagaggagggaaagtttgcattaagcattttaagttgtttttacattacaaaagcaataaaaacatagcaaatttgggaaatagatgttaggaaaaaaaatcatccagcattttatctaattcagtcactattagttattattttggtctttctcttaaccctttttcatttgtgtaatttacctagtagatatgtaacttgtgtcttttttggtttttttcttattttttttaacagtattgtcataaaaatttgcaagttgcttcatgatctttgcaatcactatatcatgatgcatatttcttttgtcattctatgtgtttgttggtttgtttttaactactaaagacaatttttattttattatttatcaatataaagctacattatatctttttgcatatatatgcatatatgtgtgcacaaaggtgtgcatttctaagagaatagattctcgggaatggacttactgcttcaaaggatttgatcatttgcacagcttttggtacatgttgtcagattgctttccaaaggggctgcactgatttactatgccatcagcgattacccattttgctgcatcttaaccagaactggttattatcatttaaattttttggagatttaataggcaaagcagtgcctaattgttttaatttgcatggcattgatgaactgaggaagccaatcatttttccatatttttgttttcctctcccttcctaggatcaagtgatttctgaggcactttcatccccagcttctaacactttaggtctgggagcctctagggaagcagacagatagcacaagattgcaagagtcagacaggagactatatggagatataaatgatgacattaaggggttactggacagaggcagaggagaaaaactaagaattaaccaaagaacacctaagaagtgattctggtcaaacttaaaaggtatctcccctcttctgtttggcagctcccttgatgtgcaatggaaataatgcagttgctctctcttctgtgattagaaagagaaaatgagaattcattcatgagataaaagttaaaataatgttggtattatttacagtgagatcccatttaaggctgattttggtaatcaagactgataccttcatcgaagacagataaggtgtaccaggtgtttcctgtatctaattcatatgtttacggtacgggaattggtctccctagtaaatgaatctctttgagaaccagctgtatcttttatgatgggttcattcaactaactggcttaatcaaaaggtcagtaaaaagctgtaacctttaaaacactggaggcttaccagttgctccagagatacttcatcttccctttcacatacttacttcaatttttcccatgtttcttcaccaaatttctctatcacaagagattgcagacaggtgttgataaatccatactagaatacaaaaccagaagaaaaatatatattatgaggcatgaaatccccagtcatacacatcttcatgtcttttaggaaatgtgcaatggcatcctcttggagaaactaattataccttttccttgtttctcgtgatttaatttaatagctctgctcattcccaacttaggaaaaacctggcaccccaccgcttgggttatttctatatagaaaacatatgaactacatttgaaatcaaattgtaattagagaaagttaaagaaagtatttactgtcaattataatcctctccgaaataaggaactggtttgttagaacaaagaattcaaaaacacaccagtggcatggaggtgtttagacctggcagaaaggaagggcacacacttcatgtcgattccaaaaaggcagtgacaggatgattttttttttctttataaaaatgaatctatacctgggtgtgtgtgtggagaatataacgagtgcaggaaaacagaggaggaaactccaataagaaagacagcaccaggttaacagaaagaactgtcttctgggtttgctcattaatctgtgctctttcttcttcctccatcagagaaaaaaaaaaggaggacccatgaacacttctgcttagtgagggatagtgtgccccaggcaggccacctgccttccgcaactcggggctcctaacacaagcagggtgattgagttatgtttgaaagcactgtgtgagctcagctttcaaaatatttcttcctgaagggaagaattcttttgtcacacaaatatcaggctccagatttattttataagtttggattttcatatatataggaatttcttaaagtgaaagagcccagtgccaacaggaaggcgagtgtctaaactctggtagttattttccagaaatggaaatatttgtcctactgggctatatttccagttccccaccaccaatgtcatccttactccttactccatcttgtcccgcctctacgctccccaatatgtgcccgcaccctagcctggcattcagagcactctctagaactgtcttaatttgtttcattttatcacctactcctgctgccttaggctcatccaaaatgcctaccacccttccccaaacagagatgtcatttcttcaatggatagagtttcctcctttctcacccagtcagcccagggcaaggccaggctctgaggctactgggatactgcctggtctgcagaaccatttcctctccctctgccagacccagccatcattccctgtcaggctcactgctggatgcctctgtgtcctcaacaccacagagatggtgtgttaactatcacatgcacacgctcgggttttgtatctgtcaacacacacatatatatatacacacaggcatgtatgtatgggtgtgcatgtatttgtatatacttatatatattatgtatgtttatatgtggccatgtacacatataaatgcatatgtgtgtatgtatatatatatttttttcctgtcctttgttaaattgcaagctcctcagggtcaggaagtaagtgtcatttatctatattttgactaaagtgccaagacactgtctgctacacaggaggtatttaacaaacacttatcgagcaaggaagtactgaaatgaagcctcaagtctcatgaaaatctttaaataacccgttattcaacatcaatccaatgtaaacaaagatagcaattgttcaacttagcaatctttgcaaaagtatgcccaatcaaataaaacatcatgcccactgcccgagcactagagacaaacttctagtgtgtaacaagggaaactgaggcagtggggaatttgaagtctgctgctagttgataaccacatcacctacttctaggtcatgaccaccccgatagtgtgcctctgtttgatgaatttagggccattgagtcatgtggtccagcatttgtctttggtgttcagcagttccccaagctggtaccagagttaatcatttagagaccttgagcttatagatcagagagtggccccctcaccctctactgattataaacatgtccctttcctgtccactgaaatcaggtgactttctctgcccctggagagagcaaaagaggcaatgtatcccacacgatgtgtcgagcatatgcggggaccttggtgtttgctgcccacacccaggtggagggggatacttggtaggacacactccctacacatttgagggcctcactgaaataagtaagaatggcaagccagcaccaaagttctctaaccatctggaactagtgctgctcaaccagtgagatcagcaagcaggcagggactctcatttgctggtgacacccaaatctttcagaggctacttgggccatggctgcagcacccccaaaaacatctgcgttccaaagaagcaattaaaatgtctgaaaatgttaaggtttagccaaatctttctcctgtaaagatgttttcacattccatatccagtcctactcaccgtgcctgccaggcattggctggggaatgtggcttcaaaataaaatgcagtctcagtaagcccagagagggagtacagcttaggagaaagggtttgggctctggagccagaagggtttctgtttctgtgacttgtagctgtgcagctttgggtaaattgcctaacctctctgagcccagtctgctcatgagctaaagtggacataataccgtttgctgtgttggaggatggttgttggggttatagagtaacggttctgaagttagaccatgagggctcattgctgaccccaagtcttatttgctgtttgactcaagccagatcttactcaccctcagttgtctcatttggaaaatgggggtgagaatggtcccttcctcatagggttttagtaagcattaaatgaggtaatacgtgtgaggtacttggcacatagtaagcgctcaggaaactgtagcctcttagataacaggcattttgaacaataggtgctcaacaaacagaagcggaaggaaagtcagggccaagggtgctgagagctgctcaccatgttcctgccgcagctgctcctggggccacagggattgagatgcagcaccaagcgcccgcccttcctgccagcccctagtcactcaggagagaatccacagcgtctccagaagcctgtcttgtagaaatctgggcagtccacagtgaaattaggagctcatcactagcctccaagcaaggagcacactgttgggtcctcagtcac

SEQ ID NO: 694 - DNA, 130789 bp, Homo sapiens
ggagagaaaggacgcacgcttcccgccattttgttcagcttgccgggcaaccggcccctgctggggactacaagtcccgtaagcctccgcggcggcacgtcctaccctacactgtccagccggctccctttttccccctccccgggggccaagggctccggctgctgcctggcggccaacgggccaggtaggatttccgggagaggctgctgtggaggctgaggaggcggcggcggagatctgggtaagttcagcgagcaagggaaagtgagcaggacgcgctcagtatcaggctgcggcctcctctcaggctgcggcccctttcttggctctgcgagagggtcccggtccgggcagaaggtaacggcccgggtcgccgtcgcttcgggccagggcggggcggggccgccgcctccctcctcggccctcccacaacggtccaacccgggcttctccgcctgaggcagggcccgcgcaggctcgccctctccgccccccgagacttggctgggcccttttgtctgggctgcgttgctccccctttgtgtccgtgcatggagtctccgccacgggggagcctgttcccccggtccccaacagggactgctccctggggatccggttacagtaaccggatcgggtcaaagtacatttttcaaaaccgtcctgcctcagacctctgcacccctgctgggcagaacgggggcttcggagccaggcggagtttctgtaaaaacctggaggttattatttaactttcaaacatcagcctgggcggcttcagggcacgaaactcccgacgtttttcttggtggagagatgagattaaggaaaagaagcgacccctctctcccaccctctacaccccggctccgggaaaccgggaaggcatcgaatttgctgcgatgtctgtgcagctcacatctgtgatcggtggaccaaagaaccagtggtgaatggtagaatggcagttcacgcacctcccaaatctcggaggagagtgacttacagggcatcactgattgcttgcaaaaaaaaaaaaccctccagtgcttcattcggacactcagctcctcgctccttccaacctcttccttttcttgttctttttaaaacaaacagtggaaggaaaaagtccttcagtggaagaatttgctttatagaggaaccagaaacccagtggcttctagaagtcacttactttttcgccaaattaaagaaatgaatttcgggcgtggtggcgcgcgcctgtaatgccaactattctggaggctgaggcaggagaatcgcttgaggccagaagttcgcgaccagcctgggcaacacagcaagaccccatcttaaaaaaaaaaggaatgaagcccgtttagaaatgaagccagtttaggggatgaggtgtggtagattcttaccggaaaccgcggaactgcgtggattgtggattcgatcaaatttggctagataatggtaactgtgtatgtcctcctgttggaagactgcattgctagaatcagcttaaggtaaaatttgtttgtttgtttcatttaagagacaagagtctagcttggttgctgaagcttgagtacagtggagagctcctagttcactgtagcctcgaacttcttggcttaagccatccttccaccagaggctcccagatgcctgggactagaggcatgagccactgtgcccgactatttaatttaatttatttatatttatttatttattttgagacaatctcactttgttacccaggctggaatgcaatggcacgatcttggctcactgcaacctccacttcccaggttgaagcgattctcctgcctcagcctcctgagtagctgggattacaggtgtgtgccaccatgcccagctagtttttgtatttttggtagaaacaaggtttcaccatgttagccaggctggccttgaactcctaacctcaggtgatccacccgcctcggtctcccaaagtgctgggattacaagcgtgagccaccgtgcctggccaatttttatgtatttattttttgaaatagggtctcgctgggtttcccaggctggagtgcagtgagttgagcactgctcactgcagcctggacctcctcctgggctcaagcctctgcctccagagtagctgggacaacagacacaggccaccagcgcagctaattaaaaaaatttttaaaaaaatttttgtattgattggggtcccactctgttgcccaggctggtcttggactcctgggctcaagtgatcctccctcccaaagtgctggtattaaaccttaagataaagaatactgtatttgttttttgagatagagtcttgctctgttgctcaggctgtgcagtggcgtgatcttggctcactgcaacctcttcctcctggtttcaagcgattctcctgcctcagcctcccgagtagctggaattacaggcatgtgccaccactcccggctaattttttttttttttttagtagagatggtgtttcaccgtgttggccaggctggtctggaactcctgacctaaagtaatttacctgcctccgcctcccaaagtgctgggattacaggtgtgagccaccgtgcctggccaataaaaaattctaaagaaggtcattgcaaataacccttttgaaaaataggttaattcgtgtttcaagtctctgggatgaggacagccaggaggacccctttacatgaatcagggaaggttactgaagttagataggttaattcctgccctagccgagtaggcaaaataaagcccttcaccctgtattactttgtttgatatctcataatggaagtgacttactcttgagaatcctagattgtattagtaatactgtatagggatggtagatccttaatgcagttcttcaatttttaatccagcagtgagtgagggtcttttgtgttttcctggctatagtttgaagaagcaaccacagaattgctctagttttaataataaactggttgggcgcggtggctcacacctgtaatcccagcactttgggaggctgaggcaggcagatcacctaaggtcaggtgttcgagatcagcctggccaacatggtaaaatcccatctctactaaaaatataaaaattagccaggtgtggtggtgggcatctgtaatcccagctacttgggaggctgaggcaggagaatcacttgaacctgggaggcggaggttacagcgagctgagattgcgccactgcactccagcctgggcgacagagggagactcagtctcaaaaaaaaaaaaaaacacagaaataataaactaagaaacagcagttactattgactattgcttaattgtacaaacatgacaattttctcaatattatttatttttatgattattattatttttttgaggcaaggtcttgttctgtcccccaggtggagtaaaatgctatgatcatggcccactgtagcctcaacctcttgggctcaaatgatcctcccacttcagccttctgagtagctgggactacaggtgcacactaccacacttggctaattttttaatttttttgtggacacgaggtctccctgtgttgcccaggatggtcttgaactcctggactcaagcagtcctcctaccttagcctccgagagtgctgggattataggcgtgagccagtgtgtctagctatatatttattcatttattttgtttgttttaaacataatttttttttttgagatggagtttcactctttttgcccaggctgaagtgcaatggcacgatcttggctcactgcaacctctgcctcccgggtttaagtgattcttctgcctcagcctcctgagtagctgggattacaggcatgtgccaacatgcctggctaattttgtatttttagtagagacgggaattcaccatgttggccagactggtcttgaactcctgacctcagatgatccgcccacctcagcctcccaaagttctgggattacaggcgtcagccatcacgcctggcccataattttataatttttatagagacaggtctcgccatgttgcccagcctggtctcaaattccttggctcaggcgatcctctcacctcagcctcccaaagtgctgggattacaggcatgagtcaccatgcccggcctcccagtaccattttttaaacaaattaatacacattgtgtcatttaatcctcactacagttctgtgagatggttgttactctcattttacagctgataaagcctagcctctaaaatgttgaagtgacttgcccaaggttatagttaacccaggtaggaaatatcagagtaaaccatacttcaaatctagtcctctttcagttacctcacacttattacagctactaatcttagcagcaccaacagctttaatttgctaaaatctaaatattggagaaaatggaaaatattttccaattaaggcaaattgatttacaaggaactggaatttctggaaccataaacaatgagtctttctcttaaattatattgaacattggtcccattactttgtcttctcatatgctgtgattaccttgtgcctaggcagaatggcagttttatgcaacgctcaaaaagtggtgagttactcagttttggttccccctaatctttgctataaggtttattaaatatgttggagaacataaatacaatagctttggctgctgaaactaacattgaagacagaaccaaaattaagatactgtacttttttagtcagaccatcgggactcaagagaatgctctctctagtttctgcttttaataaaaacttttaatcagtttcaaacctgcagttaagtcttggatttatgttagtacatgccatgaatgtgacatcagaaacagaaacctatttcacctcccttacttattaggtaaaatgcataacatgccaatggaattgagtcaatacaattatgtagtctagcctttctaactggtagtagcctgtttgaaatcttttattattgcattataatgggaaagaactttttttccttgtgcttttgctgttggtttacttcatttccaaaaccatctgttcattcagtcaacaaatacggaaagtctgttatattctaggcactgttgtagacattgaggacaaaacagtgaaaacaagtattttccctcttggggtttacctactgattagggttggctgggaagaggaaggagtctgacagtaaataagcactaaataaataaaattccctcatataactgcaaccttgagcaactcaacctctttgagctttagttttcttgtctttaacatggatgtaattgattcctgctcttcctatcttgtggattgtttctaagagggagtagaataagtatttggatacattattcgcttcaaattcctgtagcaagttatttttactactattagaagaagaggcccagcacggtggctcacgcctgtaatcccagcactctgggaggccaaggcaagcagatcacttgaggccaggagttcgagacgagcctggccaacatggcgaaaccccatctctactaaaaataaaacaattagctgggggtggtggcccatgcctgtagtctcagttacttgggaggctgaggcatgagacttgcttgatcccaggaggcagaggttgcagtgagcagagattgtgccactgcacttcagccggggtgacagagcaagattccatcctcccaccacccctgcccgcccccacccacccccccaaaaaaaaaacaaaagaaaagaaaacaaggagcattggaagaagattatttataaagagagaggctgggcccagtggctcatgcctgtaatcccagtgcttcgggaggctaaggcaggaggatcactttatgtttatcccaggagtttgagaccagcctggcaacatagcaagactttgtctctacaaaaaaaaaaattaaaaatcagccaggcatggtagtggacatctgtactcccagttactcaggaagctgagataggaggatcacttgagctccacggtttgaggctgcagtgagctatgattgtgccaccacactacagcctgtgtggcagagctggagaccctgtttcaaaaaataagtaaataagtaaaataggaaagagagaagggaatggatggattctttattctgagggagctctaaagtcctgttgtaaaactttcacaatcggccaggcgcggtggctcacgcctctaatcccaggactgtgggaggccgaggtgggtggatcacccgaggtccagagttggagaccagcctgaccaacatggagaaaccccgtctctactaaaaatacaaaattagccaggcgtggtggtacacgcctgtaattccagatacttgggaggctgaggcaggagaatggcttgaactcgggaggcggaggttgctgtgagctgagatcacaccattgcactccagcctgggcaacaagagcgaaactccatctcaaaaaaacaaacaaacaaacaaaaaaaactttcacagccgtgtcttcacaggggctaccataaccaaattatgtagacctttttcttttctcttctttctttttcttttttttcactgctgtggtcccagctactcaggaggctgaggcacaggaatcacttgagcctaggaggtggaggttgcaatgagccaagattgtgccactggactccagcctgggtgacagagtgagaccttgtctcaaaaaaaaaaaaaaattgagacagagtcttactctgtcacctaggctggagtccagtgacatgatcagggctcactgaacccttgacctctctcccaggctcaagcactcctcccacctcaaccccctgagtaactgggactacaggcatgcaccaccatgcctggctaattttttcttttttttttttttcttttagtagagacaaggtctcattatgttgcccagaccagtcttgaactcctgagctgaagcgatccacccgccttggcctcccaaagtgctgggattacaggcgtgagccactgcgctgggcctatgtagaccttttaattttttttttgagacggagtcttgctctgtcgcccaggctggagtgcagtggtgcaatctcggctcactgcaagctccacctcccgggttcacgccattttcctgcctcagcctcccaagtagctgggactataggcgcccaccaccacacccggctaatttttttgtatttttagtagagacagggtttcactatgttagccaggatggtctcaatctcctgacctcgtgatccacctgtctcggcctctcaaagtgtggggattacaggcgtgagccagcgcgcccggccttaatttttttttgaaatgagttttgctcttgtcactcaggttggagtgacagtgtgatctcagcttactgcaacctctgcctcccgggttcaagcgattctccagcctcagcctcccaagtagctgggattataggcgctcaccaccatgcccggctaaattttgtatttttagtagagacagggtttcgccatgttggccaggctggtcctgaggttccaaactcctgaactcaggtgatccacctaccttggcctcccaaagtggtaggattacaggcgtgagcctccgcacccagcctttttttttttttttttgtagacgggagtcctgctctgtcacccaggctggagtgcagtggcgtgaactcagcacactgcaacctccgcctcctgggttcaagtgattctcctgcctcagcctcctgagtagttggggttacaggcgtgcaccactatgccctgctaattttttttttttttagtagagatggggtttcaccatgttggccaggctggttttgaactcctgacctcaagtgatccgcccgcctcagcctcccaaagtgccaggatcacaggcatgagccaccacacccagcccatcaaagctttttgaaatgatctgtaggccaggagtggtggctgcggcctgtaatcctaggatcatgaggccacaaggtggagttcaagactagcctggccaacatggcagaaccctgtctctacaaaaactacaaaaaagttagcttggcatgtggcacgcttctatgagtcccagctactctggaggctgaggtgggaggattgcctgagcctggaaggttgaggctgcagtgagccgtaattgcgccactgcactctagcccaggtagacagagtgaaagaccatctcaaaaaaaaaaaaaaaattgcttactatcttgatggttggtgagagggtttagagaaggtatttatgtacttgttaaaaatttttggccagatgtgttggctcacgcctgtaatcccagcactttgggaggctgaggcgggcggatcacgaggtcaggagattgagaccatcctggctaacacggtgaaaccccgtctctactaaaagtacaaaaaattatccgggcatggtggtgggtgcctgtagtcccagctactcgggaggctgaggcaggagaatggcgtgaacctgggaggcacggcttgcagtgagccaagattgtgccactgcgctccagcctgggtgacagagcgagactccatctcataaaaaaaaaaaaaaaaaatttggccaggcgcagtggctcacacctgtattcccagcactttgggaggctgaggcgggtggatcacctgaggtcaggagttcgagaccagcctggctaacatggtgaaaccccgtctctactaaaaaaaaaaaaaaattggctgcgtgtggtggcaagtgcctgtaatcccagctactcaggaggctgaggcaggagaatccctgaacccgggaggcggaggttgcaatgagccaagatcatgccattgcactccagcctgggtgacagagtgagacttcatctcaaaaaaaaagaaaaaagttttttttttaaccatttttttgtttttctttctttctttctccccccagccccccccccctttttttttaacaacccaagggcacaagggggaaaaaatagaggaagtatttagaatgttttgttttgttttgattttaaggatgggagaggtttgacatgtttgaagggaaagggaaagcagccagcagagaggcagatattggagatgtgcacagagaaaatgtagataatgaagaagtcttaggaggaaatagaatgaaaagctcatgaaacagtaaactttgaagaggaatatgaagaaataaagggtgagagaagatatatttggaagtggtggacatggaaggtgaaataagagtagttgttaccagttgattactgttattacccaggcactgatctaggtttatttatttttatttttatttatgtatgtatttatttttttaagacagagtcttgctctgttgcccaagctggagtacagtggcacagtcatggctcactgcagcctcaactcccctgctgggctcaagcaatcttcctgtctcagcctgctgagtagctgggactacaggcataccgccatgcctggctaatttttgggttttttgtagcgatgggatttcgccacattgcctaggctggtcttgaactcctaggcttaagcgatcttcctgcctgggcctcccaaagtgcttgaattacacgcatgagccaccatggccagcctataatttctttctttcttttttttttttttgaaacagagtctcagtctgtcacccaggctggagtgcagtggtgcgaccacagctcactgcaacctctacctcctcaggctcaggtgggtgatccttccacctcagcctcccgggtagctgggactataggtgcgggccaccacgccaggctgattttttaaaatttttgtagagatgggatttcgccatgttgcctaggctggtcttgaactcctggtctcaagtgatccatccaccttggcctgccagagtgctaggattacaggtgtgagcccctgtggctggccctggcctataatttcttttcttttttttttttttgagatggggtctcgctctgttgcccaggctggagtgcagtggcacaatctcggctcagtgccagctccgcctcccgggttcacgccattctcctgcctcagcctcccgagtagctgggactacaggcgcccgccaccacacccgactaattttttgtatttttagtagagacggggtttcaccgtgttagccaggatgatctcgatctcctgacctcgtgatccgcccgcctcggcctcccaaagtgctgggattacaggtgtgagccaccgcgcccagcctataatttcttatattccataattgtaaaattatttttccataagtggagtaaatattatattctcaacttgtgtttctattatcaacttttttttaacttttggacagactaatttagatgtgtgggataaaaatgttattctgtgtttttttaaatgtaactttttttttttttttttttttttgagacggagtctcgctctgtcgcccaggctggagtgcagtggcgcgatctcggctcactgcaagctccgcctcccaggttcacgccattctcctgcctcagcctcccgagtagctgggactacaggcgtccgctaccacgcccggctaattttttgtatttttagtagagacggggtttcactgtgttagccaggatggtctcgatctcctgacctcgtgatccgcccgcctcggcctcccaaagtgctgggattacaggcgtgagccaccgcgcccggccttaaatgtaacttttatgttcagagatatatgtgcatggtttggtatacaggtaaacttgtatcatggaggtttgttgtgtatattattttgtcactcaggtattaagcctagtgcccattagttatttttccagatcctctccctgctcccatcctctactctccaataggcaccagtgagtgttgttcccctctgtgtccatgtgttctcatcatgcaatatttggaacatgtgatatttgtttttctgtttctgcattagtttgctaaagataatggcctccagctccacccatgttcctgcaaaggacatgatcttgttgttttttatggtggcatagtattgcatggtgtatacataccaccttttctttatctagtctacttttgatgggcatttaggttgattccgtgtctttgctgttgtgaatagtgctgcagtgaacatatgtgtgcatatgtctttataatagaatgatttatattcctttgggtatataaccagtaatgggatttctgggttgaatggtatttctaagtctttgaggaattgccacactgtcctccacaatagttgaactaatttatactcccactgacaatgtataagcatttctttttctccacaatctcgccagcattattttttgaattttttttttttttttccgagacagagtcttgctctgtcacccaggctggagtgcagtggagtgatctcggctcactgcagcctctgcctcccgggttcaagcaattctcctctcagcctttccagtagctgggattacaggcccacaccaccacgcccggctaatttttgtatttttgtagggacagggtttcaccatgttggcagtctggtcttgaaatcctgacctcgtgatctgcccgcctcggcctcctaaagtgctgagattacagccgtgagccactgcgcctggccttttttttttttttgagacggagtcttgctctgtcacccaggctggagtgcagtggcgtgatctcagctcactgcaacctccgcctcccgggttcaagcgattctcttgccttagcctcccgagtagctgggactacaggtgcatgccaccacgcctggctaattttttgtgtttttagtagagacgcagttaaaccatgttagccagtatggtctcgatctcctgacctcgtgatccgcccgcctcagcctcccaaagtgctgggattacaggcatgagccactgcgcctggcctggcctatttttttactttttaatactagtcatcctgactggtataagatggtatctcattgtcatttcgattggcatttctctaatggtcagtgatgttgagcttttttcatatgattgttggctgtatgtatgtcttcttttgaaaaatgtcagttcatgtcctttgccgacttttttcttgtttctttttgagacagagtcttgctctgttgtctaggttggagtgcaatggcacaatcttggctcgctgaaacctctgcttcccagcttcaaatgattcttgtgcttcagcctcctgagtagctgggatgactacaccaccacgccaggctaatttttgtatttttagtagagatgaggtttcaacatgttggccaggctggtctcgaactcctggcctcaagtgatccacctgccttggcctcccaaagtgttgggattacaggcgtgagccactgcgcccagccctttgcctactctttaatggggttgtttagttttcttcttacaaatttgtttaagttccttgtagatgctggatattagacctttgtcagatgcatagtttgcaaaaattttctcccattctgtaggttgtttgttcaccctgttgatagtttccttttctgtgcaggagctctttaattagaccccatttatcaatttttgcttttgtagtaattgcttttggtgtctctgtcatgaaattttttttttttttgagacagagtctccctctgttgcccaggctggagtgcagtggcacgatcttggctcactgcaagctccggctcctgagttcactccattctcctgcctcagcctcccgagtagctgggactacaggcgcatgccaccacgcctggctaattttttgtatgtttagtagagacaaggtttcaccgtgctagccgggatggtctcgatctcctgacctcgtgatccgcccgcctcagcctcccaaagtgctgggactacaggcgtgagccaccgcgcccggcctatcatgaaatttttgcccatttttatgtccagaatggtattgcctagcttgtcttccagggtttttgtagtttcgggttttacatttaagtctttaatctgtcttaggttaatttttgtatatagagtaaggaagggatccattttcaatcttctgcatactagccagttatcccagcactgtttattattattaatttatttatttttagacagagtctcgctctgttgcccaggctggagtacagtggcacgatcttggctcactgcaacctctgcctcctggattcaagtgattctcctgactcagcctactgagtagctgggactacaggccccgccaccatgtctggctaatttttgtattttcagtagagacagggtttcaccatgttggtcaggctggtctcgaactcctgacctcaagtgatccacccacgttggcttaccaaagtgttgggattacaggcatgagccaccgcgcctggcctcgtgcaccatttattgaatggggaattcctcattgcctatttttgtctggcttatcaaagatcagatacttgtaggtgtgtggcctttatttctgagttctccattctgttctattggtctatgtgtctttttttgtaccagtaccatgctgtattggttactgtagccctgtggtatagtttgatgttggatagcatgatgcctccagctttgttctttttgcttaggatttccttggctcttttggttccatatgaattttaaaataatttttttttctagttttatgaagaatgtcaatagtattttaataggaatggcatggaatctatacatttcttagagcagtgcggcccttttaacaatattgattcttcctatccataggcatgggacgtttttccatttgtttgtgtcatctctgatttctttgagcagtgttttgtagttctctttgtagagatctttcacctccctggttagctgtattcctaggtatttgtgtgtgtgtgtgtagcagtcgtgaaagggattgtgttcctgatttggcagtcagcttgactgttgttgaggtataggaatgttagtgatttttcacgttgattttgtatcctgaaattttgctgaagttgtttatcagcttaaggagcttttgtgctgagaccatgaggttttctggatacagggtcatgttgtctacagacaaagatagtttgacttcctctcttcctatttagatgcccttaaatacctacttcattgaatttttaacgtgcagtggtattgaattttatcgaaagcctttaatgcatctgttgagataatcatgtggtttttgtctttagttctgtttatgtgatgaatcatatttacgaatttgcatatgttgaaccaaccttgcatcccagggctaaagcctacttgattgtggtgggtaagctttttgatgtgctgcggatttgatttgccagtattttgttgaggatttttgcattgatattcatcaagaatgttgacctgaagttttcttttttttgttgtgtctctgccaagttttggtatcaggatgatgctggcctcatagaatgagttaggaaggagtccctcctcttcattcttttggaatggtttcagcaggaatggtaccagctcttcttggtacatctggtagaattcagctgtgaatccatccggtcctgggctctttttggctgataggctatttattactgactcagtttcagagctcgttattggtctgttcagggattcaatttcttcctggttcagtcttgggagggtgtatgtgtctaggaattatccattttttctagattttctagtttatgtacatagaggtgttcataatattatcagatggttatttgtatttctgtggggtcagtggtaatagccccttttcatttctgattgtgattatatttgaatcttctctctttttgtctttattagtctagctagcagtctgttgtattacttttttcaaagacccaactccaccaggcgcaagggctcatgcttgtaatcccagcactttgggaggccaaggtggatggatcccttgaggcaaggagtttcagaccagcctggccaacatggcaaaaccccatctctactaagaatataattagccatgcatggtggtgcacacctgtaatcccaactacttgggagcctaaggcatgagaatcgcctcaacctgggaggtggaggttgcagttagccaagactgcacctctgtgctccagcctggacaacagagtgagactctatctcaaaaaataataacaaataaataaataaaataaaacaaaaaacccaaatccctcctggatttgttgatcttctgaatgagttttcagtgtctcaatctccttcagttcagctctgatactgattattctcttttgctagctttgggattgatttgctcttggttatctagttcttttagttgtaatgttaggttgttaaattgagatctttgtaactttttgatgtggatacttagtgctctaaatatccctcttaacactgccttagctgtgtcccagagattctggtatgatatatctttgttttcattagtttcaaagaacttcttgatttctgccttaatttcattatttactcaaaagtcattcagggccagtaacagtggcttatgcctgtaatctcagcactttggtaggccgaggcaggtggatcaccagaggtcaggagtttgagaccagcctggccatcatggtagaaccccatctctactaaaaattcaaaaattagccaggcatggtggtgcatgcctatagtcctggcttcttgaaaggccgagacaggagaattgcttgaacctggaggcggaggttgcagtgagctgagatcgtgccactgcactccagcttgggcgacagagcaagactctgtctcaaaaaaaaaaaaaaaaaagtcattcaggagcaggtcattcaatttccatgtaattgtatggttttaagtgaatttttttttttttttttttggagacggagcctcattctgttgcccaggctggagtgcggtggtgcgattccaactcactgcaacctccgcttctgggttcaagcgattctcatgccttagcctcccgagtagctgggattacaggtgtgtgccaccacgcccagctaattttgtatttttagtagagacagggtttcagcatgttagccaggccgatcttgagctcctgacctcaggtgatccgccctccttggcctcccaaagtgctgggattacagacgtaagccaccacgcccggctggttttaagtgaatttcttagtcttaatttctagtttgattccgctgtggtccaagagattgtttactatgatttcagttcttttgcatttgctgagaagtgttttacttccgattatgcaaccaattttagagtatatgccatgtggcaatgagaagaatgtgtattctgtttttcatttgtttgtttgtttttctgagacagagtcttggtgtgtcacccaggctggagtgcagtggtgcgatctcggctcattgcagcctccacctcccagattcaaacaattctcctgcctcagcctcccgagtagctgggactacaggcatgtgccaccaatcttagcaaatttttggacttttagtagagacagggtttcaccatgttggccaggctggtcttgaactcctgacctcaagtgatctgcctgcctcggcctcccaaagtgctaggattacaggcatgagccaccacgcctgaccaattctgttgtttttggatggagggttctgtaggtgtcttatcaggtccctttcacccactgctgtttgaatcctgaatatctttgttaattttctgtctcgatgatctaataatgtcagtggggtgttaaagactctcactattattttgtgggaaactaagtccctttgaaggtctctaagaacttgctttatgaatctgggtgctcctatgttgggtatatatatgtggcggtgtgagccaccgtgcccagccttgtgtttttttaaataatgctatccaattattttcagtagcaattgatttgtgagggcattttgaaccttgtaagacaccaaataatgacgtgtttttattagtcttgtgatactagtatccacctaggtcattagatatttaaaatctgcactttatataggaccaacgatatttaaaaaaatagtgaagtatctttcttacactagtgttgatgatgtgtatatttcttgtttacctgagtatagggctcatagagaaatggttgttctttgggaaagcttaggtgagttgattgtttattaagcaagcttaaaaattagagccctcaggctgggcgagatggctcacgcctgtaatcccagcactttgggaggttgaggcaggtggatcacgaggtcaagagatcgagacaaccctggccaacatggtgaaaccctgtctctactaaaaatacaaaaattagctgggcgtggtggcacgcacctatagtcccagctactcgggaggctgaggtaggagaatcacttgaacccaggaggcagaggttgcagtaagctgagattgtgccactgcactccagtgtggcaacagagcgagaccctgtctcaaaaaaaaaaaaaaaaaaaaattagagccctcaaacagttttccccctcctccagtgagtgacaaatagaaagagggaggattccaagagataatatttaaaaatagccttacatcttcttcccttcattcatggattaatccctgttaaaaatgctgccagtaaatagcaaagaataactgtatagaaccaatcataggatataaaaggactttcttcttccttttacttgcacatacccaattttgcctcctgtcccttcctctaaatttgaatttatttcagggtgagcattatgattcaggatatcagtgcacctttgctgtatgtattaaagggtgaaaggctgggcatggtggctcatacctgtaatcccagcactttgcgggggctgaggctggaggattgcctgaggctaggagtttgagaccagcctgggcagcatagcaagacactgtctctacaaaaaacaatttttttttttttgagatagagtcttgttctgtcgcccaggctggagtgcaatggcacgatcttggcccactgcagcctctgcctcccaggttccagcgattctcctgcctcagcctcctgggtaactgggattacaggtgcacgccaccacgcctggctaatttttgtatctttagtagagacagggtttctccatgttggccaggctggtctcgagctcctaacctcaggtgatccacccgccttggcctcccaaagtgctgggattacaggtgtaagccaccatgcccggcctttgttttttttaattatccaagtatggcaacgtgggcctgtggtctcagctacttgggagcctaaggcaggaagatcacctgagccaggagactgaggatgcagtaagctgtgatggtgccattatgctgcagcctggacgacagagtgagactctgtctcaaaaaaaacaccaaaaaaagatgtcacataatcttaaaatttgtatggaacacaaaaaggctctgaatagtcaaagcaattttgagctaaaagaataaagccagaggcatcatactgtcttatttcaaaatatgcgacaaaactgaagtaaaacagcgtggatctgccataaaaagacatagacaaattgaatagactagggaatccagaaataagtccacgtaggtatggtcaattgattttcgacaaagatgccaagaacacacagtggggaaaggacaatcagtgtcttcagtaaatgatgttgggtaaagtggatatccacatgcagaagaatgaaattagatccatgtctctcaccatcttaaaaaatcaactctggctgggcacggtggctcacgcctgtaatcccagcactttgggagcctgaggcgggcagatcacgaggtcaagagatcaaaaccatcctggccaacatggtgaaaccccgtctctactaaaaatacaaaaattagctgggcgtggtggtgtgcacctgtagtcccagctacttgggaggctgagataggagaatcgcttgaacccaggaggcggaggttgcagtgagctgagatcatgccattgtactccagcctgggcgacagagccagactccatctcaaaaaaaaaatcaactcaaaatggatttaaagacttaaatgtaagacctgaaactgtaaaactactagaagcaaacacaagagaaagcttcatgacttggtctgggcaatgattttttgattatgaccccaaaagcacaggcaacaaaaagcaaaaatagtcaaaggggattacatcaaactcaaaagcttccgcacagcaagggaaacaacagaatgaagagacaacgtatagaatgggagaaaatatttgtaaactatatgtatgattagaggttaataggaaaagttatgaggaactcaacagcaaggaaacaatcccattttaaaatgggcaaaagatctgaatagacatttctcaaaagaagacctataaatggccaacaagtatatgaaaaaatgttcagtatcactaatcctctggaaaatgcaaattaaaaccacaatgagatattacctcacaccgtgttagaatggtttttatcagaaagatgaaagatttgtgggataccatactggtgaagaaaaaaatgtaaaattaaaagaaaaaaaataacaagtgttggcaaggatgtggagaaaagggaaccctcatgcactgttggtggaaatgtaaatttgtatactactttttttttttttttttttgagacacagtctcgctctgttgccaggctggagtgcagtgacgcaatctcggctcactgcaacctccgcctcccaggttcaagcgattctcctgcctcagcttcccgagtagctgggacgacgggcgcgtgccaccacgcccagctaatttttgtatttttagtagagatggggtttcactgtgttggccaagatggtcttgatctcttgacctcgtgatcgcctgcctcggccccccaccaagttttgggattacaggcgtgagccaccgcgcctggcctgtacactactgttctatggaaaacagtatggagattcctcaaaaaattgaaaataggattatcatacaattcagcaattccactactgggtatatatccaaaggaaatgaaatcagtatgttgaggtatctgtacgctcatgttcattgcagcattattcacaagagccaagatacagaatcagtgttaagtgtccatcagtagatgaatggataaagaaaatttggtatatatacacaacgaaatactattcagccttgaaaaagaagggaatcttgtcatttgggacaacatggatgaacttagaggatattacattaagtgaagtcagccaggcacagaaagacaaatgctgcatgctcttattttgttgttacagacagggttttttgctgctgtgttgcccaggctggagtacggtggctattcccaggtgcaatcatagcacactatagcctcgaagtccctcctggtatcaagcgatcctcctgcctcagccttctgagttggtgggactacaggcaggtgccaccatggctggccacatgcttttacttatatatggaatctaaaatgtcaaactcaatcttacaattctcatatacctatattaacaccaccaaggctgtggctaccattagcaacaggagcattaaatatctgttgggtaaactgtagaccaaggcttttagtattacagaatataattctaataaaaattccaggctggggcagggcatggtggttcatgcctgtaatcccagcactttgggaggtcgaggcgggtggatcacctgaggtcaggagtttgagaccagcctggccaacatggtgatacccctatctctactaaaagtacaaaaaaattagccgggcgtggtggcccatacctgtaatcccacatactcaggaggctgaggcaggagaatcacttgaaccccaggggtggaggttgcagtgagccgagatcacgccactgcgctccagcctgggcaacagaaagagactgcatctcaaaaaatagaaaaaattccaggctgggcgcaggtggttcaagcctgtaacacagcattttgctaggtggaggcaggcggattgcttgagcctaggagtttgagaccagcctgggcaacatggtgaaatcccatctctacaaaaaatacgaaaactagctgggtgtgttggtgtgcacctgtagtcccagctacttgggaggctgaggtgggaagatctcacctgagcccagggaggttgaggctgtagtgagccgtgattgtgccactgcattccagcctgggcgacaagagtgagaccctgtctaaaaacagtaaataaaaataggacaggctcagtggttcatgcctgtaatcccagcactttgggaggccgaggcaggcggatcatgaggtcaggagatggagaccatcctggctaacatggtgaaaccccgtctctactaaaaatacaaaaaattagccgggcgtggtggtgggcacctgtagtcccagctactcgggaggctgaggcaggataatggtgtgaacccggaaggcagaggttgcagtgagctgagatcaagccattgcactccagcctgggctacagagggagattctgtctcaaaaaataaataaataaaataataataataataataaagtaaaactcatagaagcagagaataaaatggtggttaccaggagctgggtgggagtggagattgggaaggtgttggtcaaaggatataaaatttctgttagacagaaggaataagcacaagaaatctgttgtacaacatagtgaccttagtaaaaatatattctttttttttttttttttttttttgagacagagtttcactctttttggccagggtggagtgcaatggcatgatcttggctcactgcaacctctgcctcccaggttcaagcgattctcctgcctcagcctcccaagtagctggaattacaggcatgcaccaccatgcccagctaattttttgtatttttagtagagacggagtttctccatgttggtcaggctgatctcaaactcccaacctcaggtgatctgcctgcctaagcctcccaaagtgctgggattagaggtgtgagccaccacgcccggccactaaaaatatattctgtacctgcaaattgctgagagtagattttaagtgttctcaccacaaagaaacgtaattattttaggtaatggatatgttcattagtttgatttagccattccacagtcttcacatacagtagcgctcccccttatccacagttttgctttctgtggttttagttacccaagatcagccatggtctgaagatatgaaaaagaaattccagcaacaaacaattcattagttttaaacagcatgccattctgagtagtgtgatgaaatctctcttgccgtcctgcgtatgtcatgaatcatctctttgctcggtgtctccacactgagtctgctacatgccctttagtagcagacttggttgtcaaattaactcaggctattgcagggctcgtgttcaagtaacccttattttacttaataatggccccaaagtgcaagagtagtgatgctggcaatttggatataccaaggataaattcctttttcttttttttttttttgagacagactcttgctctgttgcccagactggagttcagtggccccatcattgctcactgcaacctccacctcctgagctcaaacaatccttgcacctcagcctccagagtagctgggattacagatgtgcatcaccatgcctggctaatttttgtattttttgtagagatgaggttttgccatgttacctcgaactcctgggctcaagtgatccacccacctcagcctcccaaagtgctgggattacaggtgtgagccaccactcccagccaagaagctattaagtgtatcctttaagcaaaaagatgaaagttctagacttactaaggaaaaaaaaatcttatgccaagattgctaaaatctatagtaaaaatgattttttttttgttttttatgaaccctgcatattgtatttgaaagaatgaattttctatctgtgaaattgtgaagacgaaaaaagaaaattgtgctagttttgctgttgtactccacattgcagaagttacaatcacagtgcacagtaagttcctagtgaagatggaaaagacactaaatttgtgggtgggagacatgaacaaaaacgtactttgattgagtgcaattggattcagtactgtccattgtttcagttatccactgggggctttggaatgtatccctcaaggataagagaggactactgtatttctgaatgtcattttacacaccgtaactatatataatttttgtcagttaaacaaaatatggcacaatctcttttaagctattggtgataccaataagattgggaattttactaacaatcttttacatactttaccttcttaaataaaattaggtaagagataggacttctgggacaacatctttatatacttgggagaagggttcatccttccactatggcaacactaatttattggtaaatgcaaaccactatagtaggctcattctattaaatgaatgcactgcataataacacttctgtcaatgctggactgcacaaatgatggtggtcttgtaaggttaaaatggagctgaaaaattcctattgcctggtgatgtagccatcatgatgttatagcacaatgcattactcacgtttgtggtaatgctggtagtaaacaaacctgtgctggcagtcatataaaactatagcacatacaattatgtatagtatataatacttgataataaatgactatattactggtttatatatttactatactttttaattgttagtgtgtattccttctacacacacacacacacacatatttttattttatttttatttttgagatggggtctcactttgttgcccaggctggagtgcaatggcacaattagggctcactgcagccttgacctctcaggctcaggtgatcttcccacctcagcctcccaagtagctgggactacaggcacatgccaccatactggctaactttttttttttcttcttccctgtagagacaaggttttgccatgttgcccagactggtcttgaactcctgggctcaagcagtttgctcaccttggactcccaaagtgctgtgattacaggtgtgagccacctcacccagccttattttttaaaaaagttaactgtaaaacagcctctggcaggtccttcaggaagtattctagaagaaggcactgttatcataggagatgacagctccatgcctgttagtacccctgaagacctttcaagaagtcaagatgtagaagtggaagacagtgatattcttgatcctgtccctgtggaggcctaggctaatgtgttgttagtgtcttagtttttaacaaaaagttttagaaagtaaaaaaaaaaaaaaaagaaagagggacggagggaaggaaaggagggagggaggaaggaagagggaggagagagacagagcagagagagaaaggaaggaaaggaaaggaagaaagaaaaaaagaaaaaaaagaaaagaaatcctcctgacttatcatcctgaatagctgggacaacagatgtgtcctaccacaccaagctaatttttaaaaaattgtttttatggagatgggatcttgctatgttgcctgggctggtctcaagctcctggcctcaagtgatcttcttgctttgacctacagaagcactaggattacaggtgtgagccacctctcctggccatcttttcttttttttttttttggagatggagttttgctcttgttgcccaggctggagtgcagtggcacgatctcggctcaccacaacctctggctcccaggttcaagtgattctcctggctcagcctcccgagtagctgggattacaggcatgtgccaccacgcctggctaattttgtatttttagtggagatggggtttctccatgttggtcaggctggtctcaaactgccgacctcaggtgttccacctgcctcagcctcccaaattgctgggattactggggtgagccaccatgcctggacctggccatcctttttttctttttttttttttttctgagatgaagtcttgttcttgttgaccaggctggagtacagtggcacggtctcagctcactgcaatctctgccttccgggttcaagcgattctcctgcctcagtctcctgagtagctgggattacaggcgcccaccaccaccctggctaatttttgtacttttagtagagatggggtttcgccatgttggccaggctggtctcaaactccagacctcaggtgatctgcctgccttggcctcctaaagtgctgggatacagccatgagccaccaggcccggctggccatcttttaaaagtatgttttgtctttgaggtttcctcaaaatgtgatacataacgatgccagaaatatatacggcttcatttttgtgggtgttgattttgtcatgatcagtgatgatgatgaattgcccttcctgtgctctgtaagcatgttttctgaaattaatgtcctttataactcactagtgttattttctgggataatttggattagcacgcaatgcttttgcttatcaataagccacacctctgttttaaagagctgattcatgcttcttagtggtaacagaagtactatgtttaacaaagaggaggaggtcagtttttcttcaaagaagaaagtttcatttttatgtctttactcctcagtaatatgttacatattgaatatttgtgcttaaaaacaaacttttcttaagcataactttttttttttttttttttgagtcagagtctcactctgtcgcccaggctggagtgcaatggcaccatcttggctcactgcaagctccaccttccaggttcatgctattctgcctcaacctcccgagtagctgggactacaggcacctgccagctactgttacaattacacgcctggctaattttttttttttttttttttttttagtagagacggggtttcaccgtgttagccaggatggtctcgatctcctgacctcgtgatccgcccgcctcgtcggcctcccaaagtgctgggattacaggcgtgagccaccacgcccggccaacttttttttttttgaacaggcttttccatttgtaaaactcagtccttactaagaacatgattgtaagtctctatataatgtttcattttctttgtgataggcaaaaacaaattaagttctttattaactgcttttatttgtagctactaaatttctctgctaagtgtaacaaaaatagtttagaaatagcaaagaaagttattttagggaaatgtagaggttttctacacttccagatttccagggaaaagggtaaattggtgacagataataaagatgcatgtagccaggcacggtggctcatgcctgtaatccgagcactttgggaggtcgaggcaggcggatcatttgaggtcaggagttcaagaccagcctggccaacatggtgaaatctcgtctctacaaaaatacaaaaattagctgggcgtggtggtatgcacctttaatcccagctactcgggaggctgagtcggaagaatcacttgaacctgggaggcggaggttgcagtgagctgagatcgcaccattgcactccagcctgagtgacaaagcgaaactctgtctcaaaaaaaaaagaagataataaagatgcgtgtagattacagtatttactccttatattaatgtagtagcatctgaaggtcactctagaagaatagataccttattactttcttaattttctctagtgatgtgctttttttttttttgagacggtgttttgttcttgtctcccaggctggagtgcaatggcgcaatctcggctcactgcaacctctgcctcctgggttcaagcgattctcctgcctcagcctcctgagtagctgagattacaggcttacaccaccacgcccggctaatttctttctttctttctttctttttttttttttttttttgtatttttagtagagacggggtttcaccgtgttggccaggctggtctcaaattcctgacatcgggtgatctacccgcctcggcctcctaaagtgctgggattgcaggtgtgagccaccgtgcctggccgtgatatgcttttaaatcaagtccaagaaaatgtggaaataacactttagttgttcagtctgccaatgtaaatttaggtttcattatcttgatggtgtttttagacattgtgtattttgatcaggctttgaatcatgatagaattaaaaactgctttttttgttttagaactgaaatggaggagtgaggtgagctttaagactgccaactatatgccaggcacagcccatttcttcctgttttattttataataaatgctatttcatgagattctcattaaagatgagtattattaatcccacttgaatccccaaagacaagaaggttaaattattctgcaatattatcttttgtaaccaaaatcattaaccagtttgtatatgattgatatttgaaactaacttgtgctaatttgtccaatgaaagataatgcaagttctcttaaccagtaaacttttgttcttttgatttttgcctggcttgttaagctttctcaggagggagaaggttattttgaataacacgggtctagcgttacagcaattacccagaaaggaatagaaaaggcagaaaataatttcattcttgacggtttccatctgagtagattaatttatatttgtatgtacaatctgaggctatcttggacattcaaaatgaaacaaggaatgaagctattattagggtaattgagaaaaaaataatttttgcttttttttttttttttgagtctttctctgtcgccaggctggcgtgcagtggcgcagtctcggctcactgcaacctccacctcctgggttcaagcgattcctctgcctcagcctcccgagtagctgggactacaggtgcgtgccaccatgccctgctaattttttgttgttgttgttgtttttgtatttttagtagaaacgggttttcaccatttgggccaggatggtcttgatctcctgacctcatgatccgcccgcctcggcctcccaaagtgctgggattacaggcatgagccaccgccgctggcctaatttttgcttttaatatcaagtttctagcctgcagtacatgcttctgtgtttctttcactgaactgacctagccacagttaccaagttgaggaattgatacattcgaagagttctgttaaaggtgggaagaggataatatattttagaattctcatatacctatgttaacaccaccaaggctgtggctgccattagcaacagcagcattaaatatctgttgggtggctggccggggtggctcacgcctgtaatcctggaactttgggaggccaaggtgggcagatcatgaggtcaggagtttgagaccagcctggccagcatggtgaaaccccgtctctactaaaaatacaaaaaattagccaggcatagtggcatgtgtctgtagtcccagctactcaggaggctgaggcaggagaatcacttgaaccccacaggcggagggttgcagtgagccgagatcatgccaccgcactccagcctgggcaacagagtagacagaccctgtctcaaaaaataaaataggccgagcacggtggctcatgcctgtaatcccagcactttgggaggctaaggcaggcggatcgcttgaggtcaagagttcgagaccagcctggtgaacatggtgaaaccctgtctctaccaaaaacacaaaaattagccgggcgtgggggcacatgcctataatcccagctacttgggaggctgaggcaggagaattgcttgaacctgggagctggaggttgcagtgagccaagatcgcgctactgcactccagcctgggtgacagagcaagactctgtctcaaaaaagaaaaaaaaatttaattaattaaatactgatattcaaaaagaagcacttttgaggcaatagttttatcagatctcaaatatgtatgttttgtatccatcctactggttctgtttctgagaagaaccctaatacagaaggtattccggaagacacgttagccaagcttgagatttaaaggaattagctgtgtaaagaggtaggaaaggctgggtgcggtggctcacatctgtaatctctgcactttgggaggccgaggcgggtggatcaccagaggtcaggagttcaagaccagcctggccaacatggtggaaccccatctctactaaaaatacaaaaattagctgggtgtggtggcacatgccggtaatctcagctactggggaggctgaggcaggagaatcgcttgaatccaggaggcgggggttatagtaagccaaggtcatgccactgcactccagcctgggcgacagagcaagactctgtctcaaaaaatatatatatgatgaataattttgtgttgatgaaatttctgctgtgtataaatattttttgagtttagtatgtctctactgttaagtgatatggcatgatttatttcttttaccacttttcggtattcacattgccaggaaacttgttcctttgaagttatttggttttctcatggctcacatacgtcatggatacttacctaattccatttctattaatttcttgttggtctcggactatgtagtactgtttggtgctagtgttcatttatttattcagtaagtattttcttagtacctagtgtatgcaccttctaaatgcagggatatagtagtgaacagaacagataaagtatctaatgatactttctagattgggagagacacaataagaacttaggtaagcatatctatagataaattacagatagtataccatcagatagtgatacattaaaataaaaataaaacagggtaaatggatagaatgttttgaaaagggggtgccaaggaaaggcctctctgagggagtcacacttgagtgacctgaaataatggagcaaatcacgcagtttctgggaaaagagcattccaggctgactgaataacaactgcaaaccctagggtaagaatgtgcttgttatgttacagaaacaatagtaagctcagtatgggtaaaacagagtgagcaagagaagtaggaaatgtggtcagtggagcagacagggaccaggacatgtaggatcttataggccgtggtaagaaatttgcagttgtcaagcacaatggctcatgcctgtaatcccagcactttgggaggccaaggtgggcagatcacttgaggtcaggagttcaagaccagcctggccaacatggtgaaaccccatctcttctaaaaatacaaaaattagccgggcgtcttggcgcacgcctgtaatcccagctacttgggaggttgaggcaggagaatcgcttgaacctgggagtcggaggttgcagtgagccaagatcgtgccactgcactccagcctgggtgacagagcaagactccatctcaattaaaaaaaaaaaaaaaaagagaaatctggagttaatttcagatgtaataatgtagccggcttaagtctggctgcttgccactcagaggccaaaaaaaagagaagccaggtgcggtttaaggaaagcagttttattaatcaaatgctaggagctggggaatggccaggctcatgccttcaaaagaccattccagttttttgggctgagtgaaggattttttttgagatggagtctcactctgtcacccaggctggagtgcagtggcgcaatctcagcttagtgcaacctctgcctcccagattgaagcgattctcctgcctcaacctccagagtagccaggactacaggcgcgcgccaccacgccctgctaatttttgtagttttagtagagacggggtttccctatgttggccaggctggtctcgaactcctgacctcaggtgatctgcctgcctcggcctcccacagtgctgggattacaggcatgagccaccacgcccggcctgagtgaagggttttaagaaggcaaagatatgggaaatatgtgatagtggtgcaggaggggataggccttcaaatcttgttcccatggctgtcttgagtaatcacctgtctggagttctggttttttcatcctgatttctgcctaatagtggtgagccaactgttcagaactccccttaggtgggaggattctgcaactggctctctctgcctgatttgtttcaaaattggcccctggaatttgtaagcaagcacataattagataagtgagcattgttcatggaagtacctggtaggaaagggaaacaaagagtttcaaagtatgtttcaaggctgaaagcaagaaaggaaaaaaaagttttaaaacgcattttgaggctgagatacttggctacaacagggatatatgacctgctttacttttttttttttttttttttgggggggatggagtctcgctctgtcacccaggctggagtgcagtggcacgatcttggctcactgcaacctccacctcccgagttcaagccattttcctgcctcagcctcccacgtagctgggattacaggcgcccgccaccatgcccggctaatttttatatttttagtagagacgaggtttcaccatgttggccaggctggttttgaactcctgacctcaggcgatctgcccgccttggcctcccaaaatgctaggagtacaggcatgagccaccatgcccttttttttgttgttgttaatagaggcagggtctggctctgttgcccatgctggagtgccgtggtgcagtcatagctcactgtaacctcaaatttctgggctcaagctgtcttcctgcctcagagtagctaggactacaggcacgcaccaccacgctcatctaatttttaaatttttttagagacagggattttactatgttgcccaagctggccttgaattcctggcctcaagtgatcctaccacttcagtatctgaaagtactgcgattatagccatcagccactgcatccagctctgctttactttttgaaaggatcacccaggccagtctgaggataacagaatataagagtctgagaagaagggaggttaattaggggttgattgtactagtctagcaagagatggtgatagcttagactagagtgagaagtggttaaattatggatatcttttggaggtggaggcaataagacttggtaatgatttaattgtagctgtgagagaaagagaagagtcaaggatgacaccttgttgaacaactagaaaacttaagctgccattttactgaaatgatacaaaatagcagctaacacagatgccagctctttttctaagtgctttacatctgttgccctactcatgaatagggaatacctgggggggaaaaaattgggagtgggaaatcaagagtttgttctttaaaacatagtaagtttatgaaacttcctagatttccaaatagagtattgagtatgctgtagatatatcagtctgttgaagttcaggggagatgttcagcctggaaataagaatttgtttgtatcatcagtgtatatagggggtattaaaaatggtagaactaggctaggcatgttggcctatgtctgtaatcccaacactttgggaggccaagatgggaggatcacttgaggtaaggagtttgagaccagcctagataacatagtgagaccccgtctctacaaaaatttttaaaaatttaggccgggcacctaatttggtgcttactaggtgctgtggctcaccatataggtttgagcatcatctgtttatgggtggttacagaggccataggaatatttctgtcttgcacaggtgtccagttagtggaaacacaaagtaggcttctcctctgcaaaaactacacaggatttttctagcaagacatgcttctgtttgtgattctgtaagaacaggggtattttgttaatggaaactttccatcacaaaccaggatcatcccctaggattgatattataacaacatcaatcaaaagaagtaaatgatttctgtggctttggaagagttcagtataatctaatagagaaattaaaggtctataagagtcccttggaacatgtgaaaggaccatgtggtattgaaaattgcgatctgtgatttcgatagcttaatattagaattggaaggtatcagatggctggcaaactgtcagtaaagtcctattcttaaaggagtactgtcctaggttgggttatctttgaggcagactctgatagtatagcctgaagaatgcttattaggaagtgcccttgggatcaacacccgtagaagggaggggacaggagcagcagtatttggccatagggagaagtcaagtggcaatagagatccaacaggagccttagtggaccccacgggggctctggagctaaaatgaccttttagagttgtcttatatgtgctgtaacggctgggcttacaccctggtcttgattggatgtggacccctgagaaggttgtgaccttccttgagtcaactcttcatatctgaggcactccctgaaaggattgacagttgtaggctgtctcccaacagcagtcctgtcattccttaatggaggatccagccagtgcaacagcatgctaccacagtatacccttgtgttgctcagatctactacttaaaaaacaaaaaaacagtatttttgagatataattcattattgtaaaatttataattacagtttatagtatacaactcaatggcttttaatatatttgcaagttgtgtaaccatcactctaaccaattttagaacattttaattaccccccaaaaaactctgttccccttagctgtcactctgtaatctcctccccacccacccccaacataggccaccgcaaactttctgtctctatagacttacctattatggacatttcatgtaagtggaataatacgctgcatggtcctttgtgattagcctttcatttagtgtgttttaaacgtttatccatgttacaacacgtatcaatacttaatttctttttatgctgaatgtcccgttgtattaattttgtttatccagtgatcagtggaaagacactgggtggttttcactttttagctattatgaataatgctgctatgaacatttgtatacaagtttttcgtttgtttgttttgggggacgtttgtttttgtagttagctgggactataggcacgtgccaccatgctcaagtaatttttgtattttttgtagagacggggtttcaccatgttggctaggcttgtctcaaacttctgacctcaagtgatctgcctgccttgtcctcccaaagtgctgggattacaggcatgagccactgcacctggcctgtgtacaagattttgtatgaacatccttttttttttttttttttttttttgagacggagttttgctctgtaacccagactggagtgcagtggcgcgatctcagctcactgcaacctccgcctcctgggttcaagcgattctcctgcctcagcctcctgagtacctgggactacaggcacctgccaccacgcccagctaatttttgtatttttagtagagacagggtttcaccatattgaccaggctggtctcgaactcctgacctcaggtgatctgcccgcctcagcctcccaaagtgctgggattacaggcgtgagccaccgcacctggccttgacatatgtttttatttctcttggatatatacctaggagtgggtcatatggtaaactctatgtttaactgtttggggaactgttactcttccaaatcggctacatcattttacattctcaccagcagtttattgaggccccagtttctctgcatctttcctaatacttgttatgtatttatttaacttttattttacgttcaggttacacgtacacttgcaggtttgttatataggtaaactgtgtgttacgggggtttggtgtacagataatttagtcaccccggtaataaccataacacctgataggtattttttctgatcctctcatccttcaccctcaagcaggccccagtgtctgttgttcccctcctagtatccatgtgttctcggtttagctcccaacacttgttattacctcttttatttattatagccatcataatgggtgtaaagtgttatctcattgtgacattgatttgcatttcctgtagggctaaaaatgagatgttgaagatcttttcatgtgcctattgactgtatatcttctcttaggaaatgtttatatacatcctttgcccatttttaaattgggttgtctttttgttattgagttattgttctttatgtattctagatataggttccttatcagatagatgatttgcaaaaattttctcccattctgtgggttgccttatcacttttttgatggtgtcctttgaagcacaaaactttaaatttttttctttttcttttttgagaccgaatcttactctgttgcccaggctagagttcagtggcatgttctcagctcactgcaacctccgactcccaggttcaagcaattctcatgcctcagcctcctgagtagctgggactacaggtacaggccaccatgcccagctaattttggtatttttggtagagacagggtttcaccatgttgtccaggctggtctcaaactcctgacctcaggtgatccacccatctcgacctcccaaagtgctgggattacaggtgtgaaccaccacgcctggccccaagtatgtgtatttcaatttcacattcagtgaccagggaatgaccaccagttaggagttcgagaccagcctggccaacatggtgaaactctgtctctactaaaaatacaaaaattagctgggcatggtggcaggtgcctgtaatcccagctactcaggaggctgaggcaggagaatcacttgaacccaggaggcagaggttgcagtgtgctgagattgcaccattgcactccagcctggacaacagagcgaaactccatcttaaaaaaaaaaggaataggaaaagaaaaaaataatctcactagcacagaacccagatttctatctatcttagtaaacaatcaaaagcatatttcactttatgcctcaattgactgctggccaaccataacttctatagcagctctcactttgatactctctagtaaatttaagttatatttaaggttaatttgagtttaatttaattgtttaataataaatttgactgataagattgtattaaaatttaggttatgtttacttaagtgaagcaaggaggtcactcagaatgaaaactttacatttccagtacaaacctatggagttgtcatgtattattctagtttatcatatggtcatgttctttagaatttgtcaccaggctactataataaaactcaatttaccaaattcttcaagatttaacttggtaatgaagctacaaaatttatgaataagtacagactgccctttttgaacagactgttcaaactaaggatggatctaattgatgaactaggtaaaaactactcttgagggggaaaaaaaaagccaaggtcctaaagaaatcatctaaggttgttaaaagcagaaaaattctgatcttacaaggtaataaacagcagtcttctcaaaagctcttaatctgagccagatgattgctagtacgagtagcccatgagccactgcgcccggccctacaactgcatcttactcccaagtttctccagtcattcctgtcagtaggttgtgacttataaaaagcaggctctgaattggagtttagtatttagactgttagggaatgaccttaggataaaaaccacaggaggagtaggaagctgggtagggcagatttgacacttgccttgattgggggtgcaggaggttgtatattatacttagtcaactttcttttgaaacgttttttgttttattttcatacttgagtggataaacttacagcttactgaaccatcctcctgtgtctaaaataacttccattttccttaggcaaaaccaattcccttcttcaaagatgttcctcatgccctttctcaggtgttgtatttttcttacaaaaaaacttgcctttttccctatactctagtaaattcaaaatgaggattggaaagggagcttatttgaggaaactgacaataatatattttaagacaaaaattagccttaaatgttttatgataatctagtattgtacatctgtatctcaattcccctaaaataactcccagcctggcacagtctcaggctgttgtaatcctcaagaggctgacatgggaggctcacttgagcccaagaattaaaatctagtctgggcaacataaggagatcctgtctcaaaaaaaaaaaaaaaactatcatttaataagttgtacatttctataatgttccacttttaaactatagtcaatgttactgaattaggattatttttttaaaagcataaaaggtgatggactatatgtattaagtgtatcatttacctttttctctttttagaaacagtatctcacctccctaaactggttaatagtggcatggaagatccatttggtgagtatcacctacattgttcttagtaaatgacatttctgttttatcctcacctccattaaagctttgagagtaaattggttttttttcatattcagtatgctactctctagaataatgggtctcaaactttttgcttctataagaattcagttatatatttaatgatagagtgccaattaccttttgtttatgtgacatatctattgatgtttgctgtattacaaattaaacctgagaaactttaaaaatattaatttgtttaaaaacaacattgataaacccattatatattacacaaataacatttttaattaaaaaaatcaagaaccatttgacaagataaaatgagaaatttaaatttctctatcttagccaggagtggtggctcacgcctataatcctagcactttgggaagctgaggcaggcagatcacttgaggctaggagttcgagaccagcctggccaacatgacaaaaccccgtctctactaaaaatacaaaaatttagctgggcatggtggcacacacctgtaatcccagctactctggaggctgaagcatgagaaacgcttgaacccaggaagcagaggttgcagtgagctgagatcgcgccactgcgctccatcctgggcaacagagcaagactctgtctcaaaaaaagaaaaataagtaaataaactctgtcttaatcactcagtaacttatgtatacttctctttggttggaaatgtagttctgctcatatttcagaaacaatgtgtgctttgtagtgcttcattagtacttggccaatggaagataacatgaaagtgactgggcgcagtggctcatgcctgtaatcccagcactttgggaggctgagatgggcagatcacttgaggtcaggagtttgagaccagcctggctgacatggtgaaaccccatctactaaaaatacaaaaattagctgggcatggtagtgggtgcctgtaatctcagctactcaggaggttgaggcaggagaaacacttgaggcctggaaggcggaggttgcagtaagccgggatcatgccactgcactccagcctcggcaacacagggagactctgtcttaaaagaaaagaaaagagaaagataacgtggaagtaatcataatagcaggcatgtgtaatatatatgtacgtgtgtgtgtctatatatgtgtgtgtgtgtatatatatatatatttttttttaatttattttttttgagatagtgtctcactctgtcgcccaggctggagtgcagtggcaccatcacagctcactgcagccttgacctcccgggctcaggcaatcctttcaactcagcctcctgagtagctgggactataggtgtgcacccctatgcccgactgatttttttttttttttttggtagagatagggctttgccttgttgagcaggcggctctggaattcataggctcaagggatccacctgccttggcctcccagagtgttagaattacaggcgtgagccactgcacccagcctaatatttctaattaagtttagcctgtgtatatttcatctagcaacatgagtaaaggaatgtaagtctagatatacaaaggtttaatgtctgcctttttggcgataaagtcatttactgtgtgtggaaccccttttctttctttcttttttttttttttttccaagactggatatcactgtgttgcccaggctggagttcagtggctattcacagaagcaatcatagcatgctacatccttgaactcctgggctcaagcagtcttcctgctttagcctcccactgtgtttggatggtaaggggtgaagaagactgagtaaagaggctgttgcattcagcattaattatgcatatttcccacgtagctaggactacaggcatactccaccactcctggccctatttttaactgatgctcatttcaaagtgagagatatgtcttaggatatcagattttttgaaaccataacattgactaggaagactagttaggaagtacttttcattttaaaatacacattagcaaaaaagaaaaaaaagaaatcagaggcagttttacttgtttaatttcagcgtactggaggaagcatccgattcaagcattttctgatccttcatcacacggaaagaagtctgaatccctttttatgccagtgcagcttgaggaagtatagtaaaaatactactatataatactaactgaggttaggctttttgggctactagtactagcaatcatctggctcagattaagagcttttgtcttgctttgagaagactgccctttattactttgtaatatcagaatttttctgcttttaacgaccttagataatttctttaggaccttggctttctttcccccctgaagagtagtttttaggattatgcctagttcatcaattagatccatcatcaattagatccatccttagtttgaacacaagagggcagtctgtacttcttcataaattttttttttttttttttttttttttttttttttgagacagagtctcgctgtgtccccaggctggagtgcagtggggtgatctgggctcgctgcaatctccgcctcccgagttcaagccattctcctgcctcagcttcccgagtagctgggactacaggcacgtgccaccacacccagctcattttttgtatttttagtagagacagggtttcaccatcttggccaggatgatctcgagctcctgacctcatgatctgcccaccttggcctcccaaagtgctgggattacaggcgtgagccaccgtgcccagccacttattcctaaagtttgtagcttcattaccaggttaaatcttgaagaatttggtaaactgagttttattatagtagtctggtgacaaattctaaagaacatgaccatatgataaactagaataatacatgacaactccgtaggtttgtactggaaacctaagttttcattctgagtgacctccttgcttcacttaagtaaacataacctaaattttaatataatcttatcaatcaaatttattattaaacaattaaattaaactgaaattaaccttaaatataacttaaattttctagggagtatcaacgtgagagttgctatagaagttatagttgaccagtagtcaattgaggcataaagtgaaatgtgcttttgattgtttactaagataggtagaaatttgggttctgtgctagtgagattatttttttctttttcttttcttttttttatttgagacggagttttgctcttgtcgccaaggctggagtgcaatggcacagtctcacttcactgcaacctccacctcccgggttcaagtgattctcctgcctcagcctcctgagtagctgggattaccagcacctgccaccatgcccagctaatttttgtatttttagtagagatgaggtttcaccatgttggccaggctggtcttgaactcctgacctcaggtgatccacccgccgtggcctcccaaagtggcgggaattgcaggcgtgagccaccatgcccggctgagattattttttatttttatttttttggtttgtttttgttttttgggggtttttttgaggtggagtcttgctctgtcacccaggctggagtacaatggtgtgatctcggctcactgcaacctccgcctcctgggttcaagcaattctcctgcctcagcctcccaagtagctgggactacaggcacctgccaccacacccaactaatttttgtatttttaatagagacgggatttcgccatattggccaggctggtcttgaactcctgacctcagatgatccacctgcctcggcctccgaaagtgtttggattacaggtgtgagcccggcctgagattatttttttctaaacacttatttaaatcttggaatttgtaaattaacattcattcaatcataatatggagtttataggaaaacagaaatgactcatatttaactaccattctcctctgtctccatttttccttctaaatgttataatgatttttttcttagttgtttactatacatatacacacatatacatatgataagaatttggtgtactcagtgtcatttgacaaagaaaagaattgaggatgtaaaatgagtttgtttcttttggtggagtgagaattttgttataatcaagttagctaataattaagtagaaatattgaaaaagagataaaagactacacattgggtacagtgtacacggcttggatgatggttgcaccagaatcttagaaatcaccactaaagaacgtattcatgtaaccaaatactacccattccccaaaacctattgaagtaaaaaatgacataaaaaaggaaaaaaagaaaacagaaaccacccaaaagaaagaaagaaagaacgaatgaacaaaagaaagaaagaacgaatgaacaaaagaaagaaagaaagagaaagaaagaaagaattatttgtggtattctggaaataaaagtagtgagggatttttacgaataaagtaccagaaggatagacctaaggtctctaggaccttttctacctggacagatgcttacacatttcattatataatatttaaatatcatgttcgttaatatcactattggtctcgttgaaaaaaatgttaaatgttgggaagctgtcaagctcattctggatgtaaattttccaaaataggaatttcacttgaaagcttgaattctatcactagcaacaaatactgttaattttctttattagtgacaggcttacttttgagaaaatgcctgtcagctatctaagcttgaataacatagcttgttgttcagtctttcaagtaaaaatagtattccatgaagaaaactgtctagttcagtttgcaactcagtcacacaaatgcctttcctggagataaccatcatacttagtatacaaatgtgctttatacatatttctgtttcatcataaacagtaataaaaatatatgtactaaagggttgatatttattaaaactaatattttttattgctttatcaaggacattcttaaagttgaatttatttttcactgtaactgtgtagttgtgaagaatacaatgatttctgctacagtttggtgctgttgccttgatttgtgttaaggtgctaacagttttgctcaccattgcttttgtaccatcagtgcaagtgtcaacacagtggaaaaggcaaataatttttttgtattcttatgtatttagttttacctcttggacttctgaaaggatctcagggatccccagagatcagcagattatacttgcttcattttcctgaggttcctagaggcccttctatggaagtcatgagtaaagttaagatttaatcctggagattgtattgggcagggtttcagtgtggactaggtcttggacatttgacagaaatatggtcagagggagtgattagctctgtggtttctcctaagcaggagtaccctgcaccactacccccgggccacaggaggtgagcagtgggccagtgagcattacagtctgagctccacctcctgtcagatcagtgattaggtggaacagtttcatcccaaaccaccccaacacccccgtctgtagaaaaattgtcttccatgaacctggtccctggtgccaaaaaggttggggaccgctgggttaaagaaacttttgtggagcgaaatgagtctggaactcattaggcaatcaagtatgttcaaagaagaaatccataagcatttagtcaagacaggctgagggccaggctcacctgggtactgtgttcttagctttaaaaaggataaatagcagcagagatattggtgatgacagctttcaatatatctcttgagtcacattgctccagtctgtgtacaggtggccttgcagtctgtagaggtggtacgcaactgtcatcctgggttatccagtctccattttcctgacagctttgcttctttcctgtgttagctcctttgtttcctaaaccctcatgtcttcctctgtcttggttgccagtagctttttgatgttgaacctcctggaataattatctaattcatttctttttcctttagatatgtttcctgcaagatttattcaactttatcttctacttttattaaatttttcttttctactattagagtttaatctccaggaggtctttttgaagtctctgcatgtttctttttatactatcctttcattctttcaacagattttccttgccctgcatagtctctttttttcctaacattgtttttaaatattgatttggtttcttttatgttagagtttttctctgatgtctagtaataattaactgtctgctgatggttaaaagtgagggactaaatagccagttagaagctttaaatgtataggcaggttgcctttgggtgagcttcttggccttattgttgatgaacattctcatatcagtatcagggtctaaggggcacagtcttcccactgtgtttggatggtaaggggtgaagaaaactgactgaagagactgctgcattcagcattaattatgcatattttcacttaattctcttccatttttaattttacttgtatttgtattttattttactttatttttatcttttgagatggagtcttgctctgtcacccaggctagagtgcagtggcgccatctcagcttactgcaacctctgcctcctgggttcaaatgattctcctggcctcagcctcccgagtaactgggattacaagcacccatcactgcctggctaatttttgtagttttagggtttcaccatgttggctaggctggtctcgaactcctgacctcaggtgatccgcctgcctcggcctaccaaagtgctgagattacaggcatgagcctctgcagctggccttattttctttttcattttatttttttatttttattttttggggtcagtcttcctctgtctcaaaaaaaaaaaaaaaaaaaaaagcaccgcagcctcgacctcctgagctcaaacaattctcccacctctgcctcccaagtagctgggactataggcacataccaccatgcctgactaatttttttactttttgtaaagatgcagtctccctatgttgcccaggctggtcttgaactcctgggctcaagtgattctcccacctcggcctccccaaaagttgagattacaggcatgagccattgcacccaaccccttccattttttgtaccatatccctaccatcagttgccttttgcgacccctttccagagaccatttgctttacactttcttggaaaacagattccaaaattccgccagagttagtgtaggacagacattgaagatcatggagtagggaaagtgatagaggaatcaaacagcttttaccttgcttctcctgattttaggtcacctccctttcatctcatttcagagacctggataaaatacaatgaatgtattacttgttaacctatactggtgtatactaccagttaaaagaaaaaattaggctgggcgcggtggctcacccccgtaatcctagcactttgggaggccgaggtggacggtttgcctgagctcaggaattcgagaccagcctgggcaacaaggtgaaaccccgcctctactaaaatacaaaaaattacccaggcatgatggcgtgctactgtagtcccagctacttgggaggctgaggcaggagaattgcttgaacccgggaggcggaggttgcagtgagccaagatcacgccactccacgccagcctgggcaacagagcgagactctgtctcaaaaaaaaaaaaaagagagagaaaagaaagaaaaaaattcatggctacactgtacataagtgctgagtgaaggaaggatccagagaggatgtgcatagaatttgtgctaccatgatgctccacaccccactactttcaaaaatagctaattcgtgcttctgctttcttcctcccttttcaactgcttatggagttaacagtcattctcccaagagcataccagaacaaaagggactgaaaccctagcatatcacttatttaaaagtactgagttgtgacttccttctaaagatttttgaggtggaggaggatctgcatactaattgccttcccaaaatgttttaaatcatctgaatacttcattaagtttctatataccctctcttgtataaatatgaacatgacttgttgaaaatacttttttgggtgtgtttggtgattgtttaatgagatgtagattatcagtttgcattctgaatttaaagctagttgcaaaggctttattcatatgcatggcattctggaaacaaatttataagataatacctccttttgattagaatttgtatcatataggaaataggagaagtagtttgttaaggtagcaaatagaatttattatttcctaaacaaagtcaattatttttttcttattctgtatctgaatttatgaattattatgatgatgctataaaggagtttttttctagctgtttaagaacatttgccaaggagccaaactcaagacataatgcacttcaaagttcatgggaaaacatttttgatgttatgttgttatcacttgaagctcaaaatatgccagtaacatagtccttccctccctcctctttaagaatgaaagacaaaatacaagcttaattagttttgaggtcctcagggtgtaggagttaaattcctccagtattacatgatgccaaaattgatgctagttccattttttctcctagtggtcttgatgagaaatttaatatagcattattataaatatatattaaatatcctctgtcatcttatttcctgaaggggtataaaggtcaacatgtttttactgttacatcctacccactgcccagtagtaaacacacaatacatatctgtatgtgtttcttccagtggttttaatttttctgcataagatagaattaccaatcttaaggaaaacagagtacacaggcaccaaattctgtgaacctgaataacagatattatgtaattattttttctgtcagtagaaaaagatgagctgtagtagtagtagtagaagcctggaaaggcagtaatgctgacattctggactattgcctgtgtcctctcaccactttttatcacttctgactacgtcttactcctagaaaatcatagcaagtgggataggttgactaaatgcatggactggtttccatctgaatttattgctgcaaactgagcccttatcaatgtgtcatgcaccctggacagacgatgatatatgtcatacaaatgttttcttccagcctgtggcttgtctatttgctttcagaggcttttaaagtaatgcaatccaatttaatccattttctcttttatagttcataatttttgtgttttcttgaagaaatctttgcttaaccaaagattaggttttattttaagttgttgattctttttgagttaatttttagatatggtacaaagttggaaatattctcctttgtccactgaattaccttgacaccctgttgaattcctgatgaaactggtaattttctttcttgcttttttttttcttttttttgctgttccccccttccttccccctgaaatgggtaattttctaggaaaatataatttgccaaaggaactcaagaaataaaaatcctatgtagactagtgttaaaatgtgattaggccaggggttttgtggacaatttaattcatgttgatgaagcagatgattgcagtagtccctccttatttatgggggatataccaagaccaagaatgccagtggatccctgaaatcatggataatactgaaccccaatatgtactgtttttttcctgtatatacatacatacatatgtacctgtgataaagtttggattataaattaggcacagtaagaatttaataacaataactaataataaaatagaacaaataagtaaaacaaagattacttgaacacaagcactgcaataccgccacagttgatatggcaactgagatggctgctaagtgattaacaggcagtgaacacatacggtgtggatatgctggacaaggtgatggatgattcacccctgggcaggacagagcaggatggcatgagatttcatcatgatactcagagtggcacatgatttaaaacttacaagttatttatttctagaaattttccatattatatctttggactgcagtcaaccacaagtaactgaaactgcagaaagtgaaaccacagataagaggggacagctctataatgctatatcaatcagtatagcagagaaaaagaaagtatacctgtttattttataaagttggcaaaatcttgataactaaaagctgacagtctgggcatagtggctcatgcctctaatctcagtcctttgggaggcccatacgggaggattgcttgagcccaggagttcaagaacagcctaggcaacattgggagaccctacaaaaaaaaaaaaaaaaaagacacaagaatcttttaaaaagttagccaggtatggtggcacacatctatagtcccagctatttgggaggctcaggtgggaggattgcttgagtccaggaggtcaaggctgcagtgaaatgagattgtgccactgcactccagcctggaggacagagcacagccctatctctaaataaataaatgctgacaaagatagtagaaaaatacatttgtccggctgggtgtggtggctcatgcctatcccagcacattgggaagccaaggcaggcagatcacatgaggtcaggagtttgagaccacactgcccaacatggcgaaagcctgactctactaaaaatacaaaaaaaaaaaataataataataatagctgggcgtggtggcaggcaactgtaaccccagctacttgggaggctgaggcaggagaaacatctaaacctgggaggcagaggttgcagtgactcaagattgcgccactgcactctggactgggtgacagagcaagactccatctcaaaaacaaaaaacaaaacaaaacaaacaaacaaatacatttgttctattccacttaatacagctgtagaaagtctatataaattacatgtagattaaatccaacaaatcattattttttcttattacaaaaacaatatatatttctttgagaaaaatgagaaaatatggcataaaggagaaaattttaaggccaggtgcaatggctcacacctgtaatctcaggactttgggaggctgaggcagtggatcacctgaggtcaggagttcgagaccagcctggctaatatggtggaaacctgtctctactaaaaatacaaaatttagccgggcatgatggtgtgcgcctgtagtcccagctacttgggaggctgagacaggagaattgcttgaaccctggaggcagaggttgcaataagctgagattgtgccactgcacaccagcctgggtgacagagagagactccatctcaaaaaataaaaaaaggagaaaaatttaaatcatttgacctttctatccattggtaattactaataacattttgatatatctacttttatgatttttttctagggaagttttctatgtacagtagttacattttttaacatgccaatttatagctagctgttttctgcttgtttggtgcccgcccccatgcccagctaatttttttgtatttttagtagagacagggtttcaccatgtcggccaggctggtctcgaactcctgaaattaagtaatccacccgcctcggcctcccagagtgccaggattacaggcgtgagcgaccgtggctggcctgtttttgtccccatttgatatgtcaaatctataaatatattgaaagaatatgacccaagaggatttattgcaatatctaaggattatgtagatatattatcactttacacatatatatacacacacacatataaagtgtaaatatatatgtgtatatagtgtaaaaaacatatataaagtgatacatgtatgtgtgtgtgtatatatacacacacacactttttttgagatgaagtctacctctgcctcctgggttcaagcgattctcctgcctcagcctgccgagtagctgggactataggtgagcagccaccatgcctggctaatctataaatagttacaaattattaccttgataggtcaaaaactagaacgaaaatgatatgcttgcttatctttgtagatgggaaaattcaactcttctagttaaaagctttagttaccctaggaataggataatgtatttttattcttaaatacttaaataatatcaacatctgcatttctaccaaattgatttaaaaattgataacattaagacacattttataaagtaaaacttgttagataaagtctcctttgaccacctttgtctagtgacaacccatacataccacgaatgttgtgtatatccttctagttcatttttttctgttacaacattgcttacatactttgataggatcaagaccagttctctaggccagatgcagtggctcacacctgtaatcccagtgctttgggaggctgaggcaggcaaatcgtctgagcgcagcctgagcaacattgtgagaccccatctctacaaaaaatacaaaaatgaactgtgagtggtctcgcagtactgtggtcccagccactcaggaggctgggagaatcacttgtgcctgggagattgaggctgcagtgagccattgatatgggtaggctttgtcttcccacccaaatctcatcatgaattgtaaaccccataatgcctatcatccccacgtgtcaaggtagagaccaggtggaggtaattgaattatgggggcagtttaccccatgctgttctcatgatactgagttctcacaagatctgatggttttataaggcgctcttcccccttcactcagcccttctccttcctgccaccttgtaaagaagacaccttgcttctccttcacctcccaccattatggtaagtttcctgaggcctccccagccatgctgaactgtgagtcaattaaacccctttcctttataaactacccagtcttgggcacttccttatagcagtgtgagaacaaactaatacaagccatgattgtgccactgcactccagcctgggtgacaggatgagaccctgtctcaaaataaaagaggattgttatctatagaaaatctaaaggagttatttacaataacaacccaaattataaaatacctaggagtgatctcagcaacatagcccatatgataaaactagaagtgtgctgtagataaataaatagatccattatgtcaagtaatgggaaaaactggaaaagttattggtgtcatttattcctaaatttattatatatgtttaatacaacattaatagttgaagagaacttacattagcttttgatatttgacaaagtgatgatcaaatataacttagaaaaaaattaaagctaagaagttaacaaactcccctttttaatgggtttatgatgccagtttggtcacactaagttttgtaaggtcttgggtgtatttttggactttatgttcttttctgttgaacaatttgtcagtttttgtaccagttctacaatgtgtttattactacagtcaaaacaacgtcactggctgacttctgcatgtcctatcttattcaaaatgacctttcatgatcagagctttgagttgacccaaaggcagggtaatttttacaagattactgtttgaaacgtcaatgaaaccagagcacatgggcatgtgcacatatatacacacacatacacactcacatgttataattgaggcttccattgaatgaaagtaatggtagtataatggaccatcttgtagatggtgctgatggcctctaatcctcgttgaagattcgtgggtttttttgtttttttttttttgattcctcatcaaaccagtgttttatcttgcggtagccagagtaacatcatatcagattgtaatctatagctatagctttcctttttactattgcataaaaattaatattatatttgacctctttaagaatttttagatttcttatttaggtttcctttaatgctgctatattctgtttcttttcattgatttcttaaaataatttagatgctctaaaacgtaggcctggctgctttattttgtccatttccccgcacagggtgagtcagtcttttcctcacttcagtttagagctcagtaatcaaagggcacaaatagcaagaaggcttaagaattatgtcttaaatagtataagacaaaagtggcaccaaaggaaggacattcctgctaggatggggagcttggcttaatactaaaggtgtgtatttgtttagttctggttataatctcataatacatccgggatacatggcttaatgttggtttcagtgaaggccagttactatcctaaccccaccccaaaggtgaatgatggatggatgtatgattggctgactgaatgacttattaattcattcaataaatttttgttggctcactgccctaactgccatgcaggaaaaagatgagtaagttacattttcagctctcaaagaggagattgagaacttttaatgtgagacagagtgaagttattttatacaaataaaaatacttgtgttattggaatttcctgccatgttattcagcatgatttgtacttgtggaaattattaaaacttaattgtatagcatgtgtagtcagccctctgtttctgagggtttcacatccatggatttaaccaaccacagattgaaaatgcttggggaaaaaataataattatacaacaataaatgataatgcaatttttaaaaaatacagtataaaaactttacatcacatttacactgttaggtattataaataatctagagaagactaagtattatggaggatgtgtataggttatatgtaaacactttgccactttatataagggacttaaacatccatggattttggtgtccaaggagagtcctggaacaaatcccccttggatactgaaggatgactgtatttcccttcttttcctttactttttatttttaaggctagtcaaatgaagcagtgggaggggagaaggaacaaagaaatcttaagtggttgtgatcaattagttgtaaaccccactgcattctgaccagcccatatttcttttcctgtatctgtgttctttgaacagtttagtggcgatttctttagggcaagttttttgttttaccgtgtttgttttgtatctaaaaagagaatttggtgaccctggggaaataggtaaaaactagagacttctttttttgagacagagtctcactctgtcgccaggctggagtgcagtggtgccatctcagctcactgcaaccttcacctcccgggttcaagcaattctcctgcctcagcctcccaagtagctgggactaccggcgcatgccactgcgcccagctaatgtttttgtagttttagtagagacggggtttccccatgttgaccaggctggtctcaaactcctgacctcaggtaatccgcctgcctccatctcccaaattgctgggattacaggcatgagccaccacacccggcctaaaactagagacttcttaactaccttagagagtatagatagggctgggcatggcggctcatgcctgtaatcccagcactctgggaggcgggaggatcccttgagcccaggagttcaaggcctttctggggcaacatagcaagaccttgtcttgacaaaaaataaacagaattagccaggtgtggtggtgcatgcctatagtcccagctatttaagtggctgagatgggaggattgtttaagccagggaggtcgaggctgcagtgaagcatgatcatatcactacactccagcctgggcaacagagcaagatcctgcctcaaataaataaataaataaataaataaataaataaatgagtaaataaatatcttgcgctctcataaaacatacttgtacattgctaataataatgctccatgtagcataagtatggttaaaaggttatataaacctgtgcttcagtaattttgggtttctcatgaaagactatggctagagagtttttgttgtatatgtaggtttatggtgtagcaaagaatggagactcagatccagattacttagatgtgaatcctaactttgccagtttgccagtttttaacttagaccagtttactcctatgtgactcagtttcctcatatacaaaatgggaataataaatgctgtcttgctcatagacttgtaagaattagacaagttagtatatgtaaaatatttagaataatcgttgggattataacacacgttcaattcatgttagctattattattcaaacagaattgggagaaggaatacttgggaagttgaatttagtttattttctaagttttagctttcttcaaatcttttcacacataacagagtagataaatttgaacttaactttattttatttatgttctaatttttcagataccagtttttaccatttagggaaatgatcagaaaccaggaaacataaatcaaggagagaagaaatagagaacagaaatcagctttgagtgattaaaaactggtagtgctgcagttttgtccttctaagtgtttcttacaggaactagaaaagcagagctatttttaaaaattattaattaattatttttttatttttatttttgaggcagggtctcactctgttgcccagactggagtacaatggtgtgaacagggctcactgcagccttcacctcctgagttcaagtgaccctcctgcctcagcctcctgtgtagctggaaccacaggcatatgccaccactcccaaccttgttgcctaggctggtctccacctctggagctcaagcaatcttcccacttcagccttccaaagtgctaagattacaggtgtgagccaccatatccagctgaagagctattttcatttatttttatttttaaattttatttattattttttttagtcagagtctctctgccacccaggctggagtgcagtggcaccatctcagctcactgcaacctccgcctcctgggttcaagcgattctcctgcctcagcctcccaagtagcagggactacaggcacgtgccaccacacttggcttattttttctatttttagtagagatggggtttcactgtgttagccaggatggtctcgatatcctgaccttgtgatctgcccgcctcagcctcccaaagtgctgggattacaggtgtgagccaccgtggctggcctgtttttttgttgtgtttttttttgagatggagtcgtgttctgtcgcccagcttggaatgcagtggtgcaatctaggctcactgcaacctcttcctcccaggttcaaacaattctccctgcctcagcctcctgggaagctggggttacaggcatgcaccaccaccccggctaatttttgtatttttagtagagatggcattttcactgttggtcaggctggtctcgaactcctgaccttaggtgatccaccttccttggcctcccaaagtgctgggattataggcatgagctaccacgcccagccttattttttaaattttatttatttatttatgtatttctttattttgagacagagtctcactgtcacccaatctggagtgcattggcacgatcttcagctaactgcagcctccacctcccagggtcaagcagttctcctgccttagcctccccagtagctgggactacaggcatccaccaccacacccagctaagttttgtattttcagtagagacagggtttcaccatgttggccaggctggtctcaaactcctgacctcgtgatctgcctgccttggcctcccaaagtgctgggattacaggagtgagccaccaagcctgaccacaacaaagtgcttttgaattactggcttgaagaggtttgatataaacactatttatatagtcatcctagttcttctacaggaatttttattgagtcgtagtgtaactaggtgttcattactgagaatttttatttagtagagaatgaaggctatattctcctattcatgtactggaaaatgatattgtttaaggagatttcttgttaggaatttctgcataacttttacaaatgttatagctagctgtcatcagacacatactgtgttcccactggatatctagtgttggtaatattcaggtttctttctcactcacttaaagtgaatattgagggccagccgaattaggaagagttgtgaaagagagagaaggaagaataattggcagtggctaatagtcatctctttgagtcactagtcatagtcacatgtttcaaacctctgtgatgtgggctccttgatttctgactagtttctacacatcagtgatacctcttggttccttaatagatgtcaactgggccgggcacggtggctcacgcctgtaatcccagcactttgggaggcagagatgggcagatcacctgaggtcaggagttcgagaccagcctgaccaacatggtgaaaccccagtctctactaaaatacaaaaattagccaggcgtagtggcaggcgcctgtaatctcagctactcgggaggctgaggcgggagaatcgcttgaacccgggaggcggaggttgcggtgagctgagatcacaccactgcattccagtctgagcaacagagcgagaaaccttctcaaaaaaaaaaattgtgaatataaatagtccaatagtttgaaactaaataaaatgaaacttttatttagctgtgaagatttcttcagcgcatactaccaatagtagttggtactatgaaaaacagataacacatgctgatgaaacgtggaattgggaggccaggcatggtggctcacgcctgtaatcccagtactttgggaggctgaggcgggtggatcacgaggtcaggagatcaagaccatctggctaacacagtgaaaccccatctctactaaaaatacaaaaaaaacccaattagccaggcgtggtggtgggcgcctgtagtcccagctactctggaggctgaggcaggagaatggcgtgaacccgggaggcggagcttgcagtgagccgagattgcaccactgcactccaacctgggcgacagagcgagactccgtctcaaaaaaaaaaagaaacgtggaattggttctttgagatactctgttattactggaagactttttttttttttttaatagagacaagatctgcccccactggtctcaaactcctgggctcaagcaatcctcccaccttggcctcccaaagtgctgggattacagtaatgaacctggactgcacctggccgtggaagaattctgagtgggctttaaaaatccttttaagttcagcatgtccagtagaactttctgcaaagatggaaatgttctgtatctgccactctcccatgtgtagtcatatgtagctagctactgagcacctaaaatgtggctagtaaaagtgagagactgaattgtaaattgtatctcattttaataatacaaatgtaaataatcatgtgtggctagtggccacagtattggacagtacacatagacatttgagaactgagcagcaagtttgataaccaatacttctctaccaatgattaaaataatgtaattcttatttacttttagtatgcttggaaatgttgctttttgttttgctgccattagaaccaataacagtataatatttggccggacgcagtggctcacacctgtaatcccagcacttcgggaggcagcgggatgtggatcacttgaggtcaggagtttgagatcagcctggccaacatggtgaaaccccgtctctactaaaaatacaaaaattagccaggcatggtggtgcgcacctgtaatcccagctacttgggggcctgaggcaggagaatcacttgaactcgggaggcggacgttgcagtaagctgaaattgcaccactgcattccagcctgggcaacagagcgagaccctgtctcaaaataaaaaataaaaaataaaaaggctatagtattaggaagaagacagaggaagttaatttaggaatgtgttgtttactgcgggtcttcacttatacatcatcttcccactgaggcccttccgctcacccagtttataatttagcacccttcctttcagcccaccttattttcctttcctcccttttttactctgtggtacttgtcaccatctaatgtaatgggaagagggcagggattattttcccctgttgtattcactgctgtgtcccaacacctagaatgatacctgacacattagaggtactcagcaagtatttgtggagtgaataagtgagggttgtggtttctcaataattataatctaattcatttaacacttattttgcatatagcaagcattgagttagattaggtatatagagtacactatggtcactaccctttccatagtaaaacatttatttctttgtgagcttcaaatcactgacaagaaaaaaatttagaaaactaaaaacatttctttgaaccattatttaaaacagaatattgaatcggttaaatcattggttggaagggacttggcaatgatttgaatcagttgtctgatgtcacatggtggtttaaagttccatcagtgtcatttacatcctcttctcatttccccttttccttcatcccacaacatatgaaccttttgctcacttactttttctacatcttctcatctccattcagctagttctcactttcttctaggcctgcctttcccactgactttactggaccttaaggaactcctcaaatccctatccaatattaactgaaactttcctgttgattatgatttcttataactccttcctcagttccagaatcttctccctatcccctgggatatcctcaagagcttattggcctgaaaaccaaaacttgaagagaaagcaacaaggcagaatccctatatctccagtttctttgagtgtgatctttcattttgtggagctgaaagccatcctgctggcataatttcagtttctctcgctaataaaagtccaacatattgtaggttttaaacatatacattacttcatgcctaccattattgagagaagaagaaataatgtagcttctgtgacataaaagcatgacagaacctctccagtttttcctaaagaactgtggtggtttaatttaaactattggggaggtggggttcatttatatagagaatctaaatggaaggagaggagccaaaatatattaagcacctctaatcattaggtagtctttggaaatttttcttatttaatcctcataactctatgagcagttttcttcattttacagatgtgtaaactgaagtgcatgtaagtaaagtaactttccagagtaacctaatcagtaaatgggaaagctgagattttacatagttatatgactgtaaaccctgtgcttttttccattggtaagccatgctgccttctagaagtggaggcaagggagggaacaagagttacagcgtttgatgtagaataggaggcagtttgtttgtttttcacatccagtgagctagccacataaataaaccagtattatttgtggtaagtggcatgagtatctggtgattccagtggccctgccttaactttaaccttctgtcgctttcagcctgttcttcaggctagttcacatgaagtacaaacacttcctactaaggatcttgagcctcacagttgtgattaaatgagggagtatgtgaagcttcatatgacaaatctatcccctttcttactacttgcaaagcagtatgttctcaaaaaccacatgaacataccattttttccccacaaaagcaagagtttcacagcagctcccaggattgtgtggaatgatagagtagtctatggtctcgacgttttttctggcctccgtgagaaaagttccactgttggaggtcggaagaaatgtagagatgatgggctattctatccatggtagaatagtggatgaatagcctaccttggatgaatatagtggatgaatattctgccagggtaaaatagtctatggtagaatagaatctctgagaaaagtttaaaattaaagaatgctgtttctttccttatactcaagattaataatactcggtgcgtgtatactgtacatcaaatgtgacaagcattgagagtttaaggataaatacatcatgggccctgcccacaaggaatttctagcttaattgagaagtctgaagattactgcatttcaggctggtgtacttaataacagagtatgataacttaggcactgtgccaacatatattggtaggtgtaagtgtgtctagctttgtcctgaggtcagagaaaaaaacttttttttggtggtgtgtccagaaaaccatagttatgattagctctttacctctcctgtattatcccttgatgcttgtacctatttctcacttctgtcatccctcctatggctgactctttcaggttcttttttttttttgagacagagtctcgcactgtcacccaggctagagtgcagtggcgtgatctcggcttactgcaagctccgtctcccgggttcacgccattctcctgcctcagcctcccgagtagctgggactacaggcacccgccaccacaccaggctaattttttttgtatttttagtagagatagggtttcaccatgttagccaggatggtcttgatctgctgacctcgtgatctgtccgcctcggcctcccaaagtgctgggattacaggcatgagccactgcgcccggccttccagacagttcttaatggatgggtaggaatttgccaaatatatctaggagagaaattcctggcgaagggagcaatttgtacaaatagatgagaaatgaagagtttgcagattaccagcaaggctttctaatttccacatgtagcttgaggcacatgttatcaattgtaggatgttacctcccttaactatccagtgccagccagcctagagtagatcatggggtaaagaaaagaaagctgctctttcccctaattatatattcagaggttgaaaattagtctttgatgtgaatatgtatttgtgtgatttgctagtaatttctgttggtcatcacgtcctagaggaaagtgacttcttcctaacccctcactggagtttacctccctcagacatctcaagccataagaaagaagtatgctgaattaagctgagggagctataattaaaatagtcaatagctgattttcctaggtaatccaatttgtattcatacttcagcataaaaatacatttaatttaaagcattctactcttgtgattgatcttgtaaactgcttattaaaaatataggctgggcacagtggctcactcctgtaatcccagcactttgggaggccgaggcaggcggatcacgaggtcgggagatcgagaccatcttggctaacacagtgaaaccctgtttctactaaaaaatacaaaaaaattagccaggcgtggtggcaggcgcctgtagtcccagctactcgggatgctgaggcaggagaatggagtgtatccaggaggcggagcttgcagtgagctgagatcgcgccactgcactccagcctgggccacagagcgagactccatctcaaaaaaaaaaaaaccaaaatatatatatatatatataaacatggggctgggtgcagtggctcatgcctgtaattccagcactttgggaggccgaggcgggtggatcatgaggtcaggagatctagaccattctggcctcccaagtagctgggactacaggcacgtgccaccatgcccagctaatttttgtatttttagtaaagacagggtttcaccatgttagccaggatggtcttgatctcttgacctcgtgattcacctgcctcggcctcccaaagtgctgggattacaggcgtgagccaccgcaccagccactacaatacaatttttatagtgaatttaaaacaccaaacaccacattccaaaaagaactctgagtcagacaccaacagtaaaagcttaccgtgatctcagtctgtctttagtaatgaagcccaatgactaacatataagaagacaattcaaactatactttgttcaggaaaaggaagataaagtcttccacatcttctggatggaacctgggaaagatattccacagtgtcttactgcttataaacaattttaacaaatcagcattagcttaatggagggaaggaacaattcatggcttcctgatgagaaattcagttcacatttatgtggcctgctttggagcaacttgtgctgttagctgatgatcttaagtttctctgttgagcactacctgtggaactgtccaaatctgggcttttaggaaaataatatcttggccgggcacagtggctcacgcctgtaatcccagcactttgggaggccgaagtgggcagatcatgaggttaggagttcgagacgagcctgaccaacatggtgaaaccctatctctactaaaaatacaaaaattagctgggtgtggtggctcacgcctgtaatcccagctactcaggagggtgaggcaggagaatcacttgaacccaggaggtggaggttgcagtgagccgagatcgtgccactgcactccagcccaggtgacagagcgagactctgtatcaaaaaaaaaagaatatctttggtatgcccagcaatttataggttatatgtggtaattagaaacagttctttaataaaacaaggaaggcttaggtcgggtgcagtggctcatgcctataatcccagcactttgggaagctgaggctagaggatctctctctctctttttttttttttttttgagtaaaactttaaatttttctcccactaggatctcttgagtccaggagtttgagactgcctggacaacatagtgtgaccctgtctctataaaaaaaaattaaaaaattagctgggtgggtggcacatgcctgatgttctagctactccggaggctgaggtgggaggattacttgaggccaggagttccagtgagctatgatcgcacctctgcactccagcctaagtgacagagcaagactctgtctgtaaaaaaaaataaaaatgaaaaaaggctctcattagagggctttaagtgctgtctaaatctcaatggtagcttcaattcctttgcctattaaatcttatttttctaaggtgttttattttttttgagacagggtctcactatcatccaggctggagttcaatagcacgatctcagctcactgcaacttcgcatcctgggctcaaacaatccttctgcctcagcttcccaagtagctgggatcactggcatgtgccaccatgcctgactaatttttgtattttttttttttgtagagatggggttttaccatgttacccaggctggtcttgaactcctggactcaagcaacccccgcttggcctcccaaagtgctgggattagaggcgtgagccactgcacctgacctaaggtttcttgttctttccctaagtaaaataggaagagaatcacaaattttaattctgctacttccccttgagggactaagctggggagaataagtactctaaaaagggagtatcttattagctaacaaataacaagagatagctgtctacttcttacaaagttaaagtgattcttccttttacatttctaaaacataatgcatggaagactaaaatgaactcaaggctttattgttaattttaatgtcattagtgtgccagtatcgtcctacctttctgcttgtctacttaccaattagcacagagtaaatactgattgttagaagaaaaatgaaacatgatggtcagggaacatgtagtgtcttggcacataggcaacagacttagcatttctttctttcttttttttctttttttctttttttttttttttgagacagtctcgccctgtcacccaggctggagtgcactggcacaatctcagctcactgcaacctctgcctcccaggttcaagcaattttcctgcctcagcctcctgtgtagctggtactacaggtgccagccaccacacccggctactttttgtatttttagtagagacggagtttttccatgttggccaggctggtctcaaactcctgaccccaggtgatccgcccgcctcggtttctgaaagtgctgggattacaggagtgagccactgcaccgggcctagacttagcatttcattttattttgttttttattttattttttgagacagtctcgctctgtcacccaggctagagtgcaatggtgcaatcttggtcactgcaacctccgcttcctggattcaagccattctcctgcctcagcctcctgagtagctgggattacaggctcccgccaccacgcccggctaatatttgtatttttagtagagaggggtttcaccatgttggtcaggctcttcttgaactcctaatctcatgatccgcccaccttggcctcccaaagtgctgggattacaggcgtgagccactgcacctgtctaaatttagcatttctaagagattagttgtagagcatggacttccttggaaaataaatatttcttttggagcttaaaaattcttggccatttatacaagagtttcagtaagtccgggagtcagactaaggatacctggattttagtcctggctctgagcaggcatttaacctctttgaacctcagtttcctccttctgcaaaaagtaggagattgaaattgagccaaaagattgctaagaatcctttcttttttttttttttgagatggagtttcactcttgtcaccccggctggaatgcagtagcgctatcttggctcactgcaacctctgcctcccaggttcaagtgattctcctgccacagcctcctgagtagctgggactacaggcacgtaccaccaagcccagctaatttttgtatttttagtagagacgggatttcaccatgttggccaagatgttctcaatctcctgaccttgcgatctgcctaccctggcctcccaaagtgctgggattacaggcatgagccactgtgcccagcccctttcattctttaagttttattgacactctcacaatatcgtagaatcagcagtgagccatgccaagatttggcttttattttattttatttattagagacagggccttactatattgcccaggctggtctcaaactcctaggctcgagggatcctcctaccttcgcctgtccaaatgctgggattataggaatgagccactgtgcctggccttttacatttggcaggtcgtttttattttggcatttaaatttggcagatggttttagcagctatacctagatccataaatctatcttgttatactcttgtatggtcatgtctacataaattagattagaaggtactgtttctgggctgtgtgtgtgtgtgtattttcaatgtgcccagtttgaacttacccaaatattcaaggtaatgcttttatctgggtccttccatttgcttaatatttctatacaccaactggttgtgttcagactttctctctggcctgcttcttccaacttgctccctggagtcatactcttgacctggcccctcctttctcgatttgcatttattgagaggttttcaggtaccaggaacattacaaagcactttatttctgttcatgtcatttaatccttacaaattccctgtattaacaatttttttttcttcgagacagagtctcgccctgttgcccaggctggagtgcggtggcatgatcatggctcactgcaacctctgcttcctgagttcaagcgattctcacgcctcagcctcctgagtatctgagattacaggcatgtgccaccactcccagctaatttttgtatttttagtagagccagggtttcaccatgttggccaggctggtctcaaactcctgacctcaggtgatctgcctgccttggcctcctaaagtgctgggattataggcgtgagccaccacgtccagccttgtactagtaattgttgtatacttttataatactagaaaactgagacttagagaggtgaagtaacttgtctagtgttaacacttaataagtggtagagctggaattaaaatttcaatctgactccaaagctcatgctcttaagcaatatactgtgttagttccatgatgatgatgatggtgataacgatgttgttaattacaatatgttgagcacctcctgagtgacaagcaatgcattgccaccttttgcattcccattttacaatagtggaaactgcttttgctcatggtctgcttttaggctaataagtataagtacctaggttccaaagtattgggcattattgaattgtgctttcagtgcatttttccttttactttctttcctgttttaatggtcaacatcataatgtttttctaattactaccagtattaacaatttaatgttgtctgaatgtttctgtacttttttcccttactgatgccttagcattgaggttttcttatttgttacctttgctgttttttctctatcaaaagcagataatggggctaagataatagagaagggattgtaccaaggacaagctaagtacaggaaagttcagatgctagaaatctttctgggatctcagtttggagaataaagatttaaatgaaaaactcccattttttggtagctgtctttttttaaaaaattattttaatttttttttttagagacagggctcactgtgttgccgaggctggactcaaactcttggtgtcaagtgatcctcccacctcagcctcctgagtaactgagactacaggtgcacgccactccacccagtggtagctgtcttttattgaaggaatattagggctttggtacttactagcttggtgatattagacacaggatttgaccttactagccctagttttcttacctgaaaatagggtaaataaatatacctcacaatgcatggttagttgtggtgatgattaaatgcagtaacaagtgtaaaactccttaatatattactcagaattgttagcttcctcttttaccttcagatgttagtggaataatccaggttatgtggaggttatgttaaggttgtgttatgtgtgtcttttttacatttagaaaatttagtgttagtatactaaataaaaatttatcaagctgtatccttaatatttatgtacttggctatatgtaagttagttacggataaaaaaggaaaaatcaatgtgcaaactggacgttcatttgctgcatgtgattagctgatctttccatgtattatgcccagcatgtagggctactctttgtaattttttattccccaagatcatatggaaattattgagttttagcaagaagagactgttatataataccttccaaatatttatttcgtttattgttttagtaagcagattttcagaaatatttgtttgtattctcagaaaaggtatattcaatcctaaaatactgtttctaatgttattaattcccagtacatagatctcaccttgctttaggcatgcccacctacaggtaggaaataaaattttagaataagcagcatgtcttagtctgttcaggctattataacagaatactatagactggggggcttaaacaacaaacatttctttctttcttttatttttatttatttatttttgagacagggtcttgcattgttgcctaggctggagtgcagtggtgtaatcacagctcacaactcacctcctgggctcaggcaatcctcccacctcacctcccctccctccagtagctgggactactggcacatgccaccatgcctggctaatttttaaattttttatagagacagagtctcattatgttacccacgctgatctcgagctcttgggcttaagtaatccttcagccttggcctcccaaagtgctaggattacaggcatgagtcaccaggcccagccacagacatttatttctaacagttctggatactgggaagtccaaggtcaaggtgccaggagactgggtatctgtgagggccttcttcctggtttccagacagttgtcttcttgcgtagcctcacatgatggaaaaagagaactctctgggtcttttttgataaagtactaatcctattagtgagggctttaaaaccctcaatgacctaattatctcccaaagaacccatttcctatcaccatcacattggtcattagaatttccatatataaattgtaaggggacacaaacattcagtccataacacagtgaaatctgatacttttgaggtaaacctgtgtctaaaacacacctttgaatggactactgctcctattagccttttactcaaaaccatcctggtgtttttgtgtgattaaatttgtaaattctttggtgtactcttgagcaggctccctttcttctgtgactcagagcctggagcgttgcagccaagctcaaaagtcaggaacgggggtgtggacttttgggctatgccagtcagcagccagaatgtggttggcagtctcctccccttcctgcacttcagctctacacagtgtgcattctggaatgacaggcattcctgtgtgaagagtgccagtgtgaagacagttttgtaagaactgcaagtgctcaggctgtatgggaaacagaaacttcagcagatgaactgaccttatgccatttcctgatgtttggcagtgacactgaaagaggaccgcatgtcccctctttatgtggatttatcttttatgaaaagtttgcttttgtccgggacagtttgttgtcgtgagatacatcagacaatataatcatgggacaagctgatgtctccagaccggtaaatccagatgcagttggtgagtaatagaaggcagagaaacagaaaatcttgacagaagcaaggcagatttacaggtgaacttgagtatttatgtgaagttaaacacgagaatgttgatgatcccaactttgaaatgtttatgtttgtgaagaatgaatgaagtcatgcggaacatggcgagaaactttaaaaaattaagttttttaaaacttaaaaacttaaattcagtttattaatttatcgctcacagttttgttttacttgatctctttgaagttttttatattatattgctaaggaattatctgttaatttcttgccgttactaaagataaatgctacagaaacttatttagaattcagagatattttgttagtattttacagaacttggaaaatagaactgttgacttctatagacagaaccacttttaagaattaagtttttagacttggttatacattttcctaataagtctcaggcattttccattgcactagtgtttccgtttctcttaagtcaacactttgatataaacttttctgaagttagtactttacatttgaaatgttactaagggatagctagagagcaagctgattgtgagtatagctcagagtttcaaatcttctatgtgaaatggtagtcacttgtcactgcaagctcattttcctaatcttgtagggttttatatgacaatcataaattgggaaaaacagttttaagcagatgttcattaaagggttgcttaagtataagcaaaactagggaaagcctgtgaatcatttctagacattataatatttaagaaagatttataccttcactttgatttatggagcagcagaaaacatgttcagtcctaggctgcattttttgttttttgtttttcagaaacaaaaaatgttggtgacttaaaaaaaaagcataaagtgtggaaacacaggtaacactcccaaatgtttcataatgtagtgagattttgtttctaaaggtagtattttcacctgagagcttcctagatgaaatatcttcagtatttttcatgtattattgaaactgaggcacatggatcacaaagtgagtcattcagcaacagattttcagaactgaagtcaggacttgactcactttaccttgatcactagggctgtgtctttatcaattcattaactcatttaaaaaaatgaaatgtttcataaatagaaaaaggtataaagaaaaatataaagaatcatctggggccactccccagcctaacagatgaaatttagaacataaagataaacctcacactatccttctcttctgcattcccttctgatgacattttgcttctttgtttccagaattaaacactctcctatatttgataaataactcacttttgggctgtaaattctcctgtggtttctacgccaaacattagttgtttgttagcaagtatagtaaggactcaatgctaggcatttatctatgagatggaaatgaaagggctttgacaaacaataaattgtaaagcaagtaaaatttagtggtgagtggtggtatttaagaagaatgcccatctaagatctatatactgtattaaaaacttcatctgaggccgggcgcggtggctcacgcctgtaatcccagcacgttgggaggccgaggcaggcggatcatgaggtcaggcgatcgagaccattctggctaacacggtgaaaccccgtctctactaaaaatacaaaaaaatcagctgggcgtggtggcgggcgcctgtagccccagctactcgggaggctgaggcaggagaatggcgtgaacccgggaggcggagcttgcagtgagccgagatcgtgccactgcactccagcctgggcgacagagcgaaactccgtctcaaaaagaaaaaaaaaaaaaaaaaaaagttcatctgagtaacgtttggtatttgtatgcttctgaaaaaaagtaagaatcaaattcatcaattctttttttttttttttttttgagacggagtcttactctgtcgcccaggctggagtgcagtggcttgatctcggctcactgaaagctccgcctcccgggttcacgccattctcctgcctcagcctcccgagtagctgaaattcatcaattctattcctaccagtagccctaataaaagacatttgaggaagaaatagaaatcaggagcttaactaagttttttatgtttcctctggatttaattttggggttttatttcctattacctagataataagtagttgactatcagcagttttcatggactgactccattattatgctatttataattcaggatgtattctgtttgagcagatcaggaccaggttatgaaggcttaactgaaaaccttgaggactataccaattccaataaaggttttcaccaaacaacagtttcttaatttaattttcaaagcctttatgtgggtagctgtttggaaaatctcaccattttacttggaatgataaatatacaaagtaaattaaaacctaaattatctgtttactattctaggcctataatacagcacttagttttgagctttgaaattaatagtactagatttagcaagtcaactgatgcaaaacacatgaatgaatatattgaattgatttattattactttcaggcactgtgaataacatagaggcccctatgtagatattattcatgtctatgccctcaagaagtttgtcttctagttgagaatttaaaatatgaaaaagtatccaaaatatttgtaaaatttttttaaagattaaggcatacttctttttttttaatttaattttattttttttttacttaaaaaatatttgtgtgtgtgaaaatggggtctcactgtcgtgaccaggctggtctcgaactctagcctcaattgatcctcccacctcgggctcccaaagtgctaggattacaggtgtgagccaccagtcctgcagttaaaaaaaggacccactcctttaagttaattgattcccttgacttgtaatggaaggccagcgctattaaccaaagagtctgctttcaaataaataacctttgcatgaggattcatatgcaaatttatgagatgttataaccatatccaaccagagtttctactgtaggatctttctaacaactggtgaactgagtatttgaatgtacattaggaatctatgctgtggtatccattcaaggaaataagttctcatcagttcattgaaaaaaattaaataaaatacgttcataggagaagcatgtagatttatctagataaaacattgcaatcagggcagagtgcattggttcgtgtctataatcccagcactttgggaggctgacgcaggagaatcacttgagtccaggagtttgggatcagcctgggcaacatagggcaacaccgtttctacaaaaataaaaatttagccactgtggtggtacttatctgtagtcccagctacttgggaagcttaggtgggaggatcgcttgagcctggtaggttgaggctgcagtgactcatgattgtacctctgcactccagcctgggtgtcagagggagacactgtctcaagaaaaagaaacacaaactttcaaatcctactttgtagttcttaatgaacataaaaactgtttttttgctcaccaaaattctttactatgtgtcatattaaaacaactagctaattatcacatatccttaaattaggcacaagaccgaagaattttttcaatttattttttattttttaaatgtatttttttggctgggcgcagtgtctcatgcctgtaatcccagcactttgggaggccaaggcgggtgaatcacgaggtcaggagatgagacaaccctggccaacatggtgaaaccctgtctctactaaaaatacaaaaattagctgagcatggtggcgcgtgcctgtagtcccagctactcaggaggctgagacaggagaatcgcttgaaacaaggaggcggaggatgcagtgagccgagatcgtgccactgcactccagcctggcgacagagtgagactctgtctcaaaaaaaaagaaaaaaaagtttttgtttgtttgtttgtgtatttatttatttacttttttttgagatgaagtctcactctgtcacccaagttggagtgcagtggcgtgatttcgactcactgcaacttctgctttccaggttcaagtgattctcctgtctcatcctcccgagtagctgggactacaggtgcccaccactaagcctggctaatttttgtatttttgtagagacggggtttcgccatgttggccaggttgctttcaaactcctgacctcaagtgatccgcctgccttggcttcccaaagtgctgggattacaagtgtgagccactgtgcctggcaaattttttttttaattgaaaataattgtacctgttcatgggctacataatggatatttccatatgtatgatgtgattagattagggtaattagcatattcatcatctccaacatgtatttatttatattgggaaggttgaaatcctcctcagctatttgaaactacatattattaactatagtcattctgcagtggcatagaacactagaactttttcctcttatctagctgtaattttgtattctttaacaaatctttccctacccatcccttcccattatctctcccagcctctagtagcctctgttgtactttttactcctatgagatcaacttttttttagcttctatgtatgagtgagaacatgtggtgttaaacttcctgttcctagcttatttaacttaaaataatgtccttagttccatccatgttgctgagaatgacaggatttcattgtctttctttctctctctctcttctttctttctttcgttctttcgtctcaactctgtcaccgaggctggagtgcagtggcgcgatctcggctcactgcaacctccacctcccaggttcaagcaattctcctgcctcagcctcccgagtagctgggactacgggtgcacactgtcatacccagctaattctttttttttttcttgagacagaatcccactctgtcacccaggctggagtacagtgacacaatcatagctcactgcagcttcagcctcctagattcaagcgatcctcccccctcagcctcctaagtagctgggactacaggcacatgccaccacacctggctagttttttttattttttgacgaaacgaggtctcactctctttccctggctggtctcaaactcctggacctggactcaagtgatcttcctgcctcagccttccaaagtgctgggattacagttgtgagctagtacacctggctcattcttttttatggctaaatagtattccattttgtatatataccacattttctttatccattcatctgttgttgaacacctaggttgattccatatcttggctgttgttgagtagtactacagtaaacatggaagtgcagatatctcttcagtataatgatttcctttcctttggatatattcccagtaatggtattgctggatcatatggtagcgctatttgtagtttttctttcttttgaggaccctccatactgttccccatagtggctatactagtttacattcccaccgacagtgtatagtgttccctttactctgtaccctcaccagcactggctactttttgtctttttgataatagcctcctaactggggtgagatgatacctcattgtggttttgatttgcattcacctgatgatttgttatgttgagcatttaaaaaaatatatttggcttttttttttttttttttttttttttttttgagacagagtcttgctctgtcgccaggctggaatgcagtggcgtgagcagtcttggctcactgcaacctccgactccctggttcaggctgttctcctgccccagcctcccgagtagctgggattacaggcacgtgccaccatgaccagctaatttttgtatttttaatacagacagggtttcaccatgttggccaggatggtcttgatctcctgaccttgtgatccgcccacttcagcctcccaaagtactgggactacaggcataagccacagcccttggcctatttgggcatttttatgtcttcttttgagaaatgtctcttcagatcatttggtctttcccatttttatattatttatttttttatttttattattattattttttgagacagagtctcgctgtgttggccaggctggagtgcagtggcgcgatctcggctcactgcaagctccacctcccgggttcacgccattctcctgcctcagcctcccaagtagctaggactacaggcgcctgccaccgcacccagctaattttttttttttttttttgtatttttagtagagacggggtttcaccgtgttagccaggatggtctcgatctcctgacctcgtgatccacttgcctcggcatcccaaagtgctgggattacaggtgtgagccactgcgcccagcctcccatttttatattatttaactatttatttatttattttatttttttgaggcagagtctttctctgttgcccaggcggagtgcagtggcacgatttcagctcactgcaacctccacctctcgggttcaagcaattctctgcctcagcctcctgagtagctgggattacaggcgcctgccagcatgcccgactaatttttgtattttaggtagagacggggtttcaccatcttggccaggctggtcctgaactcctgacctcatgatccacctgcctcagccccccaaagtgctgggattacaggcgtgagccacctcacctggccatatttaattattcttttttaagacagagtctcgctatgttgcccaggctggtcttgaactcctgggctcatgcgatcctcccactttggcctcccaaagtgctaggattacaaacataagtcactgcacccagcccttcctaattctaattagaaggaccaaagatttttaataaattctctccaaccatttggcttggaactttccttctctgtctttccattttacctctctttttttttcctttttgccccttcatttaccctaattcactaattaacttttccccccacttttcttttgcataataatatattgctataaaagatactgtatgttctctttcctacattccttttccataaccatttgatttattttctctgaaacttggagttatggggttctcacccttatgatactggaagcagttttggggaacgtgatttggaaatatatcatcccccatctctacaaaaaaaatgtaacaattagtcaggtgtggtggtgcacacctgcagtcccagctgttcaggaggctgagatgggaggatcacttgagcccaggaggttgaggctgcagtgagccatgatcatgtcactgcactgcagcctggctaacagagcgagactgtgtttgaaaaacaaaaaagaaaggaaaagaaatatattatcacttagaggcaaaatcctaaggagattgcaggatgaataaaatttaacatagctacataacaacaataaaactggagtaaataataggttaatttaaaataaagtacttcatgagattttggagaaaaaggcttagtagtatttggttatcagaattataaagacatttctcatacctgtctgctgtttatctaacagtaaatgctttcttttaaaaaaggagaaacaggcatactttcctcatgtaatccagtgttcaggaggaggtggcaatataggggtctgtcataaactccttaaaagattctctgttatcaaatttggactaccaaccaaaacttattgatccctctctctgctccagtggattttctaaataggccattaataaggtttggatctaggtccccaaccagatcccatgttaaattgtaatccccagtgttggaagtgggacctggtgggaggtgattggggtggatttctcacgaatggtttaacaccatccacttagtactgtcctcaagatagtaagttctcatgagatctggtcatttaaaagtgtgtggaggctgggtgcagtggctcatgcctgtaatcccagcactttgggaggccgaggcaggtggatcatgaggtcgggagttcaagaccagcctggccaacatggtgaaaccctgtctttactaaaactacaaaaattagccgggcatggtggcgtgtgcctgtagtcccagctattcaggaggctgaggcaggagaatcccttgaaccctggaggcggaggttgtcgtgagccaggattgcgccactgtactccagcctgggcaacagagtgaggctccatctcaaaaaaaaagaaaagtgtgtggcacctgcccccttgctctcttgctcctgttctgggccatgtgacgtgtctactcccccttcatcttccaccatgattgtaagttcctgcagcttcccccgaagccaggcagatactagcatcattcttcctatacagactgcagaaacatgagccaattaagcctcttttctttataaattacccagtctcaggtatttctttttatttatttatttatttatttatttagatagagtctcactttgttgcccaggctggagtccagtggtgcgatctcagctcactgcaacctctacctcctgggttcaaagtaattctcctgccttggcctcctgagtagctgggactacaggcgcgtgccaccaagcctggctactttttgtatttttagtagagacggggtttcgccgtattggccaggctggtcttgaactcctgacctcaggtgatcctcctgccttggcctcccaaagtgctgggattacaggtgtgagccactgtacctggcctcaggtaattctttatagcaatgcaagaatggactaatagacctattatcacaacctacatatgtatttcctctttcttttttcttttttttttttttgagacagtctcactctgtcgcccaggctggagtgcagtggcacgatctcgacttactacaacctctgcctcctggattcaggtgattctcctgcctcagcctcccaagtagctggcattacaggtgcccaccaccatgcctggctatgtatttcgtctttctacttgcaagtaaactttggaaagtttgaagttttttttccatgagtgaatagcttatattctggcccttcactataaaaacatacccttaacctggaattttttgtcagaacagtgtgcacattaagttgccagtggtaaagcaacttcacttcttgatacaatcataggcagaaaactatttttccagaggtagaatctcagacataactgtacctgcaagttcagagagagaccttccacctgactatcttctcctgacggctttaccgagttctttctaattcccaagggtcagatctatgcaatatttccacaggaagttgtgggccttctctatacaaagcctgctttgttcattagtggcaggtttattttctgtaattttgccgaagttttctgaaacagttgtttaaagccaataataatcctcttttagaaggcaaaaatgaataagtacagtagtgtaaataccataaatgaatgttctacgtttacaatgttctgatactgtgaaaaggttgtttatagcaaatctgtttccagctaggtgggcttaaaaacagactaaaccattatattatgaagatatttggtacttcttcacagtgaagtatgtataccttgttgaataaaatcatacattaaaattttggacaaataggctgggcacggtggctcatgcctgtaatcctagcactttgggaggtcgaagcggatagatcactgttggccaggctggctggaactcctgacctcaggtgatcacaccattgcactccagcctgggtgacagagcaagactttgtttcaaaaaaaaagaaaagaaaagaaaggaaaggaaaggggaaaggaaaaaggaaaggaaaggaaaggaaaggaaaggaaacctgataaggtggccgggcgctgtgtcttatgcctgtaatcccagcactgtgggaggccgaggagggcggatcatgaggtcaggagatcgagaccatcctggctaacacagtgaaatcccatctctacttaaaaaaaaaaaaaaaaaaaaaaattagctgggcatggtggtgggcgcctgtagtcccagctacttgggaggctgaggcaggagaatggcgtgaacccgggaggtggagcttgcagtgagccgagatcgtgccactgcactccagcctgggcgacagagcgagactccatctcaaaaaaaaaaaaaaaaaaaaaaaacctgataaggtgtaaaacatacagagagttcatacagatccaataactttgttacttattaccaagtcaagtaaagcggggggcgggggtggggggacaaggcatggtagctcacacactttgagaggctgaggcaggaggattgcttgagaccaggagttcgagaccagcctgggcaacatagcgaaacctgatctctactaaaaaaattagccagataaggtggtctgcacctgtagttctatcttctcagaggctgaggcaggaagattgcttgagcccaggagtccaaggttgcagtgagttatgatcatgccattgtattccaagctgggtgaaagagtgagacactgtctcaaaacaaaacaacaacaacaacaacaactggctgtgccaggtgcagtggtgcacccctagagccccagtgacttgagaggctgaagcagcaggattgcttgagaccaggagtttgaggctgcactgtgccatgatcgcgcccattaatagccactgtactctagcctgggtaacataccccatatctaaaaaataaaaatatatatgtataataaaataaataattggttgtaaatctaattctaaaattaacattatctttgacctagggcatattgtttaatcctgttttatctcatatctccatcaagttatgcaggtataatatgtatctatagcaaatagttaatgaatactttatccgaagatgaaaggtgctaagtggtttttataaatatcatacatttatttaaaaatcacagccaatggcccagtgctgtggctcacacctgtaatcccagcactttgggaggccaaagtgggtggatcacctgaggtcaggagtttgagaccagcctggccaacatggtgaaaccctgtctctactaaaaatacaaaagttagccaggcgtggtggtgggcacctgtaatcccagctacttgggaggctgagacaggagaatcccttgaacccaggaggcaggggttgcagtgagctgagatcgtgccattgccctccagccagggtgacagagtgacactctgtataaaaaaaaaaaaaatcacccctgaaattcatatgaaacaactacacttgcacttaaaaacttcaattaaatatttactaggaaaaatatggtggttgaagaaactactagaactctgcataattaatgatgtaagaaacaagcctatgatatgtgaggtgctacaacttgaatgagggagtaagtagtttaaataccaggcctggtttcagggtactactcaaacaggaaactccaaactgtaatttggttagttatcttccactcccagcctccaccccctccaaaaaacaccaagactgtcaactctgtgacgtgctttcctaatggcctgtagctacatgactcaaagaaaaaggtgttttctttggaacacacaattgtaaaactatacccagcatcctacaccctgatttctggcaaacaaaggaaaactacctttttttttttttttcactcatagaaaacagaatggggccataggccatttaaaatgccataactagtttaaacagaaacaacagtctatccaaatgtgactgcatgcctatatgttctctgtcaaattggaaattagagggagcattttataaaatcagatgctgagaacaaagatttatgtgcagaattggcgtatgaacagtttcaggcccatctttcttagtcctttattagtataaaacaaatttgggtgtacttatataattttttaaaaaacagtgatgatttctggatacctgagtatattttttgtttttgttttttttggttgtttgtttgtttgttttgaggcaggttctccctctgtcacccaggttgtagtacagtggtatgatcacagctcactgcaacctcaaccacctgagcttaagcagttccctcgccttagcctaccgagtatctgggactgcaggtgcatgccaccacgcccagccaattgttgtgtgtgtgtgtgtggttttcgttttgttttgtttttgagagggagtcttgctctgtggcccatgctggagtgcagtggagttgtctcagctcactgcagcctctgcctcccgggttcaagagattctcatgcctcagcctccccagtagctggaactacaggcatgtaccaccacacccagcttttttttttttttttttttgtatttttagtagaaacagggtttcatgttggccatgctggtctccaactcctgacctcaagtgacccgcccacctcggcctcccaaaatgctaggattataggcacgagccaccgcacccagcctaatttttgtatttttgtaaagatgatgtctcagtatgttgcccaggctggtcttgaactcctgggtttaagcaatccacccacctggccttccaatgtgctgggattacaggcgtgagccactgcatccagcctactctttgttctgtaatgtattcatctgtcagtttctctttgtttctattacagtttctaagcattgcaattgaatcctcctgtcaaacagaaattcatactaagaagcttgaagcttgaactattgtagcaggattttttttttttttaattttagatacagggtattgctgtgttgcccaggctggagtgcagtggctattcacaggtgcaatgatacatatcacaatacagcctcaactcctagactcaagcaatcttcctgcctcagcctcctgagtaactaggacaacaggtgcgcatcactgtgccctgcccagtgttattgtagcagttttagagataaatggcttaattagatctaatcagccactgctatgaagcacttatgcattaatttttttctttgagacagggtctcacttgttgcccaggctggagtgcagtggcacaatcacagctcactacagcctcaacctcctcagatcaaaggatcctcctgccccagcctcccaagtagctaagactataggcaagcaccacacttggctaattttttttttttgtagaggcagggtctccctatgttgctcaagctgatcttaaactcctgggctcaagtgatccccactacctcgacctcccagagtgctaggattaaaagcatgagccaccatgcctggcaaatttatgcattcttcaaaactctttattatacagctaaaacacttttacctggcatatttagatcttcattaaatttggtttctagctcctttagcacaatattttacttgtggcaaactaggagaatatacttaaaagaactcttagaatccagattacagttgacctttaaacaacacaggtttcaactgtgtgggttcttatgtgtggatgtttttcaataaatgtattgacagattgtttggagatttacaacaatttgaaaaaaaaaactcacaggcagaccagatgtggtggcttttgcctgtaatcccagcactttgggaatctgaggcaagaggattacttgaggccaggagttcaaggtcgacctgggcgacatagtgagaccccatctctacaaaaaattaaaaaattagccaggtgtggtggcacatgcctgttgtcccagctactcagacagctgaggtgggaggatcacttgatcccaccaggagttggaggctgcagtgagctctcatctcaccactgcactctagcctgggcaagagtgagatgctgtctcaaaaattttaaaaagaggctgggcacaatggctcatgcctgtaatcccagcactctgggaggccaaggtgggtagatcactttagatctggagttcaagaccagcctggccaacatgttgaaacctcatctctactaagattagctgggcgtggtggtacacgcctatagtcccagctactcaggaggctaaggcagaagaatcacttgaacctgggaggcggaggttgcagtgagccaagatcacaccactgcactccagcctgggagacagagtgagactccatctcaaaaaataaaaaatacaaacaaataataaaaataaaaataagtccgggcacagtggctcacgcctgtaatcccagcactttgggaggccaaggtgggtggatcacttgaggtcaggagctcgagaccagcctagccaacatggcgaaaccctatctctactaaaaatacaaaagttagccgggtgtggttttgcgtacctgtaatcccggctacttgggaggctgaggcaggagaatcgcttgaacccaggaggcagaggttgtggtgagccgagatcacgccattgcactccagcctgggcaacaagaatgaaactttgtctcaaaaaaataaataaataaaaataaaaatgaattaaattaactagcatatactgtactgctgtaatttcatagccacctcctattactattgaagtgagctcaagtattgccagtatccacttaaaatgctgtatgatgctaattttctagtgagcagttcttcatagcttagtgcaatatcataaatcttgaataacaccacgggacctacaacacgtgccactaatgatactggaattgctcttaagaagcagagaagagtcatgacattataagaaaaagttgaaaacgaaaaaaagagaaaacacaaggaaaagttgaatcgcctgatgtgatgcataccatagattgaggtctgtagctgcagttgcctgccatttttataagtatatatacataggtggtggctgggctggggaaatggcggcttcacgagagagtgggacttgggcagcagaggcagcacagtggatgcatttctgaccttctacagtgaggtgaaacaaatagagaagagagactcggttctaacatccaaaaatcagattgaaagatggacccgtcctggttcctcttacttcaatttgaacccatttgaggttcttcagttagatcctgaagttacagatgaagaaattaaaaaaagaggtttcagcagttatccacattggtgcgtcctgacaaaaatcatgatgctgacagagcacaaaaggcttttgaagctgtggacaaagcataaaagttgctactggatcaggaccaaaagaagaggaccctggatgtaattcaggcaggaaaagaatacatggaacacggccaggcacggtggcacacgcccgtaatcttagcactttggaaggccaaggtgggaggatcccttgagctcaggggtttgagaccagcctgggcaagatagcaagaccttgtctctattaaaaaaaaattttttttttaattagccaggtgtagtggcacacgcttttaatcccagctgctctggagactgaggccagaggattgattgaacccagaaagataaaaaagtccattcaaaaggaagatataataactctaaatttgtatatacctcataacagcttcaaagtatataaagcaaaaattaatagaactaagagagaaatcactttgtcttttttttttttttttttttttttgagacggagtctcgctctgtcgcccaggctggagtacagtggcgtgatctcggctctctgcaagctccacctcccgggttcacgccattctcctgcctcagcctccctagtagctgggactataggcacccgccactgcgcccggctaattttttgtatttttagtagagatggggtttcaccatggtctcgatctcctgacctcgtgatccgcccacctcggcctcccaaagtgctgggattacaggtgtgagccgccgcgcccggccatcactttcataattagagatgttaacatacctctctcagttactgatagagcaaacagacaacaaatcagaagggatcttaatgatttgtatatgattaaccaccttgacctaattggcatatttagaacaccatacccaacaattgcacaatacactttccaataacacataattggagataatgtattataaatttgggaagaaacaactgtaagcttctgttgtttatttgcaacttggaccatatttgagatatataggaaaagcattaaatataaatggcctaaacactccaattatcctaccacgttgggagactgaggtggaaggaccacttgaacccagcagtttgagaccagctcagctcactgtaacctccacctcccgcattcaagccattctcctgcctcagcctcccaagtagctgggattataggtgcctgccaccatactcagctaatttttttttgttgttgtatttttaatagagacagggtttcctcatgttggccaggctggtctcaacctcctgccctcaagtgatccacctgtctcggcctcccaaagtgttgggattacaggcatgagccaccgcatctggcctcatttttctttttctttttctttctttcttttttttttttttttttttgagacagagttttgctttcacccaggctggagtgcagtgatgtgatcttggctcactgcaacctccgcctcccaagttcaagattctcctgcctcagcctcccgagtagctgggattataggcgtgtaccaccacacccagctaatttttgtatttttagtagagacgaggtttcaccatgttggctaggctggtctcaaactcctgatctcaggtggtctgcctgcctcggcttcccaaagtgctgggattacaggcatgagtcaccatgcctggcccctaattcatttttcttcaacaaagaagcagcctatagccagaaaatgtctgcctctgtctcttttaacctccatgaggtttccagataataatctggtattgggtttaacacacctgactgaccttaggaccctaggctgacctggagagattttttaaaacagattctgaaagtcctacctcctggagattctgtattttgaaaaggcaattgggctgattccaagtatttggacagatttcggagtcttggaaataatgtactgtttgtcctggagagtaggaaaaagaggggaaggaaggagggagaatatgaggatatgaatatgtatgtgtgaatttgagataactgagtcagggccaggtgtggctctaccccaacacaggaggtaagaggaaagaaggacatctgcctctaaaagttttgtaaaagtgaaaatcaagcacatttgcatgagaagcaaagaaaatgttgctctgttttttgtattcagtggctttattttttttatacatattttgcttatgtatcaactattttttttttgagacaaggtccctgtattaagccattcttgcattgctataaagagatccctgggactggataatttataaagaaaagagctttatttgactcgtggttctgtaggctgtacaggaaacataatgcttgcaactgccctgcttctggggaggtctcaggaaacttacaatcatgaatcatgacagaaaaccaaccaggaataagcatgtcacgtgaccagagcaggaacaagagagcaaagagggagatgccacatacttttaaacgaccagatctcacgagaactcactcactattgctaaggcagcaccatatggatggtgctaaactattcatgagaaatccacccccatgatccagtcacctccaaccaggccccacttccagtactgaagattacaattcaacctgagatttgagcgggacacatatctaaactatatcagtatggctctgtcgcccaggctggagtgcagtggcacgatcacagctcattgcagcctggacctgctgagctcaagcgatcttcccacctcagcctcgcaagtagctgggactaggcacatggcaccctgcccaactaatttttttttttttttaagagacagggtttcttcatgttccccaggctggtctttctttacctaaaaaagaagagaagccagatgctgtagccagtgtctgtaatctgagacattctcataatttcaactatttgcctgtaatctcagctactcaggaggctgaggcagaggattgcttgagtcctggagttgaaggctcagtgagctgtgattgtgccactgcactccatgctgggcaacagaacgaaaccctgtctctaaaataactagataaatagatagagagacagatagatagatagatagatagatagatagataatcagattctagtgtatttcatgtaaagtgttaaagtaattgagacccagaatgtccttgtataagtcatgcaactaggaagagtcactgtcctcttgtcatttccatcttttgcactttagtaatgaggatgctattttgcctaagtcttctgggcatagcaaactaatgcatcagtagtcaccattgcatttactgtgataattacgattgtataaatctaacctttattgaaaaacttccctaaacctccatcaatcaagtgaaaaaaagattgaatttggcagttgtttcttttaaaaatttaatgctgttggttgtatattttctcttttgaaaatacctagttttaaaagagagagaggccaggtgtggtggtacacacctttaatcccagtgcttttgggaggccaagcagggaggatctcttgagaccaggcatttgagaccaccctgagcaatttggtgagaccctatctctacaaaacaaaattgtttttgtaattagccaggagtgatggtacatgcttatagtcctggctactcaggaggctgaggcaggaggatcatttgagatcgggaatttgaggctgcagtgagctgtgattacactactgcacttcatcctgggcaacagagtgagaccctgtttctaaaataataataataataataataaatttttttaaaaaagatgttttagtgactattatgacctttttaccctcctccaaaagtgttacttgcttcagatgtgaaattgtttacagtcaacatgttagcttatcatatgctgttccttgatgtatttctacaaagtagaggttccactttaatttcaggatggtttttccacatgactctttttttcttcctctctagacttctccagagaaccttggaacagtaggtggagtgcaaagctgcattgtgtaccttcctgcttttttttggttgccttcctgctggtttttttttttttcctttctttaaattcttggccccgccttggctctcctttctctgccattaaaactaactaactaaaccctgcatgcatggtcattatgaggggttcatggccttttatttcagttctgcacatgtatcatgtcagttatgttttatgtcaaatccttaatattatggtgtgtgtgtttgtgtgtgtgtgtgtgtgtgtgtgtgtgtgtgtgtgtgtgtgtgtgtgtttgagacaggctctcactctgttgcccaggctggagtgcagtatcttaatcacagccaactgcagcattgacctcccaggctcaagccatcttcccaactcagcctcctgagtagttgggactacaggtgcacaccaccatgcccagctaatttttgtttttgtattatttgtagagacagggtttcaccttactgccctggttgatctcaagctcctgagcttaagcgatctgcctgcctcagcctcccacagtgctgggattacagaaatgagccactgtgctcagcctatgattgtctctaaggcactactatggtaaacaaattggaatctcacctctactttctgaaaacatttccctccaatttaatgtacccgctttctaatgcttctgccccgcaaccctgagcactttccaatacctagggtccttttgtgaagggagaaaataatttgatgagcagatataagtaaggtactaacaatgtgttacctctccctgaactatttatatcctgaaaagggcagggaaagggcaatgtttaatagagaaaatgattcactcactaatgaggcaggaattccctgcctcagtaaggcaagatctcatgcatttgttaagatatccacattttgtatacatgcgcctttaaaagattttgagccggctctgatcatttcaccagattttgtcctaaaatgatgtcagcttggtttggttcctttttctccttagtagtttatctgttaatggattttgatgtttggtgtccatgtgatgtccaggagtctccctgtctgcatgattgtttatcgttgctccgatcctttccaactaccacaggaagagaggggaagggacattttagagattatgctgaaataatacatttgcttccttccctctcttcttttcatgtaacagaggaagcagaccagcccactacagagccaggcatggtcctggacagtgtggaagcaggagacacaacacctcctaccaaaaggaagagcaagttctcaggctttggcaagatcttcaagccctggaaatggaggaaaaaaaaaagtagtgataaatttaaagagacttcagaaggtgagatattaagggttaaatgtgtgttctgagttagaattctctatgttagatgtatttaatttttccttatcttcccaagtttctgtagtcctctatttgaagagggtatttaatgttttattctttccttcttctttttttttttttttttttttggtgagacaggatctccctctgttgcccaggctagagtacagtggcgcaatcacagttcactgcagattcaacctcctgggctcatgtaatcctcctgcctcagcctcccaagtagctggaagtacaagcatgagctactgtgcccagttaatttttaaattctttgtagagatggggtctccttatgtttcccaggctggtcttgaactcctgggctcaagcgatcctcccacctcagcctcccaaagtgctgggattacaagcatgagccactgtggctggccagagtttaatcttttagaattaaacatcaaaatggtcatgtactaaacctaatattgtataccctcattcccaggtttgtattttgatggcatataagtatctattgagtggtgaatggagttcctgaactgtcgcaaatctaagatgcttctttccatcagaacttggtgaagaaaatgactgaatgagttgatacatacataaataaaatgcttattttctactctgcccatccacacaaagttcatccgtaaataacttactaatgaaattttctcttaagttacaattatgtaaggctagttttttggaagtgatgctttcctgacagcacaggttataaaagaaatttaagagttttaatttgaagttagtctgctagttattttctttcctgagaatataaacttaaactactttattcttttacctgtagaattagaatgctaagtgtaaggttgactttcaactgtcacatttctgagtgccattttccaatttaatgttagttttagaacggaaaatatctatgcgaaagccaagagaagagctggttaaaagaggggttctgttggaagaccctgagcaaggtgagtttacaaataaatagcatatgcctgtctctgtgcacttggtctttgattgggtctgacgagatatttgaattttctttctttcttttatattgctatttttgggttggagggtggcctttaaaaaaaaaagttcacccttccttccttggggcaaacattcctttcctctgtgtacatcctcaactttgtgccagctacaatattgcgtgtcttttttttcccccccttgagacagagtcttgctctgttgcccaggctggagtgcagtggcacaatcttggctcactgcaacctctgcctcctgggttcaagcaattctcgtgcctcagcctcccaagtagctgggattacaggcacctgtcaccacccccagctaacttttgactttttagtagagatggggtttcaccatgttggtcaggctggtcttgaacttctaacctcaggtgatccgcccgccttggcctcccaaagttctgggactacaggtgtgagccactgtgcctggctaattttttcatttttagtagagatgaggtttcaccaagttggccaggctggtctcgaactcctgacctcaggtgttctgcccacctcggcctcccaaagtgctgggattacaggcttgagccaccgcgcccagctcattttcttttttgaacacatttgtccccatgcccatatcactgcaccagtctaccagtcattgtttgtttaataatgtcaagactttcttcaatgtgtgactctatgaagcaagttattgcaaatgtgaaagtatagtacattggttgcatctcatttctcttcatctgagttatgttgcatgaggcaaaatctgaaagccatattgtatactggccaggcatggtggctcacgcctgtaatcccagtattttaggaggccgagacgggcagaacacttaaggtcaggagtttgagaccagcctggccaaaatggtgaaaccccatctctactaaaaatacaaaaaattaggagggcatagtagcaggcacctgtagtaccagctacttgggaggctgaggcaggagaatcacttgaactcaggaggcagaggttgcagtgagctgagatggcgccactgcactccagcctgggcaacagagcaagactccttctcaaaaaaatttaaaaaatcatatcctttgaagaataggggaaaggaaccaaatagatggagtattactgtatactttttgggctttaaaccatgcgaatatattgcctattcaaaaaattaaattgtatgtattgaagatttattatctcaactgtataaaaactaaccagagacaacaagcttgaaggagcaatttgaaatattattacaattggttacctctgaagttgaggtgggaacatgggtgggctttttttttgttttttaattgagacagggtctccctatgttgcccaggctagtctcaaactcatgggcagcacaagcagtcttcctgcctcagcctcccaaagtgctgggattacaggcgtgagctgctgtgcccaggtgctatgcgatgttttctttctttctttttttttttttgtatgtgactagttatgagcatatataacttttgttttatataactctatttgtttttttacattaggacacaaaatcttctcagtatttaggtagttacgtactactttaatggtttcactgtagcacctctttggcccttgctttgctttcttttttgagacagagtctcactctctctcccaggctggagtgcagtggtgtgatcttggctcactgcaacctccatctgctgggttcaagcaattttccagcctcagcctcccgaggagctgtgattacaggcatccgccaccacacctggctaatttttgtatttttagtagagttggggttttcaccatgttggccagactggtctcgaactcctgacctcaagtgatccagccacctcagcctcccaaagtgctgggattacaggcgtgagccaccatgcctggcctggcccttgcttttttgatacagctgttccactttccatggcctttcttttcacctttcttgctcacttatcataaaccacatacattactcatttcttgtttttcaccttcagtctcttttgccctacactcacggcaacctctgcctcctgggttcaagcaattctccttcctcagcctcccgagtagctggaattataggcatgcatcaccacacccagctaatttttgtatttttaatagacagggtttcaccgttttggccaggctggtctcaaactcctgagctcaagtgatccacctgcctcggccttccaaagttctgggattataggcatgagccaccacgcctgatgatcttttgccctatactttctattagcccctaatccaagttgtttttagcctacaagttcacaggcccaattaataaacgagttgcagccattggacaagatgccattctgccaaccagataaatgacctaagctttattctgtatctaaaaacagggatgggcctcatgctggcttatagatctgcattttaggccaaaagtagtgtttgaaccttgaagtcctctgcatacttaaagggaacttttggctggcctggcgcggtggctcatgctgtaatcccagcactttgggaggccagtgtgggaggatcccttgaactcagtagttccagaccagcctgagcaacatagtgagacctcatctctataaaagattttttaaattagccaggtatggtagtgcaggcctgtagtcctagctacttgagcccaaaagatggaggatggcttgagcccagaagattgaaggctgcagtaagtattaattgcaccactgcactccagcctgggcgacagagtgagaccctgtttttttttttaaaaaaaggtggcttttggcttgattatagtgctaacttgactgtactgtaaaatatttaattgattttaattgattttctgggtttagggagaacattcagtgatgttaaagccccatagtactactccacttcattaacattgcagaaccctctatatttaatataagaaatgatactgcaaagtagacatccctgattaagtaacttgagataactgatcacttttgcatgtatttcactagtgtgtgctgagtagaaactaattaacactgtcttaaactttattatgttgttttcacaaagagcagcctttgttgactttgaaatcattgcttcagtattctagaaaatcttgtttttgttaaacatgggcagtaacttactatttttgtatagttgttgtcatcttacccccaccctgttttaaaaataaaaagtagttgtcagattactttggctttagaagtaccttttcacttgccttagaatcttcattactttgagcctacactccacctcttattggaacttcatgaagaatgatgttggatttcactctgtcacccaggctagagcacagtggtctgatcatggcttactgtacccttgacctcctgggttcaaacagtcctcccacctcagcctcccaggtagctgggactaggcatgtgccaccacacccagctagtttttttacttttttgtagagacagggtcttactatgtttcgcaggctgatctcaaactcttgggctcaacgatcctcccgcctcagcctcccaaattgttgggattacaggcatgagcaccactgtgcccagcccataaccatttcttttttttttttttttttgagatggagtctgttgcctcagcctcccgagtagctgggattacaggcacctgccaccacacccgaataatttttgtattgttagtaaagacggggtttcaccatgttggccaggctggtctcaaactcctgacctcagatgatccacccgcctcggcctcccagagtgttgggattacaggcgtgagccactacacccggccccccataaccatttcttatgtgaatctattctcctgccagaccaaactagttgccagtgccccaaacacgttgaataacttcacacctttatacatgctgtccttcttccaaacagactgtctttattcagtgtggtaggctcctactccttcaagatccagttcaaagcaaggcatggtggtgtgtgctatagtcccatctactagggagtctgagagaggaggactgtttgagcccaggagttcaaggcccattctggtaacatagcaagaccatctcaactccagctcagatactttctgtgatgccttcctaactctattctcactccaggaaaatgatttcttcttcattcctaccacagtacttcactaattagagctcttgacatttaacattgtagttacttatatataagtttgccctattcgtttgtctttttttttctttctttgagttggaagttttgctctgctgcccaggctggagtgcaatgacacaatcttggcttactgcaacctctgcctcctgggttcagttgattctcctgcctcagcctcctgaatagctgggattacaggcgcttgctaccatgcctggataatttttgtatttttagtagagacaaggttttaccatgttagacaggctggtctcgaactcttgacctcaggtgatccacctgcctcagcctcccaaagtgctgagattacaggtgtgagacactgcgcccggcttttatttgtcttattcatataacaacgtacttggcacatagtaggctatcaaacatgtattggaaaaagaaatcacttgtttctgtttaagcatccagataatctagatctcaataataaactaaaacaggaagacgagggaaagaagataagaaaggttagaaatcaccaaccctgggccgggcacggtggctcacgcctgtaatcccagcactttgggggctgaggcgggcagatcacgaggtcaggagatcgagaccatcctggctaacacggtgaaaccccgtctccactaaaaaatacaaaaaattagtcgggcgtggtggcaggcgtctagtcccagatactcaggaggctgaggcaggagaatggcgtgaacccgggaggcagaggctgcagcgagccaagatcatgccactgcactccagcctggtctgtgagaccctgtctcaaatcaccaactctggccaggcgcagtgattcatgccatttatcctagcacttcgggagaccaaggcgggctgattgcttgagcccaggagttcaagaccagcctgggcaacatagtgagaccctgtctcaatttaaaaaagagagagaaagaaaaaaagaaattactaactcttctttctatctgttcatgccaacttcatcactttgtactcttctttcaccttgcaggtggtgaggatccaggaaagccaagcgatgccatgttaaagaatggccataccacccccatagggaatgccagatcatctagtccagtccaagtagaggaagagccagtaagattagcaagtcttaggaaagctattccagaagaggacctaaagaaacgactaggtaagaaactctggatttttgagtttaagagccacgggccagttattctccttacataaggggtttgcaagagaacagggaaaagtgaaatctagagagaattacattctcctttaacaataccttaactagcaacttcaaggggaatttcctcccccaccccgcttttattcactaaatacctaaatttgtgatcctcaagaagggaagaggatgttaagtatcagatacctataggattttttccagctacacattccacttctttcacccaaggaattttgttgtggctctcctccagtagcctggcccttgtgtgaagaatcactaccacaatgagcatctcttagtgagcctttcttactgacatttcttaagtatggggaggttgggaggcattgagaatggtaacctataagctaatctataaattaattggtgaaattggccacaaattcatagatgtgttagctttttcagtttctcttgttactctctcttccctttttataccatacatgttattacacaggctcaactggaagccagcctaattctgaagcagagtctgttcctgagaatgtacccaaaccacctttacttcctcccaaaagacccttgtcctcttctcatgaagcaagtgaagggcaagcaaaggatgccacttcctctggcggcacggcaaggttcatcatctccacctccatcaccacagcacccgctgccaccactgctgccacaagccttgcaaagactgttaatctctctgtcaccccttccccagcacccaggactctgcctgctgctcctgccagcactaacactactgctaccccaagcctcactcatatggtccctgccaagcagccccctatccctccccctaaaccagctcacagaaatagcaaccctgtcattggtaagtaagtctttaggcttccagtgttttgggtttggtttgatgttggatggttattttatttgataactggtacaacattgatttggtctgtgagaattttccatatcttgtccctttgaatgacctcaatatggagaaaagtcttaggttaagaaaaaataggccaggtgcggtggctcacgcctgtaatcccagcactttgggaggccgaggtgggtggatcacaaggtcaggagattgagaccatcctggcaacatggtgaaaccccatctctactaaaaatacaaaaaattagccaggcgtggtggcacgtgcctgtagtcccagctacttgggaggctgaggcaagagaattgcttgaacccaggaggcggaggttgcagtgagccaagattgtgccaatgcaccccagcctaggcgacagagagagactccgtctcaaaaaaacaaaaacaaacaaacaaaaaaagtcatgaaactgaggcagatggccataaatgtaaacatcactaagattagatttaagttttgggggttttaacctattttttaatctaatatttaatctgtttttctaaaacaatgattccaaaacactatacatatttgtgtgtgtgtgtgtgtgtgtgtgtgtgtgtgtgtgtgtaattggactggatatgtgaaaaccataacagattccacctgcatggaattatctgtggcacttgctgaaaaattagaataatgcctcagctcacaaggggcaaggcaaacttttcaaatgaaaatttttaaatctacttaaaactacctatgccttccataagcattaatgagtctagtagataaaaggatgattctgtagatgccagtggaatttgggattcagtgtctggcatagttatcttcacagggaactgcagaagctattacttaaattgttctgataaaatcatgttttatcttgggagaattaagaatgctattcttatgttaaaataagtgatggtagagaaagcagggaatataatcagtaaaatttgtatgggtttagtaaattttttgcatttacccaaagttctatttaagtctactttctttatataaatgcacaatttcttagaagaattttcaagaaagggagaggaaagctaatgagtgcttcaaagctaataaaaatatagttttttcaggaaaaatgatactaggcttagtattgcttaaagttcttgttcacgattgaacgaatgaataaaaactatactcattaaatatttaatatcaccatgttgggtggagtgattcaaaccttgaaaaacaggcttagaatattttatgagtatgacagtttggagtagcttgatgaaaacaggatgaagttgttattaccaccactttggatggatagtgtcatgttgacttatctgtgaggaacttggggagctttcacatacttattttcaaaactaccttgtgctgcaggaaaccaattttatcttttccataggtagggcaattagaacatgaagacattgtgactcattcaaggttgtaggccaggcgcagtggctcatgcctgtaatcccagcactttgggaggcagaggcgggtggatcacctgaggtcaggagttcaagaccagcctggccaacatggtgaaacgccatctctactaaaaatacaaaaaattagccgggcatggtggtaggcacctgtaatcccagctactcgggaggctgaagcaggagaattgcttgcacgtgggaagcagacgttgcagtgagctgagattgtgccactgcattgcagcctgagcaacaagagcaaaactccatctcaaaaaaaaagaagaaggttgtagttagtgaaagatagaaactgaacataggcttttcaactctcaggtccagacctctgttccttacagtagtgtttgcaaactggtgttctcctcaggatcacctagaaagcttatgataacagactgctggacactacccgtagagtttctgattttagtaagcctgggatgggcttgagaatttgcctttctaataggttcccagatgacactgatgctgctctccagggagcacacattaagagcctctgctctacaccagtggcataccacccttttcaagttaaggcaacatataaaatgataatttgtgtatgataccctggactaaactgcagagctcattcttagcttgaggtaaatagcccaaaacaatagaccttgtaactgaggaatcagtattagtccatgaggggtcctcaacaaaagaagaaaaatagaacagttcacagagcatttcttagagctaaatagatttaatttaaaggactctcttttattctaaaattacaaccttcctaatcctttggtgttaaaatgccatttctttcacaaaaggattatgatcataaatggtttacttaatatcaagccttatttggaaatcttagaaaatgacaacctcaaaaaaacactagaaaaaaaaccaacaatctgaggttgatcaagatttttgttattgttttggtcactgaaatccaaaagtttggaaatcattgcttcagaagtactactgtcttctcatccatataacatggagtattacgactaaggaaaaaccaccagcaatagctgaacgggtgaaagggaattattacccatcccagaaacactctgaaatttttccacagaactacagccagatgctgttgtcagggtatatataccagaatttacttccttaacatatatgccttcctcaaattaccaaatagaatttattttattaattcaaaagtaaaaatattcatttatggtctcatcaggaatgagttttgttgtagatggaatagctaacagctatttttagagaatcagcaaaaatccaatctttccaaaaatatctctttcactgctcctaaaattcacatttttagaatctttttgtgtgtgtatgcagtgtttttctagaaagccttttttaaaatttatttatggggccaggcatggtggctcatgcctgtaatcccagcacttcgggaggccgaggtgggcagatcgcttgaggcccagagtttgagaccagcctgggcaacatggtgaaaccccatctctactaaaaatacaaaaaatgatctgggtatgatggtgcatgcctataatcccagctactcaggaggctgaggcaggagagaatcacttgaacccgggaagtggcggttgcagtgagccaaaattgcaccactgtactccaacctaggcaacagagcgagactctgtctcaaaaaaaaaaaaattatttatgatgagagacattaaaacattacaaaattaggccaggcacagtggctcaatgcctataatcccagcatttggggaggccgaggtgggaagatcacttgaggccaggagttcaagaccagcctgagcaacgtagcaagaccccatctctataaaatatttaaaaattagctgggcatggtgacatgtgcctgtaattctagctacttgggagattgaggtaagaggattgggtaagcacaggagttcaaggctgcagtgagttatgattgcaccactgcactctagcctgggtaacagagcaacatcctgtctctaaaaaaaaagaaaaggctaggtacagtggctcacacctgtagtaccaacactttgggaggctgaggcaggtagattacctgagcccaggagtttgagaccagcctaggcaacatggagaaacccatctctacaaaaaataccccccccaaaaattagccgggcatggtggcacatgcctatggtcccagctacttgggaggctgaggtgggaggatcacctgagcccagggaggtcaaaattgcagtgagccgtgactgcgccactgcactccagtgacacagtgtgagaccctgtctaaaataaattaatttaatttaaaaataaaaataaatttaaaaagaaaagaggctgggtgtggtggctcacatccataatcccagcactttgggaggctgagataggtgtatcactggagcccaggacctcaagaccagcctgggcagcatagtgagaccttgtctctactaaaaattaaaaaaattagtcaggcatgggggcatgggcctgtagtcctagctacttgggaggctgtagcaagaggatcacttgaacccaggagatcgaggctgcagtgagctattgttcatgccactgcactccagtctgggcaacagagggagaccttgtctcaaaagaaaaaaaaaaaaagaattataaaattagctagccttggccgggcaaagcggacatgcctgtaatcccagcactttgggaggccgaggcgggtggatcacctgaggtcgggagttcaagaccagcctgaccaacatggagaaaccccatctctactaaaaatacaaaaaattagccgggcgtggtggcacatgcctgtaatcccagctactcaggaggctgaggtaggagaatcacttgaacccaggaggtggaggttgcagttagccgagatggcgccattgcactccagcctgggcaacgagtgaaactccatctcaaaaaagaaaaaaataattagctagccttttactttgaacatctccaattttggagatttaggacaaatacagttttatttaagggaagtttttgagagtgtttgagaatactgagtgggatgaaactaaagggtttgagtagaaggttagaggttggtgatcaaaagaactactttttttttttttttcctgtcagcagggaaaaaataactaccctttaattactttaccagttttactcctgtgtgatctgatgatccacttcttacaggtcatctggagccctccaaagggactttgctgaaacaacaccaacacctttgctgagtcattgtgggctttggtgaaactataggaatatatactgtcatgatacagggtgaaggcttctcatctaataaacatatattgagggtccactagatgccaggtactgtgcacagccctgtggatgatatgttgatggagacaaggttgccctgccatcaaggagcccatgatatagtggagagtgaacatgggaagctgaggtgcaaagggaacataagaggtgtgcataccaataaaaattagagacagtaggccgggcgcggtggctcacgactgtaatcccagcactttgggaggccgaggcgggcggatcacgaggtcaggagattgagaccatcctggctaacatgatgaaaccccgtctttactaaaaatacacaaaaaattagccgggagtggtggtgggcgcctgtagtcccagctacttgggaggctgaggcaggcgaatggtgtgaacccgggaggcagagcttgcagtgagccgagatggcaccactgcactccagcctgggcgacaagactccgtctcaaaaaaaaaaaaaaattagagacagtaggatgcagtcaaatagtcagagacttggataccagctgagtccatgccagtttgtagtatgatcttgggcaaagtcacctagcttctgtggccttgccttttccttctgaaaaatggtaaagatgctatattttttcccctgtcacctcaggtggtataaggagaatatgacttcaaggacaaaaaacactttgatttcttcaaaggactttgcaattgctataaaaattcaagatgtcagtattgacagttttataacacagagctaagatatctagataccattatcaggatatggtaacaatacccactaatacttattttatgctatctgaatgtttaaattttttaatggagtactgttatacaaaataacttttttttttttgagtcagagtcttgtgctgtccagcctggagtgcagtggcatgaccttgactcactgcagcctccgcctcccaggttcaagagattctcgtgcctcagcctctcctgagtagctgggattataggtgcccaccaccacacctagctaatttttgtaattttttttttttttttttagtagagacggggtttcaccatgttggccaggctggtctcgaactcctgacctcaagtaatctgcccacctcggcctcccaaagtattgggattacaggtgtgagccaccgtgccagccacaagataactttttatcagattttttttgtctctattcatattaactacaccaagatcaagttacaaaaagttgtcagccgggtgccatggctcacgcctgtaatcccaacactttgagaggccaaggcaggtggatcatttgaggtcaggagttcgagaccagcctggccaacatggtgaaagcccgcctctactaaaaatacaaaaattagccgggccgtagtggcgtgcgcctgtaatctcagctacttggtagactgaggcaggagtatcgcttgagcccgggaggcagaggttgcggtaagccaagatcgcgccactgcactccagtctgggcgagagagtgagaccctgtctcaaaaaaaaaaaaaaaaaaaaaattgtcatatctgttgccatagcaatgaagtaagctactcatcagtcttcctacacctctgtacatttattaagccttctatttgaataaatataaacttcatttcaggataaaatatatagggaatggcaaaactatgaaattatttaacttgcttaaaagattaaaactgaactcaactttaattctaggccctgggccggcccttcaaagcattggaaagtcgtgaaattgatgtgttgctctctcttttccagctgaactgtcccaagcaataaacagtggtacattgttatcaaaaccgtccccacccttaccacctaagagaggcattccatcaacctcagtacccaccttggagtctgctgctgccatcaccacaaaaacaccaagtgatgaaagagagaagagcacgtgttctatgggctcggaactactaccaatgatctcacctcgctctccgtcccccccactgcctactcatatacctccagagcctccacgcacccctccattccctgctaagacttttcaagttgtgccagaaattgagtttccaccatccttagatctacaccaggagattccccagcaggaagatcagaaaaaggaagtccccaagaggatactggaccagaactttggggagccccatataccctctaggctgcctccactcccactgcatattcgaatccagcaggccctcaccagcccacttcccatgactcctattctggagggttctcacagagctcattcgttgctttttgaaaacagtgacagcttttctgaggacagcagtacgctgggtcggaccaggtctcttcccatcactattgaaatgctaaaagtgtaagtgcctttaaagcttgcctcttatttctcctttactctagatagccctgcttggaaaaaattacttataaaaagaaaatgtgggccgggcctagtggcccacacctgtaagcccagcactttgggaagctgaggcaaatggaccgatcacctgaggtcaggagttcaagaccagcctggccaatacagtaaaaccctgtctcgatgaaaataacaaaaattggccaggcgtggtggcacatacctgtaatcccagctactcgggaggctgaggcaggagaatcgctttaacagggaggtggaggttgcagtgagccaagactgtgccactgtactccagcctgggcgacaaagcgagtctctgtctcacagaaaaaaagaaaatgtgaataatttttttttttccgagatggagtcctgctctgtcacccgggctggagtgcagtggcacgatctccgctcactgtaacctctgccgcccaggttcaagcgattctcctgcctcagcctcccgagtagctgagactacaggcatgtgccaccacattcggctgatttttgtatttttagtggagatggggtttcaacatgttggccaggctggtctcgaactcctgacctcaggtgatccacctgcatcggtctcacaaagtgctgggattgcaagtgtgagccaccgcgcccagcattgtgaataaatttaaagtacaaagaatactctgccaaaagaataagttatagaatttggactctttctttttttaatcttaccttaaaactttatttttatttatttatttatttatttatgtttgagacaggttctcactctctcactcaagctggagtcagtggtgcagtcttggctcactgcaacctccatctcctgggctcaagcaattctccctcctcagcctcccgagtaactgtgactacaggcgcatgccatcacacccagctaatttttatattttttgttagagatgggattttgccatgttgcccaggctcaccctgaactcctgggctcaagcagtctgcctgcctcaacctcccagaatgctgggatcatgggtgtgagccactgcgcctggccaaattttgattttttactcttgtgattttttttttttcatggagatttttgtgatgacacaaaatttacaaaattatgtacatgaaaaattacaaccgctagttttatatactacagggaaggcattgtataatgttgtgcttaagagcattcaccttggagtgagatagccctgggttcaaattgcagcactaccactcttagcttatagtagtgttaagttactgaagccttctgctctttagttatatcatctctaaatgggaataatatttactctgtaggcttgtgagaatgacattagacaaattctggaaagcaccagtgcctaataagtggtaaagctgggatctgaacccttagattaatacctgctaaaaagtttcttagtaagattgttaaagttaagggagagaattaattataagttacttcatccatagatttttttgtatttatggttatttcagtcctttgtcttttttttttttttgagatagaatctcactcttgtcacccaggctggaatgtagtggcacaatctcggttcacttcaacctctgcctcctgggttcaagagattctcctgcctcagcctctcaagtagctgggattacaggcacctgccaccatgccaggctaatttttgtatttttagtagacacagggtttcaccatgttggccaggctggtctcaaactcctgacctcaggtgaatttgcccacctccatctcccaaagtgctgggattacagccatgagccaccacgcccagtctttatttcagtcctttgtcttaaaagtcagttatcctcttcatttctaaaaggaaaatataattatgttaatttgttagtccagacgatgaagaagaagaggagcaaacctgtccatccacattcagtgaagaaatgacacctacctcagtcattcctaaattaccacagtgtctacgggaggaagaagagaaggagagcgactctgattcagaaggtcccattcagtaccgagatgaagaagatgaagatgaaagctatcagagtaagaaagggagggaaaagcaaaacagagaattcttttccagataaaactatttgctgatcttagcaagtgtcaaaagagatatggaaacaggtaccttctcccattaagtcatctggctaactgatgttggaagccactgtgaaggactccttgtccctattatcacccctctgttaaaacaagccaagacagggatccaagtagattgagtcactcaggttttaggttttttgtttttttttgttttaatttttttttttttttttggacaaggttttgatctgtcacccagctggagtacagtggtgcaatcgtcgctcactgtagcctccaactcctggacttaagtgatccttacgcctcaacctcccaaatagctaggacagatgtgtgccacaactggttaggtttctttgattttttgttttgttttttgtttttgtagagacagggtctcgttaggttgcctagcctgttctttttttttttttttgagacggagttttgctcttgttgcccaggctggagtgcaatggtgcgatctcggctcagtttaacctccacctcccaggttcaagcaattctcctgtctcagcctcccaagtagctgggattacaggcatgtgccaccacacctggctaattttgtatttttagtagagatggggcttcaccatgttggtcagactggtctcaaactcccgacctcaggtgatctgcctgcctcggcctcccaaagtgctgggattataggtgtcagccaccgtgcctggccataaaagatatatatataattttttttttttttttagacagagtcttgctctgtcatccagactggagtgcaggggcacgatctcaactcactgcaacctccacctcccgggttcaagcaattctcctgcctcagcctcccaagtagctgggattacaggcgtctgccactaggcccagctaatttttttttatttttagtagaggcggcgcttcactgtgttggccaggctggtctcgaactcgacctcgtgatccgcccacctcccacagtgctgagattataggtgtgagccactgtgcccagctgcccaggctgttattgaactcctgacctcatgtgatccccctgccttgacctcccaaagctctaggattacaggcatgagccaccgtgcctagcctatttttaatttttatagatatataatagtaatatatatttatggggtacatgagatattttgatataagcatgtgtgtatgggtaattaggctatccatctcaagcacttatcatttgtttgtattgggattattccaaatctacctttctggttatcttgaaatatacaatgaattattgttaactatagtcaccctattgtgccaccgaacactagatcttattcctttttttttgagacagtgtctcactctgcaggctagagtgcagtggcacaatctcagctcaatggaacctccacttcctggctcaagcaatgctccaacctcagcctcccaagtagctgagaacacaggtgtgagccaccacgcccagctcatttttgtatttttttatagagacagcgtttcaccatgttgcccaggctggtctcgaacttgtgagctcaaagtgatctgcccacctcagctcccaaagtgctgcgattacaggcatgagccaccacgcccggcctagatcttatttcttctatctaattctgtttttatacccattaaccagtctctctctcccccatcccctctacccttccctgcctctggtaaccaccattttatttattacctccatgagatcaacttttttagctcccacgtaagagtgagaacatacaacatttatctttctgtgcctggcttatttcacttaacgtaattgtcctccagttccatccattttgttgcacataacaggatttctttctttttcatggcagaataatcttcaattgtgtatatacaccacgttttctttatcccttcatttattgatggacatttagtctgattccatatcttggggattataaatagtactgcaataagcatgactgattgatttgctgatttcctttcttttggatatgtacccaacagtgggattgctggatcgtatggtagttctattttttttttaatagacggaggctcactctgtcaccaggcaggagtgcagaggcacgatctcagctcactgtaacctccgcctcccaggttcaagcgattctcctgcctcagcctcccaagtagctgggattacaggtgtgtatcaccatgcccagctcattttagtttttgtttttgtttttgtttttgtttttttagtggagacagggtttcaccatattggctgggatggtcttgatctcttgacctcatgatccacctgccttggcctcccaaagtgctgggattacaggcatgagccaccgtgactggcccggtagttctatttttaagggtgttttgtttgttttgttttgttttttaagtagagacacagtcttgctgtgttgctcagactgatctgaaactcccagcctcaagcaatcctcctgccttggcctcccaatgtgctgcattacaagcatgagccacctcatttggcctattttcagttttttaaggaacctccatagtgttttccacaatggctgtactaatttcaggtttttgtttgcccccaattttaaaactattcacctaagtgcctctaatcccagcactttgggaggccgaggccggtgaggtcaggagcttgagaccagcctggccaacatggtgaaaccccatctcttctaaagatagaaaaaattagccaggcatggctggccacggtggctcacacctataatcccaacactttgggaggccgaggcaggcggatcacctgaggtcaggagttcgagatcagcctggccaatgtggtgaaaccccatctctactaaaaataaaaaattggctgagcatggtagcaggcgcctgtaatcccagctactcaggaggctgaggcaggagaattgcttgaacccaggagacggaagtcgcagtgagccaagactgtgccactacactccagccggggtcacagagcgagactctgtcgcaaaaaaaaaaaaaaaaagccaggcatggtgacaggcacctgtaaccccagctactcaggaggctgaggcaggagaattgcttgagcctgggaggcggaggttgcagtgagccgagatcttgccactgcactgcaacctgggcaacagagcaagactccgcctcagaaaaaaaaaaaaaaaaagaggccaggcgtggtggctcacgcctataatccctgcactttgggaggccgaggtgggtggatcacctgaggtcaggagttcaaaccagcctggccaacataacgaaacccgaaacccggtgtctactaaaaatacaaaaaattagctgggcgtggtgacccacgcctataatctcagctactcaggaggctaaggcaggagaatcacttgaacctgggaggcggaggttgcaatgagctgaaatcgtgacactgcactccagcctgggcaacaagagcaaaagctctgtctcaaacaaacaaacaaacaaaaaaaccaacaacaatatggagtagaggaaaggtggcacatgggctaaggtgaaaagataaaagtgatgttttccctttggtctaatgaacttattgccacagggcagagaaaaataaacattttcataccctcacatctttgcaaataattgagtcctgattaattgaagtagaaaggcagctttaaaaacagatagactatgaggtgttagtatgaaagcctttatgttttaattcagagggctgtcccatgcttagattctctctcctgtagcaactcttaccaaggaggaaaaatgtagaggcctgatagaagagaaaagataccttttaaccatcttagtccacctggctaaaaagatttttaggtgtctttagctttacccccacctcagtgttcagctggatcatttgaggccaggtgggaactgggaattaaatattgtatttgttcagactcttgactagctccaggtaaggttgaacctttggctttaagcctcaagttctacatttttttcttccccgtgtgcaaaggtgctctcgccaacaaagtgaagaggaaagacacactggcaatgaagttgaaccacagacccagtgaaccagagttgaacctgaattcttggccttgtaaaagcaaggaggagtggaatgaaatacggcaccagattggaaacacactgatccggtaggcctttgcttagatttgcttgattgatttggttatgccagtatttgtgttagatgttgttagatgtgttgtttttttgtgtgtgttttgtttcgttttctgagacagggtcttgctctgtcacccaggctggagtagtggcgcgatctcggctcactgtaacctccacctcccaggttcgagcaattctcctgcatcagtctcctgagtagctggcgttataggcacctgccaccacgccaggctaatttttgtattcttagcaaagacagcgtttcgccatgttggccgggctggtctcgaactgctggcctcaagtgatcacccaccttggcctccacaagtgctgggattacaggcatgagcccctatacctagtctatatgtttactttgttgtggagtattcatttatcttttttagtgtgatttttttttcttttcagacagagtcttgatctgtcacccaggctggagtgcagtggttcaatcatggctcaccacctccaactcttgggttcaaggcaccctcccacctcagcctcttgactagctgggtcctcaggcatgcgccaccatgcactgctaatttttgtaattttttgtagagacagggtctctctgtgtttcccaggctggtctcaaactcatggcctcaaacattcctcccacgttgccctccgaaagtcctgggattataggtgtaagccaccacacccatcactttgagtataattttaaaaaatacatattgggttttgcatgaaaggagagaaggttagcactccacttgacaaggatggaagaggccctttgggcctgacaacacacatacaaggcattgccacctactacgtggcatctaactatctttacaaaaaaagaaaaagaaaagaaaagaggctgggtgcagtggctcatgcctgtaatcctagaacttcgggaggctgaggtaggcagatcatctgaggtcaggagttcaagaccagcctgaccaatatgatgaaaccccatctctactaaaaatacaaaaattagccaggcatggtggcatgcgcctatagtcccagctactcgggaggctgagatcggagaattgcttgaacccaagaggcagaggctgcagtgagctgagatcgcgccactgtactgcagcctgggcaacagagtgagactccatctaaaaaaaaaaaaaagaaaagaaaagaaacaaaaaaatatatattggacacagttgggtatcctctaagaatttggaaattgaagatgtagctgcctgtgagagttttattttatttattttatttttgagatggagcctcgctctgtcacccaggctggagtgcaatggtgcaatctcggcttactgcaacctctgcctcccgggttcaagtgcttctcctgcctcagcctcctgagtagctgggactacaagctcataccaccacacctggctaatttttgtatttttagtaaagatggggtttcaccatgttggccaggctggtctcgatctcctgactcaggtgatctgcccgccttcgactcacaaagtgctgggattacaggtgtgagccaccacacctggccagcctgtgagagctttaaaccatgagatagacatatggttttgcaaaagtttctacataaatcagaatggttcccagaacagaaaggctcctctgtcactttttttatctggttgcttaaccataagatgccaacccaattaacagtcacacccatatttgcattatatctgtttcatatgttccgtgtaactgcctcctttcaaagtgttggtatatttttcaagtcaactggaaccaaaagtatagagaaactgaatgcaagccagctttctgcatatgtaacagtgtaagaatccaggttgtatagatgggtttttgtttgacacagatgtttctcccagtaaagagaggataaggagctggaactcgtggcacagttccctacaaaataattaattgatcatgtctactaattaaaatttctttttctgtactattgcagatacctggttttggctgggcaaggtggctcacacctataatcccaacattttgggaggctcacttgaggtgggaggctcacttgagcccaggagtttcagagcaacccgggcaacaaagtgagatcccatctgtacaaaaaattaaaaaattagctgggcatggtggcacatacctctagtccagctattctggaagcttaggtagaaggatcacttgagcctgagagatcaaggccgcagtatgctgtaattgcaccactgcactccaccctgggtgacagagcaaaaccctgtctcaaaaaaaaaaaaaaagagacacctggctttactgtgtatgctgtacctcagggcaagttttccctttgtcttctaatagacactttttggatccagaaattgttctctgcaatttctttacttaaacataattatcagcctgtatgacctctgtggtctgactactttgaaattaagggagaaggctgggcacggtggctcactcctgtaatcccagcactttgggaggctgaggtgggcggatcacttgagcccaggagttcgaggcaacatgacaagaccctgtctcgacaaaaaaacaaaaaacttagccagacatggtgacacacgtttatggtcccagctactcaagaggctgaggcagggggattgcttgagcccaggaggggctcaaggtcggcccaggaggtcaagacccaggcgatcaaggcccaggaggtcaagactgcagtgagctgtgctcatgccccactgcactccagcccagtcatcagagcaaaaccttgtctcaaaaaaaagtaaagaaagacatgtttattatatggtagtttgaaaaattacaaaaaaaagagataaatcatggccggacgcggtggctcacgcctgtaatctcagcactttgggaggccgaggcgggtggatcatgaggtcaggagatcaaggccatcctggctaacacgatgaaaccccgtctctactaaaaatacaaaaaaattagctgggtgtggtgctgggcctgtagcccagctactcgggaggctgaggcaggagaatggcatgaacctgggaggtggagcttgcagtgagctgacatcgtgccactgcactccagcctgggtgacagagcaagactccgtctcaaaaaaaaaaaaaaaaaaaaagagagagataaatcagccataatcctataccctataagccaggatttggcaaacttcttctgtaaagaaccaaatagtaaatattttaggatagggtgcagtggctcatgcctataatctccgtactttgggaggccagtgtggaagaattgcttgaggccaggagtttgagaccagcctgggtaacatagtaagactctatcactacaaaaataaaaataggtcaggcacagtggctcacacctgtaatcccagcacgtttgaaggccgaggcaggtggatcacatgagatcaggagttccagaccagcctggccaacatggtgaaaccccatctactaaaaatacaaaaattagccaggcgtggtggcgcccacctgtaatcccagctactcaggacactgaggcaagagaatcacttgaacccaggaggcagaggtttcagtgagctgagatcacaccatggcactccagtctggacgacagagtaagactccatctcaaaaaataataaataaaatagccaggcatggtagcatgcccctgtagtcctagctacgtgggaggctgtggcagcagaactacttaagcccagtagtctatatactagacagggcataaatatagttatatttaatatatttaatatatgtgtgtatgtgtatatatatgtgtgtatgtgtatatatatgtgtgtatgtgtatatatgtgtgtatgtgtatatatatgtgtgtatgtaatatatatgtgtgtatgtaatatatatgtgtacgtgtgtgtatatatgtccatatatatatatggatttgatggccatataaactctctctttttttttttcctacctttaaaaatataaaaacatgggtcgggcgcagtggctcatgcctgtaatcccagcactttgggaggccgaggcgggtggatcacgaggtcaggagacagagaccatcctggctaacacggtgaaaccccatctctactaaaattacaaaaaatttagccgggtggtggcaggcacctgtagtcccagctactcgggaggctgaggcaggagaatcgcttgaacccaggggacagaggttgcagtgagctgagttcacaccactgcactccagcctgggcaacaagagcaaaagaaactccgtttcaaaagaaaatatagtttatacatacagtggaatattatttaatcttaaaaaagaaggaaatcctccaatatgctaacaacatagtcaaaccttgaggacattaatatgagtaagccagtcacagaacaataaatactgcatgattccacttctgcgaggtatctgaaatagtcacatttatagaagcagagagtagaaagatagttgtcaggggctcgggattgaaggcaggggtgatagggagttgctaataaataagtataaagttttagttatgcatgatgagtaagttctagagatccactgtacaacattgtgtttatagttaatactgtagactgggcgcggtggctcacgcctgtaatcccaacactttgggacaccgaggcaggcagatcacgaggtcaggaggtcaagaccagcctggccaacgtgatgaaaccccatctctactaaaaatacaaaaattagccgggtgttgtggcaggcacctgtaatcccagctagtcaggaggctgaggcaggagaattgcttgaacccgggaggcagaggtttcagtgagccgggatcccgtgccactgcactccagcctgggcaacagagtgagactctgtctcaatcaatcagtcaatagttaatactgtattggccaggtgtggtggctcatgcctataatcccaatactttgggaggccgaggcaggcgtatcacgaggtcaggagttccagaccagcctgaccaacatggtgaaaccccatctctactaaaaatacaaaaattagccgggtgtggtggcgcatgcctgtaatcccagctactcaggaggctgaggcaggagaatcgcttgaacctgggaggcagaggttgcaatgagccaagatcacgccactgcactccagcctgggcaacagagtgagactctccatctcaaaaaaaataataataatactgtattgtacacttaaaagtctgttcaaaaggtagatctcatagtaagtgttatcactataaaataagattgaaatttaaaaaaacacacacaataagagaccaccacgagtacactaggatggctaaagttatgcaatttaaaagactgacaaggccgggtgtggtggctcacccctgtaatcccagcactttgggaggccgaggcaggcagatcacctgaggttgggagttcgagaccagcctgatcaacatggagaaacttcatctctactaaaaatacaaaattagctgggcgtggtagcacatgcctgtaatcccagctacttgggaggctgaggcaggagaatcacttgaaccggggaggcagaggttacagtgagccaagatcgggccactgcactccagcttgggcaacagtgcaaaactctgtctcaaaaagaaaggaaaggaaataaatacaggagtgatatgttcattcttgcaattgtgatgatgatttcacaggtgatatatggcaaaagtggccaaattgtacatgttaagtatgtacacagttgtacatatttacagtattattgtgtcagttatatcgtattaaagctggtttgttttttgttttttgttttttgtttttccgaagaacatttaaaaaggaaggcccaggccaggcatggtggctcatgcctgtaatcccaacactttgggaggctgaggtaggaagatcacttaacgtctggagttcaagaccagcctgaccaacatgctgaaaccccatctctattaaaagttagctgggcctagtggtgcatgcctgtagtctcagctactcaggaggctgaggcagggcaatcacttgaacccaggaggctgaggttgcagtgagccaaggtggcgccagtgcactccagcctgggcgacagagtgagactctgtctcaaaaaaaaaaacaggaaggtccagctgggtgtggtggctaacatctctaattccagccctttgggaggctgagctgggggaatcacttgagcccaggaatttgagaccagcctgggcaatatggcaaaactccatcactaccaaaaataaaaaaattagccagcccagtctctaaataaataaatacatacatacatacatacgtactttttaaaaaataaaatggggcggggcacagtggctcacgcctgtaatcccagcactttgggaggccgaggcaggcggatcacaaggtcaggagattgagaccatcctggctaacacggtgaaacgccatctctactaaaactacaaaaacttagccgggcatggtggcacgcgcctatagtcccagctactcgggaggctgcggcaggagaatctcttgaacctgggaggcggaggttgcagtgagccgagatcaagccactgtattccagcctgggcggcagagcaagattctgcctaaaaaaaaataaaaataaaataaaaataaataaataaaatggaagatccttgaggtaggaggatcatttgagcctaggaggtggagctgcagtgagctgtgatcgcaccactgcactctagcctgggtacagagtgagaccctgacacacacacaaaaaaaaaaaaaaaaaaaggaaggtcttgttcagaaagaaaagttgtatatagaatgggactggaagttccttatgcaagcaacagaagagttgaaaattttgcaagtactagctaattagcccaaatactgtctgagaagtataaattaaaagtaagaaatgaataactttctgatttcaaaaatgacaaattgtagttttttgttgttttttttttttttttttttttttttgagatggaatctcactctgtcgcccaagcaggagtgcagtagcatgagcttcagctcactgcaacctccatctcccaggttcaagcattctcctgcctcagcctcccgagtagctgggactacaggagcacgccacaacatccggctaatttttgtatttttcagtagagacagggtttcaccatgttggccaggctggttttgagttcctgacctcaggtgatccacctgcttcagcttcccaaagtgctggggattacatgcatgagccaccacacctggccaacaaattgttattggtgaataacatctcagaactgtgatgaggtgagataactttatcaaatgcttcacagagaagactgagatttaaatcatagaattatagaatatcacacagaaagagacaaacttaaattccagtggttcctaaaccactgatttaaaaacctagctgggcatggccaggcgtggtggctcacgcctgtaatcccagcactttgggaggccgaggcaggcggatcacaaggtcaggagatcgagaccatcctggctaacacggtgaaaccccgtctctactaaaaatacaaaaaattagccaggcgtggtggcaggcgcctgtagtcccagctacttggaaggctgaggcaggagaatgtcatgaacccgggaggcggagcttgtagtgagccgagattgcaccactgcactccagcctaggtgacagagcaagactccatctcaaaaataacctagctggacataatggcttgcgcctataatcccagcagtttggggggccaaggcgggaagatagcttgagcccaggaggagttcaagactatcctgggcaacagagtgagaccctcatctctattttcaaaaaattgtaaaaaaaaaaaatctaaagaggggcatctgagtcatagaagaagttttgtgaaaaaaaaaatctatatatagatatatgtaatttcatttttcatcctgattttctgaatcagaatttctgttaacgtttcttgggaatctgtgttttctaaaaagtctctaatgcttctgaaggagcaaatttgtttaggagccaccagttcggtccaaaccttcgcttcacggatgaggacactcaaggtctaactgaacttttttgtgctaatagctcttatcaaggtctagaactagaatcctggccacttgtttgcatatacagttcctttttataatgtgatatctgtgttaacacttttaatgtgaaattgttttataaacaatcataaataaatgaaatatatcagtttgaaaatttgttgatttcttacttatataggggctaatatatactgtgaccaaaaaaatctttataaacaagattgggaggtttaacataaacattacctttatttatctcatttttaggcgactgagtcaaagaccaacaccagaagaactagaacaacgcaatatattgcaacgtgagtccagttatggaaataaagttgtatagattttctttgtatgtttctgactttaatatacataaaagaaaaaagaagcgtttgctacaagggctaagggagagtgttccagccaggcaaggactatttatttccccatgaaggaacagagcttaccaagcttcctttggaagatgctattatggtattgtttagtgtgctgtgatactctagaaagctttgtttcagtgttctcactgtatcctggaactgccttgggcatttgggaggctttgacagtatatgggagatgtgcccaatttttctgttttcagggagctaaggaggtagctgtgcatatggagaccttcctattcctagaatgtgagggctggggcccaaagcaagtcccaaatgcagcagcttttctcttggtttaatcccttaagactttcttacctctgtagttaccaaatgggaccatatatttaatttgctgtctgtgtacataattaatttcctgaaatagcattctaatctagtacatatttcatttgtttttccagaatatagagtgaaatttggccttaaaagtctcctcactgagaaggtttgggcttccttggggctatttgtgagcatgttcagtctgaccaatccatcccctgttctctcagcactacttgggtatacacaacttaataacttagtacattttctagtgtgggagcccttataacgtatcacacaaaactcagtgtgatcaccattgtccattcttagcagttactcttgagcaagaatctgcaggcttttccttaaagcatacatagtaaacattttgggttttgcaggccaaaaagcaaatgaacaactatacgtaataggtccttacaaaaccatttaaaaatgtgaagactattcttagttcatgggcaggaaaaatacaggcaactggcgagatgtggtgccatagtttgctgactcttgcttttaagtatttgtatcgttgacaagaaaattgttttgtttagccatccccaaagttagtattttattctgatttgggcctataagaaatatctgggccgaggcgagtggatcacaaggtcaggagatcgagaccatcctggctaacatggtgaaaccccgtctctactaaaaatacaaaaaaattagccgggcatggtggcgggcgcctgtagtcccagctactcgggaggctgaggcaggagaatggcgtgaacccgggaagcggagcttgcagtgagccgagattgcgccactgcactccagcatgggcgacaaagcaagactccatctcaaaaaaaaaaaagaaaaaaaaagaaatatctgggctgggcacggtggctcacgcctgtaatcccagcactttggaaggccgaggcgggtggatcacctgaggtcaggagtttgagaccagcctgaccaatatgatgaaactctgtctctactaaaaatacaaaaatcagctgtgcatggcatgtgcctgtaatcccagctactcgggaggctgagacaggagaatcgcttgaactcgggaggccgaggttgcagtgagccaagattgtaccattgcactccagcctgggcaacaagagcaaaactccgtctcaaaaaaaaaaaacaaaaaagaaatatctgtaatgtaattactaaaacgtttgatatgcaaattgtcatttgtgagtaatattccttccttctgattgtcaactgtagctaaaaatgaagctgatcgtcaggcagaaaaacgagaaattaaacgtcggctcactagaaaggtactactgcctgtgtgttcagttaactatatgtgttatatttggatggcctatttgattggaaatgaattcacagctgggcacagtggcttgcgcctgtaatcccagcactttggaaggccatggcaggaggattgcttgagcccaggagttcaagaccagcctggggaaaacagtgaaaccttgtgtctacattaaaaaaaaaaaaaagaagaagaaagaaaagaaaaagaaaaaaatgaatttgcagcctgggcaacatggcaagaccccacctctacaaaaaaaaatatatattagccaggcatggtggtatgcgcctgtaatatcagctacttgggaggctgaggtaggaggatcatttgagcttgggaggttgaggctgcagtgagctgtgattgtgccactgcactccagcctgggtgacagggcaagaccctgtctcaaaaaaaaaaacaaaacaaaaaaccacctgataaccataatcactgggggtgggacctccagggatcaatagtgtctaaagctcccccaggtgattccaatgaagattgaagcactgggttagaggcaatttgaatgcatgattgatgcctaattattggcttggtgaactaagaggctccgtttccttcagctcagtcaaaggccaactgtcgctgaactccttgccaggaagattctgaggtttaatgaatatgtagaggtaacagatgctcaagattatgaccggcgagccgacaaaccttggaccaaactgacccctgctgacaaggtacctggaaagcactctcttgctttttttctctttctctttttctctttatttggaggatccaagatactaactagaagggagaaccataaacaaaacttctagttttaatataatattaaatttcaaatcaagatacaaaatgccaagttgaacaagtcaaaatgttatactaactcagtatgttttggtaactccaccaccaatactgaaagaaagaaaatccctgctatctcacagagtaaaaatactggaaggaataaatacatttcaaacagtggttgtttggttagagggagtttgggctatatattttagtaattaccaatatttcatttttataatgctgtgaaaaactataaaagctggccaggcgtggtggcttatgcctgtaatcctagcactttgggaggccaatgcagagggatcactcgaggtaaggagttcgagaccagcctggccaacatggtgaaaccccatctctactaaaaatacaaaaattagctgggtgtgatggcatgcacctgtaataccagctacttggaaggctgaagcaggagaattgcttgaacctaggaggtggaggttgcagtgagccaagatcatgccaatgcactccagcctgggcagcagagtgagactccacctcaaaaataaaaataaaaaattaaaattaaaaaaaaaacaaaactagccaggtgcagtggctcacacctgtaatcccagcactttgggaggccgaagcaggtagatctcttgaggtcaggagttcaagaccagcctggccaacatggtgaaaccctgtctgtactaaaaatacaaaatagccggacgtggtagtgcgcacctgtaatcccagctattcgggaggctgaggcaggagaatcgcctgaacccaggagctgaaggttgcagtgagctgagattgcaccactgcactccagccccagcaacggagcgagattccatctcagggaaaaacaaaaataaaaacaaaactataaaagctacaatatatctttcaagattttcaagtattttgattaaactaaaaattttaggtttattatgagacagatgggtatcattgtgttgacctggtgtctgggttgcctgtgaggggttgcagtgacttacaaagttaaacacagtacagaaaaatgacaagttacactgctgtgcaaagcagccagaagaagctgaaacatttttgtctctactccacaggctgccataagaaaagaattaaatgaatttaaaagctccgagatggaggttcatgaagagagcaaacattttacacggtaagacccaaaagacccaatcatatatgtgctaggtagagttttccaaaaaattgttcagatatgaagggctctaatgacatcagtaaaaaggaaaacactcagtgttgattgcaagactgcattcaaagggatgaaaagtaagaagcaatagtaaatgcctaggccaggtgcggtggctcacgcctgtaatcccagtactttgggaggctgaggcaggtggatcacctgaggtcaggagtttgagaccagccggaccaacatggcaaaaccccatctctactaaaaatacaaaaattagctgggcctggtagcaggcgcctgtaatcccaactattagggaggatgatgcgggagaatcacttgaacccgggagatggaggttgtagtgagctgagatcatgccattgcactccagcctgggtgacaagagcaaaactccatctcaaaaaaaaaaaaaaaataagtaaatgtgtattctgattatggcatttcatgtatattatttaatccttgtaataaacatgcaagatgtgttaacatccccattttatcactgaggaaatggaggctcacaatggttaagtaacttggttgacttgctagtaaattgcagaaccaggattcggagaaagaaatcaatgacttcaaggatgtgaggtgctctcttccttgtaccttactctctcaggttataaatgaggagactgtgctaagttagacaagatcttgccctctctggttcagttctgtctagcacagttgatcttaccaacttaatgtataaacaacattttaattagctgtcttcatgaaacaagccaagaaatccaacaaagccaacaagccaacaaatcaagtgttttgatttggaattacggttgtgattaaggacccacccatatccaaagaatcagctagccacaaatggaatcagtgaaagtatctttacatgattcttagaacatttacaaaaagaggcaaatgaggctgagtgcagtggttcatgcctgtaatctcgacactttgagtggctgaggcgggaggatcgcttgagcacaggagtttgacaccagcctgagcaacatagtaagactccatccctacaaaaaaaaaaaaaatctattttttgatttaggcaggggcctggtgcagtggtacacacctgtaatcctagcactttgggaggccgaggtgggaggatcactttgagaccagcctgggaaacacggtgagccccatctctacaaaaaataaacttaaaaaaaaaataagcaaggtgcagccaggcgcagtggctcacacctgtaatcccagcactttgggaggctgaggcaggtggatcacttgaggccagttggagaccagcctggtcaacatggtgaaaccctgtctctactaaaaatacaaaaattagccgggcatggtggcatgcctgtagtcccagatacttgggaggctgaagcaggagaatcacttgaaccccggaagcagaggttgcagtgagccgagatcgcgcaactgcgctccaacctgggcaacagagcaagactgtctctcaaaaaaagaaaaagaaggaccagcttaagcaagacgatgggagagaggaaaacacatggtgtttctgggtaacagaaaatgtagctggatcagaggatgtttggggcagtgtggtgaaaataaactagaaaatgggttgcagtccctcgcaatgctttgactgttatgctaggatgttggaaccattggcagttcataagcaggaaattctgtgtatttcagaacaagctctgatgcaaacaacaaagatgatatggaaggatgaagagactagcagcaaggaaaacaggaagtatctgaaataatcttagtgagcatagtggtagctcacaccagagatagtgagaatgcaaaggtgatagatttgtaagacatttcaagcatagaatcaacaagatgtggcaatttgttggattccagagatgaaataaaggagtagtcaaaatgactctgatatttttaacttgtattttttgaggtctttgaaggtgataagtttagctgaacagtttagtttattcaacaaatactgagcacctaccacgataggtatagtgctaggtccttgggctacagcaggaaataagataaagtctctgtcctcaatgaggctttattctttttttttctttttttaatagagatggggtctcactatgtttcccaggctggtcttgaattcctggcctcaagtgatcctcccatcttggcctcccgaagtgttgggattacaagtgtgagccactatgcctggccaagcttttattctaaaagaagaaggcagacaatgaacaagctagaaaataaattgcatgtgtttagtttgaggagcctatgacacatggagatacctagaagaccattagatatgcagcctagaatccagaaagaaagcaaagtctcaagatacaaatgaaagaagatagtggacctttaggggggattttatttttatttatttattttttttttttttattttttgagacaaggtctcactctgtcacccaggctggagtgcagtggcatgatcgtggctcactgcagcctcaacctctcatgttcaagccatcctcccacctcagcctcctcagtagctgtgactacaggcacaggccaccacacctggctaactttttgatcatttgtagagacagggtctccgtatgttgcccaggctgctctcaaactcctggtctcaaatgatcttctcaccttggcctcccaaagtgttgggattgattacaggcatgagccaccgtgactggccaaggaaagttgttttttatttaaagggtagacagaggaaaatgaaccaggacagcatactgagaaagatcaattgaagaagagagaaaattatggaaaagatagtgttacagaagccaagagaagagttcttttttttttttttttttttttttgagacggagtctcgctgtgtcacccaggctggagtgcagtggcgcgatctcggctcactgcaaactccacctcccaggttcacgccattctcctgcctcagcctcgcgagtagctgggactacaggtgcgcgccaccacgcccagctaattttttgtatttttagtagagacagggtttcaccgtgttagccaggatggtctcaatctcctgacctcttgatccgcccgcctcggcctcccaaagtgctgggattacaggtgtgaaccattgcgcccagccgagaagagttttaagaaggaagcagatgaggagtatcagatgcaacagaaaggtcaggtcgaattagagcagaggaaaggcagtgttaattaggtataacatttcattactactgatacattaatagcaaagcaatgtacatcatgtggtaacttgtctcttttttaatctcttttagctaccatcgtccatgatgccaaaggttgagagaggaatcaacatggctgctttgctgcttccttctccaaagtgacatatggagggaactttagcacttcccagcacagccagaattgcatcctctgggatcttctgaggtggacagcactttgaatgtagcatttcactggaacagagtcttatgtgctgcaccgggggcaaaacaacactttgtcagtgcttttgaacctttcaatattgtagcatgcttgaggagtttttcccttactggccaccaaagttctgaaccacttgcaggttccaggttttactggctgcaccacaccccttcccctagatgactgcctgtgcagagacacagtttgcaccattagccttacctgccctgccctgattgtgagacccaaatgtgtaggctctaaattccagccatcaaatccaattcctggtggggaaaaccttctggagacccccaaccttctgataaaagagtctctacctccagggaaagccttcttaccacactggcatatcagatgaaagcattgcactgtacctctcgtaacacagcaatacagtcctcttgaggcactcaagcctgagaggaagctcaggatctgacatgttcttccttttcctcacaagtcatcatgattttttattttaaaataatctggaagtaatgggaacttagtttttcctgaactccaaccagaatccaaattggttagatgaggccaggcgcggtggctcacgcctgtaatcccagcactttgggaggccgaggtgggtggatcacctgaggtcaggagttcaagaccagcctggccaacatggtgaaaccccatctctactaaaaatacaaaaattagccaggtgtggtggcgcctggttgaggcatgagaatcgcttgaacccaggaggtggaggttgcagtgagccaagatcatgcctactgcactccagcctgggcaacaaagtgggactctgtcttaaaaaaaaaaaaaaaaaaaaaatcggttagatgagaaagcatgtatattttctatatacaaaaacaagaaaggcgttttgagcccctgtgctcaggcccactcccacactgtggagtgtactttcattttcaataaatccccttattccttccttgcaaaaaaaaaaaaaaaaaaagccttagccagattcagtggctcacgcctgtaatcccaacactttgggaggctgaggcgggtggatcacctgagttcaggagttcaagaccagcctggccaacatggcaaaaccctgtctctactaaaaagtaaaaaaaattagccgggcatggtggcttgtgccttgtagtcccagccactggggaggctgaggcgggagaattgcttgaacctgggaggtggagattgcagtgagccgagatcgcgccactgcactccagcctgggtgacagagcgagactccgtctcaaaaaaaaaaaaaaagccttaatattaatgctaacgtggcagaaaactagcaggttacattttataggctattgtagttttatttaccaaatgatattctctaaatcacttcgaccaataaatgtattctcctccttaaagcagagttgtatcaactctgtgggagcatttatgagctgtcagtccccacacttctagccagaatcacaataaggtctggctgggtgtggggtgctgcataggaaagggtctctggagaagcaagaagggcacaatcatggcccactgctcccctcttcttctcagtgctctttgccctctcctgctgcgtgcttcctcttcactccagtgctgatcctcctgctctctctggcagcttccacctcacccgcccctcttccacactataaccagtatggttggtgctggggcattgactcagcccccctgctttctgcatttgtaatagatattaatatgatttcctaaaacagaagattttgttgctttctttgaacttgtattgaaaaccatacagtctcactgttttgctttaattcctatccacactataaatggaagaaaaaaattaatagcttctgtttaatctgatgaatgtggctttttttcccttcactttaatgttcaagaagttgtggctatttcatagatttcttctgatttattctgtgggtccctgttatctgttctttatgtaatctttcagtagattttcatcctttcatatccacattcttatgtggacttgctgaagaaacagaatatcagttcaaaacaaaacctaggccaggcatggtggttcacgcctataatctcagcactttgggaagccaaggcggtcaggagtttgagaccagcctgaccaacatgatgaaaccctgtctctactaaaaatacaaaaattagcctggcgtggtggcacgcatctgtaatcccaactactcaggacgctgaggcaggagagtcgcttgaacccaggaggcggagattgcagtgagccaagattgcaccactgcactccagcctgggcaacagagcgagactccatcaaaaaaaaaaaaaaaaaagaaggaaggaaggaaagcaagccctgaatccacatctccttgaagttttttttgttttattttgtttttgagacagaattttgctcttgttgcccaggccggagtgcaatggtgcaatctcagctcactgcaacctccgcctcccgggttgaggcgattctcctacctcagcctcccaagtagctaggattacaggcatgagccaccacgcctggctaattttatatttctagtagagatgaggtttctccatgttggtcaggctggtctcaaactcccgacctcaggtgatccacccacctcagcctcccaaagtggtgggattacaggcatgagccaccgtgccgagccttccttgaagttttttgtttggttttgatttgttttgttttgttttgttttgttttgtttttggagatagggtctcactctgttacccatgctggagtgcagtggcacaatcttggctcagagcaacctctgcctcccaggctcaagcaatcctcccacttcagtctaagtagctgggactacaggcacgtgccaccaggcccagctaatttttgtgttttgttagagatgaggttttgccatattgcccaggctcgtcttgaacaccggggctcaaggaatctgcccatcttcgcctcccaaagttctgagatagcaggtgtgagtcatcatgcccagcctccttgaagtttactaacaattgggataactgagggaagagaagtgacaattccactcagtctattagaggtctggatataaggtagccacacaataactctaacttgacttctaaccattctatcttattgatttggaggctgtcttctgccagattttttgtggcttgagatgatattttcgaacccttctttcactacctttcttacccttaatgtgccaagcttgaaacaggatttgatttcctgagctacttgttcgccttctgtgcgtcaccaagtaatctggttcatctttcgtctcattcatgttattttcaagtgaaacaagacattttgggggtcaagtctctttgggtgttttgtttttatgtatataaaaatggattttgtgttccctttccatgtaagtaccaacttatatggaaactcacaatcataatgtaaagaagaaatgaaagcctggtgtattgtacttcaagatgcctccctgatgtatagaatctccttgtaaaataaataattgcattgtatatcagtcttcccatcaatattaattattaaatattttagaatttttaaataccaactata

SEQ ID NO: 695 - DNA, 62221 bp, Homo sapiens
attcctgtgtgaagagtgccagtgtgaagacagttttgtaagaactgcaagtgctcaggctgtatgggaaacagaaacttcagcagatgaactgaccttatgccatttcctgatgtttggcagtgacactgaaagaggaccgcatgtcccctctttatgtggatttatcttttatgaaaagtttgcttttgtccgggacagtttgttgtcgtgagatacatcagacaatataatcatgggacaagctgatgtctccagaccggtaaatccagatgcagttggtgagtaatagaaggcagagaaacagaaaatcttgacagaagcaaggcagatttacaggtgaacttgagtatttatgtgaagttaaacacgagaatgttgatgatcccaactttgaaatgtttatgtttgtgaagaatgaatgaagtcatgcggaacatggcgagaaactttaaaaaattaagttttttaaaacttaaaaacttaaattcagtttattaatttatcgctcacagttttgttttacttgatctctttgaagttttttatattatattgctaaggaattatctgttaatttcttgccgttactaaagataaatgctacagaaacttatttagaattcagagatattttgttagtattttacagaacttggaaaatagaactgttgacttctatagacagaaccacttttaagaattaagtttttagacttggttatacattttcctaataagtctcaggcattttccattgcactagtgtttccgtttctcttaagtcaacactttgatataaacttttctgaagttagtactttacatttgaaatgttactaagggatagctagagagcaagctgattgtgagtatagctcagagtttcaaatcttctatgtgaaatggtagtcacttgtcactgcaagctcattttcctaatcttgtagggttttatatgacaatcataaattgggaaaaacagttttaagcagatgttcattaaagggttgcttaagtataagcaaaactagggaaagcctgtgaatcatttctagacattataatatttaagaaagatttataccttcactttgatttatggagcagcagaaaacatgttcagtcctaggctgcattttttgttttttgtttttcagaaacaaaaaatgttggtgacttaaaaaaaaagcataaagtgtggaaacacaggtaacactcccaaatgtttcataatgtagtgagattttgtttctaaaggtagtattttcacctgagagcttcctagatgaaatatcttcagtatttttcatgtattattgaaactgaggcacatggatcacaaagtgagtcattcagcaacagattttcagaactgaagtcaggacttgactcactttaccttgatcactagggctgtgtctttatcaattcattaactcatttaaaaaaatgaaatgtttcataaatagaaaaaggtataaagaaaaatataaagaatcatctggggccactccccagcctaacagatgaaatttagaacataaagataaacctcacactatccttctcttctgcattcccttctgatgacattttgcttctttgtttccagaattaaacactctcctatatttgataaataactcacttttgggctgtaaattctcctgtggtttctacgccaaacattagttgtttgttagcaagtatagtaaggactcaatgctaggcatttatctatgagatggaaatgaaagggctttgacaaacaataaattgtaaagcaagtaaaatttagtggtgagtggtggtatttaagaagaatgcccatctaagatctatatactgtattaaaaacttcatctgaggccgggcgcggtggctcacgcctgtaatcccagcacgttgggaggccgaggcaggcggatcatgaggtcaggcgatcgagaccattctggctaacacggtgaaaccccgtctctactaaaaatacaaaaaaatcagctgggcgtggtggcgggcgcctgtagccccagctactcgggaggctgaggcaggagaatggcgtgaacccgggaggcggagcttgcagtgagccgagatcgtgccactgcactccagcctgggcgacagagcgaaactccgtctcaaaaagaaaaaaaaaaaaaaaaaaaagttcatctgagtaacgtttggtatttgtatgcttctgaaaaaaagtaagaatcaaattcatcaattctttttttttttttttttttgagacggagtcttactctgtcgcccaggctggagtgcagtggcttgatctcggctcactgaaagctccgcctcccgggttcacgccattctcctgcctcagcctcccgagtagctgaaattcatcaattctattcctaccagtagccctaataaaagacatttgaggaagaaatagaaatcaggagcttaactaagttttttatgtttcctctggatttaattttggggttttatttcctattacctagataataagtagttgactatcagcagttttcatggactgactccattattatgctatttataattcaggatgtattctgtttgagcagatcaggaccaggttatgaaggcttaactgaaaaccttgaggactataccaattccaataaaggttttcaccaaacaacagtttcttaatttaattttcaaagcctttatgtgggtagctgtttggaaaatctcaccattttacttggaatgataaatatacaaagtaaattaaaacctaaattatctgtttactattctaggcctataatacagcacttagttttgagctttgaaattaatagtactagatttagcaagtcaactgatgcaaaacacatgaatgaatatattgaattgatttattattactttcaggcactgtgaataacatagaggcccctatgtagatattattcatgtctatgccctcaagaagtttgtcttctagttgagaatttaaaatatgaaaaagtatccaaaatatttgtaaaatttttttaaagattaaggcatacttctttttttttaatttaattttattttttttttacttaaaaaatatttgtgtgtgtgaaaatggggtctcactgtcgtgaccaggctggtctcgaactctagcctcaattgatcctcccacctcgggctcccaaagtgctaggattacaggtgtgagccaccagtcctgcagttaaaaaaaggacccactcctttaagttaattgattcccttgacttgtaatggaaggccagcgctattaaccaaagagtctgctttcaaataaataacctttgcatgaggattcatatgcaaatttatgagatgttataaccatatccaaccagagtttctactgtaggatctttctaacaactggtgaactgagtatttgaatgtacattaggaatctatgctgtggtatccattcaaggaaataagttctcatcagttcattgaaaaaaattaaataaaatacgttcataggagaagcatgtagatttatctagataaaacattgcaatcagggcagagtgcattggttcgtgtctataatcccagcactttgggaggctgacgcaggagaatcacttgagtccaggagtttgggatcagcctgggcaacatagggcaacaccgtttctacaaaaataaaaatttagccactgtggtggtacttatctgtagtcccagctacttgggaagcttaggtgggaggatcgcttgagcctggtaggttgaggctgcagtgactcatgattgtacctctgcactccagcctgggtgtcagagggagacactgtctcaagaaaaagaaacacaaactttcaaatcctactttgtagttcttaatgaacataaaaactgtttttttgctcaccaaaattctttactatgtgtcatattaaaacaactagctaattatcacatatccttaaattaggcacaagaccgaagaattttttcaatttattttttattttttaaatgtatttttttggctgggcgcagtgtctcatgcctgtaatcccagcactttgggaggccaaggcgggtgaatcacgaggtcaggagatgagacaaccctggccaacatggtgaaaccctgtctctactaaaaatacaaaaattagctgagcatggtggcgcgtgcctgtagtcccagctactcaggaggctgagacaggagaatcgcttgaaacaaggaggcggaggatgcagtgagccgagatcgtgccactgcactccagcctggcgacagagtgagactctgtctcaaaaaaaaagaaaaaaaagtttttgtttgtttgtttgtgtatttatttatttacttttttttgagatgaagtctcactctgtcacccaagttggagtgcagtggcgtgatttcgactcactgcaacttctgctttccaggttcaagtgattctcctgtctcatcctcccgagtagctgggactacaggtgcccaccactaagcctggctaatttttgtatttttgtagagacggggtttcgccatgttggccaggttgctttcaaactcctgacctcaagtgatccgcctgccttggcttcccaaagtgctgggattacaagtgtgagccactgtgcctggcaaattttttttttaattgaaaataattgtacctgttcatgggctacataatggatatttccatatgtatgatgtgattagattagggtaattagcatattcatcatctccaacatgtatttatttatattgggaaggttgaaatcctcctcagctatttgaaactacatattattaactatagtcattctgcagtggcatagaacactagaactttttcctcttatctagctgtaattttgtattctttaacaaatctttccctacccatcccttcccattatctctcccagcctctagtagcctctgttgtactttttactcctatgagatcaacttttttttagcttctatgtatgagtgagaacatgtggtgttaaacttcctgttcctagcttatttaacttaaaataatgtccttagttccatccatgttgctgagaatgacaggatttcattgtctttctttctctctctctcttctttctttctttcgttctttcgtctcaactctgtcaccgaggctggagtgcagtggcgcgatctcggctcactgcaacctccacctcccaggttcaagcaattctcctgcctcagcctcccgagtagctgggactacgggtgcacactgtcatacccagctaattctttttttttttcttgagacagaatcccactctgtcacccaggctggagtacagtgacacaatcatagctcactgcagcttcagcctcctagattcaagcgatcctcccccctcagcctcctaagtagctgggactacaggcacatgccaccacacctggctagttttttttattttttgacgaaacgaggtctcactctctttccctggctggtctcaaactcctggacctggactcaagtgatcttcctgcctcagccttccaaagtgctgggattacagttgtgagctagtacacctggctcattcttttttatggctaaatagtattccattttgtatatataccacattttctttatccattcatctgttgttgaacacctaggttgattccatatcttggctgttgttgagtagtactacagtaaacatggaagtgcagatatctcttcagtataatgatttcctttcctttggatatattcccagtaatggtattgctggatcatatggtagcgctatttgtagtttttctttcttttgaggaccctccatactgttccccatagtggctatactagtttacattcccaccgacagtgtatagtgttccctttactctgtaccctcaccagcactggctactttttgtctttttgataatagcctcctaactggggtgagatgatacctcattgtggttttgatttgcattcacctgatgatttgttatgttgagcatttaaaaaaatatatttggcttttttttttttttttttttttttttttttgagacagagtcttgctctgtcgccaggctggaatgcagtggcgtgagcagtcttggctcactgcaacctccgactccctggttcaggctgttctcctgccccagcctcccgagtagctgggattacaggcacgtgccaccatgaccagctaatttttgtatttttaatacagacagggtttcaccatgttggccaggatggtcttgatctcctgaccttgtgatccgcccacttcagcctcccaaagtactgggactacaggcataagccacagcccttggcctatttgggcatttttatgtcttcttttgagaaatgtctcttcagatcatttggtctttcccatttttatattatttatttttttatttttattattattattttttgagacagagtctcgctgtgttggccaggctggagtgcagtggcgcgatctcggctcactgcaagctccacctcccgggttcacgccattctcctgcctcagcctcccaagtagctaggactacaggcgcctgccaccgcacccagctaattttttttttttttttttgtatttttagtagagacggggtttcaccgtgttagccaggatggtctcgatctcctgacctcgtgatccacttgcctcggcatcccaaagtgctgggattacaggtgtgagccactgcgcccagcctcccatttttatattatttaactatttatttatttattttatttttttgaggcagagtctttctctgttgcccaggcggagtgcagtggcacgatttcagctcactgcaacctccacctctcgggttcaagcaattctctgcctcagcctcctgagtagctgggattacaggcgcctgccagcatgcccgactaatttttgtattttaggtagagacggggtttcaccatcttggccaggctggtcctgaactcctgacctcatgatccacctgcctcagccccccaaagtgctgggattacaggcgtgagccacctcacctggccatatttaattattcttttttaagacagagtctcgctatgttgcccaggctggtcttgaactcctgggctcatgcgatcctcccactttggcctcccaaagtgctaggattacaaacataagtcactgcacccagcccttcctaattctaattagaaggaccaaagatttttaataaattctctccaaccatttggcttggaactttccttctctgtctttccattttacctctctttttttttcctttttgccccttcatttaccctaattcactaattaacttttccccccacttttcttttgcataataatatattgctataaaagatactgtatgttctctttcctacattccttttccataaccatttgatttattttctctgaaacttggagttatggggttctcacccttatgatactggaagcagttttggggaacgtgatttggaaatatatcatcccccatctctacaaaaaaaatgtaacaattagtcaggtgtggtggtgcacacctgcagtcccagctgttcaggaggctgagatgggaggatcacttgagcccaggaggttgaggctgcagtgagccatgatcatgtcactgcactgcagcctggctaacagagcgagactgtgtttgaaaaacaaaaaagaaaggaaaagaaatatattatcacttagaggcaaaatcctaaggagattgcaggatgaataaaatttaacatagctacataacaacaataaaactggagtaaataataggttaatttaaaataaagtacttcatgagattttggagaaaaaggcttagtagtatttggttatcagaattataaagacatttctcatacctgtctgctgtttatctaacagtaaatgctttcttttaaaaaaggagaaacaggcatactttcctcatgtaatccagtgttcaggaggaggtggcaatataggggtctgtcataaactccttaaaagattctctgttatcaaatttggactaccaaccaaaacttattgatccctctctctgctccagtggattttctaaataggccattaataaggtttggatctaggtccccaaccagatcccatgttaaattgtaatccccagtgttggaagtgggacctggtgggaggtgattggggtggatttctcacgaatggtttaacaccatccacttagtactgtcctcaagatagtaagttctcatgagatctggtcatttaaaagtgtgtggaggctgggtgcagtggctcatgcctgtaatcccagcactttgggaggccgaggcaggtggatcatgaggtcgggagttcaagaccagcctggccaacatggtgaaaccctgtctttactaaaactacaaaaattagccgggcatggtggcgtgtgcctgtagtcccagctattcaggaggctgaggcaggagaatcccttgaaccctggaggcggaggttgtcgtgagccaggattgcgccactgtactccagcctgggcaacagagtgaggctccatctcaaaaaaaaagaaaagtgtgtggcacctgcccccttgctctcttgctcctgttctgggccatgtgacgtgtctactcccccttcatcttccaccatgattgtaagttcctgcagcttcccccgaagccaggcagatactagcatcattcttcctatacagactgcagaaacatgagccaattaagcctcttttctttataaattacccagtctcaggtatttctttttatttatttatttatttatttatttagatagagtctcactttgttgcccaggctggagtccagtggtgcgatctcagctcactgcaacctctacctcctgggttcaaagtaattctcctgccttggcctcctgagtagctgggactacaggcgcgtgccaccaagcctggctactttttgtatttttagtagagacggggtttcgccgtattggccaggctggtcttgaactcctgacctcaggtgatcctcctgccttggcctcccaaagtgctgggattacaggtgtgagccactgtacctggcctcaggtaattctttatagcaatgcaagaatggactaatagacctattatcacaacctacatatgtatttcctctttcttttttcttttttttttttttgagacagtctcactctgtcgcccaggctggagtgcagtggcacgatctcgacttactacaacctctgcctcctggattcaggtgattctcctgcctcagcctcccaagtagctggcattacaggtgcccaccaccatgcctggctatgtatttcgtctttctacttgcaagtaaactttggaaagtttgaagttttttttccatgagtgaatagcttatattctggcccttcactataaaaacatacccttaacctggaattttttgtcagaacagtgtgcacattaagttgccagtggtaaagcaacttcacttcttgatacaatcataggcagaaaactatttttccagaggtagaatctcagacataactgtacctgcaagttcagagagagaccttccacctgactatcttctcctgacggctttaccgagttctttctaattcccaagggtcagatctatgcaatatttccacaggaagttgtgggccttctctatacaaagcctgctttgttcattagtggcaggtttattttctgtaattttgccgaagttttctgaaacagttgtttaaagccaataataatcctcttttagaaggcaaaaatgaataagtacagtagtgtaaataccataaatgaatgttctacgtttacaatgttctgatactgtgaaaaggttgtttatagcaaatctgtttccagctaggtgggcttaaaaacagactaaaccattatattatgaagatatttggtacttcttcacagtgaagtatgtataccttgttgaataaaatcatacattaaaattttggacaaataggctgggcacggtggctcatgcctgtaatcctagcactttgggaggtcgaagcggatagatcactgttggccaggctggctggaactcctgacctcaggtgatcacaccattgcactccagcctgggtgacagagcaagactttgtttcaaaaaaaaagaaaagaaaagaaaggaaaggaaaggggaaaggaaaaaggaaaggaaaggaaaggaaaggaaaggaaacctgataaggtggccgggcgctgtgtcttatgcctgtaatcccagcactgtgggaggccgaggagggcggatcatgaggtcaggagatcgagaccatcctggctaacacagtgaaatcccatctctacttaaaaaaaaaaaaaaaaaaaaaaattagctgggcatggtggtgggcgcctgtagtcccagctacttgggaggctgaggcaggagaatggcgtgaacccgggaggtggagcttgcagtgagccgagatcgtgccactgcactccagcctgggcgacagagcgagactccatctcaaaaaaaaaaaaaaaaaaaaaaaacctgataaggtgtaaaacatacagagagttcatacagatccaataactttgttacttattaccaagtcaagtaaagcggggggcgggggtggggggacaaggcatggtagctcacacactttgagaggctgaggcaggaggattgcttgagaccaggagttcgagaccagcctgggcaacatagcgaaacctgatctctactaaaaaaattagccagataaggtggtctgcacctgtagttctatcttctcagaggctgaggcaggaagattgcttgagcccaggagtccaaggttgcagtgagttatgatcatgccattgtattccaagctgggtgaaagagtgagacactgtctcaaaacaaaacaacaacaacaacaacaactggctgtgccaggtgcagtggtgcacccctagagccccagtgacttgagaggctgaagcagcaggattgcttgagaccaggagtttgaggctgcactgtgccatgatcgcgcccattaatagccactgtactctagcctgggtaacataccccatatctaaaaaataaaaatatatatgtataataaaataaataattggttgtaaatctaattctaaaattaacattatctttgacctagggcatattgtttaatcctgttttatctcatatctccatcaagttatgcaggtataatatgtatctatagcaaatagttaatgaatactttatccgaagatgaaaggtgctaagtggtttttataaatatcatacatttatttaaaaatcacagccaatggcccagtgctgtggctcacacctgtaatcccagcactttgggaggccaaagtgggtggatcacctgaggtcaggagtttgagaccagcctggccaacatggtgaaaccctgtctctactaaaaatacaaaagttagccaggcgtggtggtgggcacctgtaatcccagctacttgggaggctgagacaggagaatcccttgaacccaggaggcaggggttgcagtgagctgagatcgtgccattgccctccagccagggtgacagagtgacactctgtataaaaaaaaaaaaaatcacccctgaaattcatatgaaacaactacacttgcacttaaaaacttcaattaaatatttactaggaaaaatatggtggttgaagaaactactagaactctgcataattaatgatgtaagaaacaagcctatgatatgtgaggtgctacaacttgaatgagggagtaagtagtttaaataccaggcctggtttcagggtactactcaaacaggaaactccaaactgtaatttggttagttatcttccactcccagcctccaccccctccaaaaaacaccaagactgtcaactctgtgacgtgctttcctaatggcctgtagctacatgactcaaagaaaaaggtgttttctttggaacacacaattgtaaaactatacccagcatcctacaccctgatttctggcaaacaaaggaaaactacctttttttttttttttcactcatagaaaacagaatggggccataggccatttaaaatgccataactagtttaaacagaaacaacagtctatccaaatgtgactgcatgcctatatgttctctgtcaaattggaaattagagggagcattttataaaatcagatgctgagaacaaagatttatgtgcagaattggcgtatgaacagtttcaggcccatctttcttagtcctttattagtataaaacaaatttgggtgtacttatataattttttaaaaaacagtgatgatttctggatacctgagtatattttttgtttttgttttttttggttgtttgtttgtttgttttgaggcaggttctccctctgtcacccaggttgtagtacagtggtatgatcacagctcactgcaacctcaaccacctgagcttaagcagttccctcgccttagcctaccgagtatctgggactgcaggtgcatgccaccacgcccagccaattgttgtgtgtgtgtgtgtggttttcgttttgttttgtttttgagagggagtcttgctctgtggcccatgctggagtgcagtggagttgtctcagctcactgcagcctctgcctcccgggttcaagagattctcatgcctcagcctccccagtagctggaactacaggcatgtaccaccacacccagcttttttttttttttttttttgtatttttagtagaaacagggtttcatgttggccatgctggtctccaactcctgacctcaagtgacccgcccacctcggcctcccaaaatgctaggattataggcacgagccaccgcacccagcctaatttttgtatttttgtaaagatgatgtctcagtatgttgcccaggctggtcttgaactcctgggtttaagcaatccacccacctggccttccaatgtgctgggattacaggcgtgagccactgcatccagcctactctttgttctgtaatgtattcatctgtcagtttctctttgtttctattacagtttctaagcattgcaattgaatcctcctgtcaaacagaaattcatactaagaagcttgaagcttgaactattgtagcaggattttttttttttttaattttagatacagggtattgctgtgttgcccaggctggagtgcagtggctattcacaggtgcaatgatacatatcacaatacagcctcaactcctagactcaagcaatcttcctgcctcagcctcctgagtaactaggacaacaggtgcgcatcactgtgccctgcccagtgttattgtagcagttttagagataaatggcttaattagatctaatcagccactgctatgaagcacttatgcattaatttttttctttgagacagggtctcacttgttgcccaggctggagtgcagtggcacaatcacagctcactacagcctcaacctcctcagatcaaaggatcctcctgccccagcctcccaagtagctaagactataggcaagcaccacacttggctaattttttttttttgtagaggcagggtctccctatgttgctcaagctgatcttaaactcctgggctcaagtgatccccactacctcgacctcccagagtgctaggattaaaagcatgagccaccatgcctggcaaatttatgcattcttcaaaactctttattatacagctaaaacacttttacctggcatatttagatcttcattaaatttggtttctagctcctttagcacaatattttacttgtggcaaactaggagaatatacttaaaagaactcttagaatccagattacagttgacctttaaacaacacaggtttcaactgtgtgggttcttatgtgtggatgtttttcaataaatgtattgacagattgtttggagatttacaacaatttgaaaaaaaaaactcacaggcagaccagatgtggtggcttttgcctgtaatcccagcactttgggaatctgaggcaagaggattacttgaggccaggagttcaaggtcgacctgggcgacatagtgagaccccatctctacaaaaaattaaaaaattagccaggtgtggtggcacatgcctgttgtcccagctactcagacagctgaggtgggaggatcacttgatcccaccaggagttggaggctgcagtgagctctcatctcaccactgcactctagcctgggcaagagtgagatgctgtctcaaaaattttaaaaagaggctgggcacaatggctcatgcctgtaatcccagcactctgggaggccaaggtgggtagatcactttagatctggagttcaagaccagcctggccaacatgttgaaacctcatctctactaagattagctgggcgtggtggtacacgcctatagtcccagctactcaggaggctaaggcagaagaatcacttgaacctgggaggcggaggttgcagtgagccaagatcacaccactgcactccagcctgggagacagagtgagactccatctcaaaaaataaaaaatacaaacaaataataaaaataaaaataagtccgggcacagtggctcacgcctgtaatcccagcactttgggaggccaaggtgggtggatcacttgaggtcaggagctcgagaccagcctagccaacatggcgaaaccctatctctactaaaaatacaaaagttagccgggtgtggttttgcgtacctgtaatcccggctacttgggaggctgaggcaggagaatcgcttgaacccaggaggcagaggttgtggtgagccgagatcacgccattgcactccagcctgggcaacaagaatgaaactttgtctcaaaaaaataaataaataaaaataaaaatgaattaaattaactagcatatactgtactgctgtaatttcatagccacctcctattactattgaagtgagctcaagtattgccagtatccacttaaaatgctgtatgatgctaattttctagtgagcagttcttcatagcttagtgcaatatcataaatcttgaataacaccacgggacctacaacacgtgccactaatgatactggaattgctcttaagaagcagagaagagtcatgacattataagaaaaagttgaaaacgaaaaaaagagaaaacacaaggaaaagttgaatcgcctgatgtgatgcataccatagattgaggtctgtagctgcagttgcctgccatttttataagtatatatacataggtggtggctgggctggggaaatggcggcttcacgagagagtgggacttgggcagcagaggcagcacagtggatgcatttctgaccttctacagtgaggtgaaacaaatagagaagagagactcggttctaacatccaaaaatcagattgaaagatggacccgtcctggttcctcttacttcaatttgaacccatttgaggttcttcagttagatcctgaagttacagatgaagaaattaaaaaaagaggtttcagcagttatccacattggtgcgtcctgacaaaaatcatgatgctgacagagcacaaaaggcttttgaagctgtggacaaagcataaaagttgctactggatcaggaccaaaagaagaggaccctggatgtaattcaggcaggaaaagaatacatggaacacggccaggcacggtggcacacgcccgtaatcttagcactttggaaggccaaggtgggaggatcccttgagctcaggggtttgagaccagcctgggcaagatagcaagaccttgtctctattaaaaaaaaattttttttttaattagccaggtgtagtggcacacgcttttaatcccagctgctctggagactgaggccagaggattgattgaacccagaaagataaaaaagtccattcaaaaggaagatataataactctaaatttgtatatacctcataacagcttcaaagtatataaagcaaaaattaatagaactaagagagaaatcactttgtcttttttttttttttttttttttttgagacggagtctcgctctgtcgcccaggctggagtacagtggcgtgatctcggctctctgcaagctccacctcccgggttcacgccattctcctgcctcagcctccctagtagctgggactataggcacccgccactgcgcccggctaattttttgtatttttagtagagatggggtttcaccatggtctcgatctcctgacctcgtgatccgcccacctcggcctcccaaagtgctgggattacaggtgtgagccgccgcgcccggccatcactttcataattagagatgttaacatacctctctcagttactgatagagcaaacagacaacaaatcagaagggatcttaatgatttgtatatgattaaccaccttgacctaattggcatatttagaacaccatacccaacaattgcacaatacactttccaataacacataattggagataatgtattataaatttgggaagaaacaactgtaagcttctgttgtttatttgcaacttggaccatatttgagatatataggaaaagcattaaatataaatggcctaaacactccaattatcctaccacgttgggagactgaggtggaaggaccacttgaacccagcagtttgagaccagctcagctcactgtaacctccacctcccgcattcaagccattctcctgcctcagcctcccaagtagctgggattataggtgcctgccaccatactcagctaatttttttttgttgttgtatttttaatagagacagggtttcctcatgttggccaggctggtctcaacctcctgccctcaagtgatccacctgtctcggcctcccaaagtgttgggattacaggcatgagccaccgcatctggcctcatttttctttttctttttctttctttcttttttttttttttttttttgagacagagttttgctttcacccaggctggagtgcagtgatgtgatcttggctcactgcaacctccgcctcccaagttcaagattctcctgcctcagcctcccgagtagctgggattataggcgtgtaccaccacacccagctaatttttgtatttttagtagagacgaggtttcaccatgttggctaggctggtctcaaactcctgatctcaggtggtctgcctgcctcggcttcccaaagtgctgggattacaggcatgagtcaccatgcctggcccctaattcatttttcttcaacaaagaagcagcctatagccagaaaatgtctgcctctgtctcttttaacctccatgaggtttccagataataatctggtattgggtttaacacacctgactgaccttaggaccctaggctgacctggagagattttttaaaacagattctgaaagtcctacctcctggagattctgtattttgaaaaggcaattgggctgattccaagtatttggacagatttcggagtcttggaaataatgtactgtttgtcctggagagtaggaaaaagaggggaaggaaggagggagaatatgaggatatgaatatgtatgtgtgaatttgagataactgagtcagggccaggtgtggctctaccccaacacaggaggtaagaggaaagaaggacatctgcctctaaaagttttgtaaaagtgaaaatcaagcacatttgcatgagaagcaaagaaaatgttgctctgttttttgtattcagtggctttattttttttatacatattttgcttatgtatcaactattttttttttgagacaaggtccctgtattaagccattcttgcattgctataaagagatccctgggactggataatttataaagaaaagagctttatttgactcgtggttctgtaggctgtacaggaaacataatgcttgcaactgccctgcttctggggaggtctcaggaaacttacaatcatgaatcatgacagaaaaccaaccaggaataagcatgtcacgtgaccagagcaggaacaagagagcaaagagggagatgccacatacttttaaacgaccagatctcacgagaactcactcactattgctaaggcagcaccatatggatggtgctaaactattcatgagaaatccacccccatgatccagtcacctccaaccaggccccacttccagtactgaagattacaattcaacctgagatttgagcgggacacatatctaaactatatcagtatggctctgtcgcccaggctggagtgcagtggcacgatcacagctcattgcagcctggacctgctgagctcaagcgatcttcccacctcagcctcgcaagtagctgggactaggcacatggcaccctgcccaactaatttttttttttttttaagagacagggtttcttcatgttccccaggctggtctttctttacctaaaaaagaagagaagccagatgctgtagccagtgtctgtaatctgagacattctcataatttcaactatttgcctgtaatctcagctactcaggaggctgaggcagaggattgcttgagtcctggagttgaaggctcagtgagctgtgattgtgccactgcactccatgctgggcaacagaacgaaaccctgtctctaaaataactagataaatagatagagagacagatagatagatagatagatagatagatagataatcagattctagtgtatttcatgtaaagtgttaaagtaattgagacccagaatgtccttgtataagtcatgcaactaggaagagtcactgtcctcttgtcatttccatcttttgcactttagtaatgaggatgctattttgcctaagtcttctgggcatagcaaactaatgcatcagtagtcaccattgcatttactgtgataattacgattgtataaatctaacctttattgaaaaacttccctaaacctccatcaatcaagtgaaaaaaagattgaatttggcagttgtttcttttaaaaatttaatgctgttggttgtatattttctcttttgaaaatacctagttttaaaagagagagaggccaggtgtggtggtacacacctttaatcccagtgcttttgggaggccaagcagggaggatctcttgagaccaggcatttgagaccaccctgagcaatttggtgagaccctatctctacaaaacaaaattgtttttgtaattagccaggagtgatggtacatgcttatagtcctggctactcaggaggctgaggcaggaggatcatttgagatcgggaatttgaggctgcagtgagctgtgattacactactgcacttcatcctgggcaacagagtgagaccctgtttctaaaataataataataataataataaatttttttaaaaaagatgttttagtgactattatgacctttttaccctcctccaaaagtgttacttgcttcagatgtgaaattgtttacagtcaacatgttagcttatcatatgctgttccttgatgtatttctacaaagtagaggttccactttaatttcaggatggtttttccacatgactctttttttcttcctctctagacttctccagagaaccttggaacagtaggtggagtgcaaagctgcattgtgtaccttcctgcttttttttggttgccttcctgctggtttttttttttttcctttctttaaattcttggccccgccttggctctcctttctctgccattaaaactaactaactaaaccctgcatgcatggtcattatgaggggttcatggccttttatttcagttctgcacatgtatcatgtcagttatgttttatgtcaaatccttaatattatggtgtgtgtgtttgtgtgtgtgtgtgtgtgtgtgtgtgtgtgtgtgtgtgtgtgtgtgtgtttgagacaggctctcactctgttgcccaggctggagtgcagtatcttaatcacagccaactgcagcattgacctcccaggctcaagccatcttcccaactcagcctcctgagtagttgggactacaggtgcacaccaccatgcccagctaatttttgtttttgtattatttgtagagacagggtttcaccttactgccctggttgatctcaagctcctgagcttaagcgatctgcctgcctcagcctcccacagtgctgggattacagaaatgagccactgtgctcagcctatgattgtctctaaggcactactatggtaaacaaattggaatctcacctctactttctgaaaacatttccctccaatttaatgtacccgctttctaatgcttctgccccgcaaccctgagcactttccaatacctagggtccttttgtgaagggagaaaataatttgatgagcagatataagtaaggtactaacaatgtgttacctctccctgaactatttatatcctgaaaagggcagggaaagggcaatgtttaatagagaaaatgattcactcactaatgaggcaggaattccctgcctcagtaaggcaagatctcatgcatttgttaagatatccacattttgtatacatgcgcctttaaaagattttgagccggctctgatcatttcaccagattttgtcctaaaatgatgtcagcttggtttggttcctttttctccttagtagtttatctgttaatggattttgatgtttggtgtccatgtgatgtccaggagtctccctgtctgcatgattgtttatcgttgctccgatcctttccaactaccacaggaagagaggggaagggacattttagagattatgctgaaataatacatttgcttccttccctctcttcttttcatgtaacagaggaagcagaccagcccactacagagccaggcatggtcctggacagtgtggaagcaggagacacaacacctcctaccaaaaggaagagcaagttctcaggctttggcaagatcttcaagccctggaaatggaggaaaaaaaaaagtagtgataaatttaaagagacttcagaaggtgagatattaagggttaaatgtgtgttctgagttagaattctctatgttagatgtatttaatttttccttatcttcccaagtttctgtagtcctctatttgaagagggtatttaatgttttattctttccttcttctttttttttttttttttttttggtgagacaggatctccctctgttgcccaggctagagtacagtggcgcaatcacagttcactgcagattcaacctcctgggctcatgtaatcctcctgcctcagcctcccaagtagctggaagtacaagcatgagctactgtgcccagttaatttttaaattctttgtagagatggggtctccttatgtttcccaggctggtcttgaactcctgggctcaagcgatcctcccacctcagcctcccaaagtgctgggattacaagcatgagccactgtggctggccagagtttaatcttttagaattaaacatcaaaatggtcatgtactaaacctaatattgtataccctcattcccaggtttgtattttgatggcatataagtatctattgagtggtgaatggagttcctgaactgtcgcaaatctaagatgcttctttccatcagaacttggtgaagaaaatgactgaatgagttgatacatacataaataaaatgcttattttctactctgcccatccacacaaagttcatccgtaaataacttactaatgaaattttctcttaagttacaattatgtaaggctagttttttggaagtgatgctttcctgacagcacaggttataaaagaaatttaagagttttaatttgaagttagtctgctagttattttctttcctgagaatataaacttaaactactttattcttttacctgtagaattagaatgctaagtgtaaggttgactttcaactgtcacatttctgagtgccattttccaatttaatgttagttttagaacggaaaatatctatgcgaaagccaagagaagagctggttaaaagaggggttctgttggaagaccctgagcaaggtgagtttacaaataaatagcatatgcctgtctctgtgcacttggtctttgattgggtctgacgagatatttgaattttctttctttcttttatattgctatttttgggttggagggtggcctttaaaaaaaaaagttcacccttccttccttggggcaaacattcctttcctctgtgtacatcctcaactttgtgccagctacaatattgcgtgtcttttttttcccccccttgagacagagtcttgctctgttgcccaggctggagtgcagtggcacaatcttggctcactgcaacctctgcctcctgggttcaagcaattctcgtgcctcagcctcccaagtagctgggattacaggcacctgtcaccacccccagctaacttttgactttttagtagagatggggtttcaccatgttggtcaggctggtcttgaacttctaacctcaggtgatccgcccgccttggcctcccaaagttctgggactacaggtgtgagccactgtgcctggctaattttttcatttttagtagagatgaggtttcaccaagttggccaggctggtctcgaactcctgacctcaggtgttctgcccacctcggcctcccaaagtgctgggattacaggcttgagccaccgcgcccagctcattttcttttttgaacacatttgtccccatgcccatatcactgcaccagtctaccagtcattgtttgtttaataatgtcaagactttcttcaatgtgtgactctatgaagcaagttattgcaaatgtgaaagtatagtacattggttgcatctcatttctcttcatctgagttatgttgcatgaggcaaaatctgaaagccatattgtatactggccaggcatggtggctcacgcctgtaatcccagtattttaggaggccgagacgggcagaacacttaaggtcaggagtttgagaccagcctggccaaaatggtgaaaccccatctctactaaaaatacaaaaaattaggagggcatagtagcaggcacctgtagtaccagctacttgggaggctgaggcaggagaatcacttgaactcaggaggcagaggttgcagtgagctgagatggcgccactgcactccagcctgggcaacagagcaagactccttctcaaaaaaatttaaaaaatcatatcctttgaagaataggggaaaggaaccaaatagatggagtattactgtatactttttgggctttaaaccatgcgaatatattgcctattcaaaaaattaaattgtatgtattgaagatttattatctcaactgtataaaaactaaccagagacaacaagcttgaaggagcaatttgaaatattattacaattggttacctctgaagttgaggtgggaacatgggtgggctttttttttgttttttaattgagacagggtctccctatgttgcccaggctagtctcaaactcatgggcagcacaagcagtcttcctgcctcagcctcccaaagtgctgggattacaggcgtgagctgctgtgcccaggtgctatgcgatgttttctttctttctttttttttttttgtatgtgactagttatgagcatatataacttttgttttatataactctatttgtttttttacattaggacacaaaatcttctcagtatttaggtagttacgtactactttaatggtttcactgtagcacctctttggcccttgctttgctttcttttttgagacagagtctcactctctctcccaggctggagtgcagtggtgtgatcttggctcactgcaacctccatctgctgggttcaagcaattttccagcctcagcctcccgaggagctgtgattacaggcatccgccaccacacctggctaatttttgtatttttagtagagttggggttttcaccatgttggccagactggtctcgaactcctgacctcaagtgatccagccacctcagcctcccaaagtgctgggattacaggcgtgagccaccatgcctggcctggcccttgcttttttgatacagctgttccactttccatggcctttcttttcacctttcttgctcacttatcataaaccacatacattactcatttcttgtttttcaccttcagtctcttttgccctacactcacggcaacctctgcctcctgggttcaagcaattctccttcctcagcctcccgagtagctggaattataggcatgcatcaccacacccagctaatttttgtatttttaatagacagggtttcaccgttttggccaggctggtctcaaactcctgagctcaagtgatccacctgcctcggccttccaaagttctgggattataggcatgagccaccacgcctgatgatcttttgccctatactttctattagcccctaatccaagttgtttttagcctacaagttcacaggcccaattaataaacgagttgcagccattggacaagatgccattctgccaaccagataaatgacctaagctttattctgtatctaaaaacagggatgggcctcatgctggcttatagatctgcattttaggccaaaagtagtgtttgaaccttgaagtcctctgcatacttaaagggaacttttggctggcctggcgcggtggctcatgctgtaatcccagcactttgggaggccagtgtgggaggatcccttgaactcagtagttccagaccagcctgagcaacatagtgagacctcatctctataaaagattttttaaattagccaggtatggtagtgcaggcctgtagtcctagctacttgagcccaaaagatggaggatggcttgagcccagaagattgaaggctgcagtaagtattaattgcaccactgcactccagcctgggcgacagagtgagaccctgtttttttttttaaaaaaaggtggcttttggcttgattatagtgctaacttgactgtactgtaaaatatttaattgattttaattgattttctgggtttagggagaacattcagtgatgttaaagccccatagtactactccacttcattaacattgcagaaccctctatatttaatataagaaatgatactgcaaagtagacatccctgattaagtaacttgagataactgatcacttttgcatgtatttcactagtgtgtgctgagtagaaactaattaacactgtcttaaactttattatgttgttttcacaaagagcagcctttgttgactttgaaatcattgcttcagtattctagaaaatcttgtttttgttaaacatgggcagtaacttactatttttgtatagttgttgtcatcttacccccaccctgttttaaaaataaaaagtagttgtcagattactttggctttagaagtaccttttcacttgccttagaatcttcattactttgagcctacactccacctcttattggaacttcatgaagaatgatgttggatttcactctgtcacccaggctagagcacagtggtctgatcatggcttactgtacccttgacctcctgggttcaaacagtcctcccacctcagcctcccaggtagctgggactaggcatgtgccaccacacccagctagtttttttacttttttgtagagacagggtcttactatgtttcgcaggctgatctcaaactcttgggctcaacgatcctcccgcctcagcctcccaaattgttgggattacaggcatgagcaccactgtgcccagcccataaccatttcttttttttttttttttttgagatggagtctgttgcctcagcctcccgagtagctgggattacaggcacctgccaccacacccgaataatttttgtattgttagtaaagacggggtttcaccatgttggccaggctggtctcaaactcctgacctcagatgatccacccgcctcggcctcccagagtgttgggattacaggcgtgagccactacacccggccccccataaccatttcttatgtgaatctattctcctgccagaccaaactagttgccagtgccccaaacacgttgaataacttcacacctttatacatgctgtccttcttccaaacagactgtctttattcagtgtggtaggctcctactccttcaagatccagttcaaagcaaggcatggtggtgtgtgctatagtcccatctactagggagtctgagagaggaggactgtttgagcccaggagttcaaggcccattctggtaacatagcaagaccatctcaactccagctcagatactttctgtgatgccttcctaactctattctcactccaggaaaatgatttcttcttcattcctaccacagtacttcactaattagagctcttgacatttaacattgtagttacttatatataagtttgccctattcgtttgtctttttttttctttctttgagttggaagttttgctctgctgcccaggctggagtgcaatgacacaatcttggcttactgcaacctctgcctcctgggttcagttgattctcctgcctcagcctcctgaatagctgggattacaggcgcttgctaccatgcctggataatttttgtatttttagtagagacaaggttttaccatgttagacaggctggtctcgaactcttgacctcaggtgatccacctgcctcagcctcccaaagtgctgagattacaggtgtgagacactgcgcccggcttttatttgtcttattcatataacaacgtacttggcacatagtaggctatcaaacatgtattggaaaaagaaatcacttgtttctgtttaagcatccagataatctagatctcaataataaactaaaacaggaagacgagggaaagaagataagaaaggttagaaatcaccaaccctgggccgggcacggtggctcacgcctgtaatcccagcactttgggggctgaggcgggcagatcacgaggtcaggagatcgagaccatcctggctaacacggtgaaaccccgtctccactaaaaaatacaaaaaattagtcgggcgtggtggcaggcgtctagtcccagatactcaggaggctgaggcaggagaatggcgtgaacccgggaggcagaggctgcagcgagccaagatcatgccactgcactccagcctggtctgtgagaccctgtctcaaatcaccaactctggccaggcgcagtgattcatgccatttatcctagcacttcgggagaccaaggcgggctgattgcttgagcccaggagttcaagaccagcctgggcaacatagtgagaccctgtctcaatttaaaaaagagagagaaagaaaaaaagaaattactaactcttctttctatctgttcatgccaacttcatcactttgtactcttctttcaccttgcaggtggtgaggatccaggaaagccaagcgatgccatgttaaagaatggccataccacccccatagggaatgccagatcatctagtccagtccaagtagaggaagagccagtaagattagcaagtcttaggaaagctattccagaagaggacctaaagaaacgactaggtaagaaactctggatttttgagtttaagagccacgggccagttattctccttacataaggggtttgcaagagaacagggaaaagtgaaatctagagagaattacattctcctttaacaataccttaactagcaacttcaaggggaatttcctcccccaccccgcttttattcactaaatacctaaatttgtgatcctcaagaagggaagaggatgttaagtatcagatacctataggattttttccagctacacattccacttctttcacccaaggaattttgttgtggctctcctccagtagcctggcccttgtgtgaagaatcactaccacaatgagcatctcttagtgagcctttcttactgacatttcttaagtatggggaggttgggaggcattgagaatggtaacctataagctaatctataaattaattggtgaaattggccacaaattcatagatgtgttagctttttcagtttctcttgttactctctcttccctttttataccatacatgttattacacaggctcaactggaagccagcctaattctgaagcagagtctgttcctgagaatgtacccaaaccacctttacttcctcccaaaagacccttgtcctcttctcatgaagcaagtgaagggcaagcaaaggatgccacttcctctggcggcacggcaaggttcatcatctccacctccatcaccacagcacccgctgccaccactgctgccacaagccttgcaaagactgttaatctctctgtcaccccttccccagcacccaggactctgcctgctgctcctgccagcactaacactactgctaccccaagcctcactcatatggtccctgccaagcagccccctatccctccccctaaaccagctcacagaaatagcaaccctgtcattggtaagtaagtctttaggcttccagtgttttgggtttggtttgatgttggatggttattttatttgataactggtacaacattgatttggtctgtgagaattttccatatcttgtccctttgaatgacctcaatatggagaaaagtcttaggttaagaaaaaataggccaggtgcggtggctcacgcctgtaatcccagcactttgggaggccgaggtgggtggatcacaaggtcaggagattgagaccatcctggcaacatggtgaaaccccatctctactaaaaatacaaaaaattagccaggcgtggtggcacgtgcctgtagtcccagctacttgggaggctgaggcaagagaattgcttgaacccaggaggcggaggttgcagtgagccaagattgtgccaatgcaccccagcctaggcgacagagagagactccgtctcaaaaaaacaaaaacaaacaaacaaaaaaagtcatgaaactgaggcagatggccataaatgtaaacatcactaagattagatttaagttttgggggttttaacctattttttaatctaatatttaatctgtttttctaaaacaatgattccaaaacactatacatatttgtgtgtgtgtgtgtgtgtgtgtgtgtgtgtgtgtgtgtaattggactggatatgtgaaaaccataacagattccacctgcatggaattatctgtggcacttgctgaaaaattagaataatgcctcagctcacaaggggcaaggcaaacttttcaaatgaaaatttttaaatctacttaaaactacctatgccttccataagcattaatgagtctagtagataaaaggatgattctgtagatgccagtggaatttgggattcagtgtctggcatagttatcttcacagggaactgcagaagctattacttaaattgttctgataaaatcatgttttatcttgggagaattaagaatgctattcttatgttaaaataagtgatggtagagaaagcagggaatataatcagtaaaatttgtatgggtttagtaaattttttgcatttacccaaagttctatttaagtctactttctttatataaatgcacaatttcttagaagaattttcaagaaagggagaggaaagctaatgagtgcttcaaagctaataaaaatatagttttttcaggaaaaatgatactaggcttagtattgcttaaagttcttgttcacgattgaacgaatgaataaaaactatactcattaaatatttaatatcaccatgttgggtggagtgattcaaaccttgaaaaacaggcttagaatattttatgagtatgacagtttggagtagcttgatgaaaacaggatgaagttgttattaccaccactttggatggatagtgtcatgttgacttatctgtgaggaacttggggagctttcacatacttattttcaaaactaccttgtgctgcaggaaaccaattttatcttttccataggtagggcaattagaacatgaagacattgtgactcattcaaggttgtaggccaggcgcagtggctcatgcctgtaatcccagcactttgggaggcagaggcgggtggatcacctgaggtcaggagttcaagaccagcctggccaacatggtgaaacgccatctctactaaaaatacaaaaaattagccgggcatggtggtaggcacctgtaatcccagctactcgggaggctgaagcaggagaattgcttgcacgtgggaagcagacgttgcagtgagctgagattgtgccactgcattgcagcctgagcaacaagagcaaaactccatctcaaaaaaaaagaagaaggttgtagttagtgaaagatagaaactgaacataggcttttcaactctcaggtccagacctctgttccttacagtagtgtttgcaaactggtgttctcctcaggatcacctagaaagcttatgataacagactgctggacactacccgtagagtttctgattttagtaagcctgggatgggcttgagaatttgcctttctaataggttcccagatgacactgatgctgctctccagggagcacacattaagagcctctgctctacaccagtggcataccacccttttcaagttaaggcaacatataaaatgataatttgtgtatgataccctggactaaactgcagagctcattcttagcttgaggtaaatagcccaaaacaatagaccttgtaactgaggaatcagtattagtccatgaggggtcctcaacaaaagaagaaaaatagaacagttcacagagcatttcttagagctaaatagatttaatttaaaggactctcttttattctaaaattacaaccttcctaatcctttggtgttaaaatgccatttctttcacaaaaggattatgatcataaatggtttacttaatatcaagccttatttggaaatcttagaaaatgacaacctcaaaaaaacactagaaaaaaaaccaacaatctgaggttgatcaagatttttgttattgttttggtcactgaaatccaaaagtttggaaatcattgcttcagaagtactactgtcttctcatccatataacatggagtattacgactaaggaaaaaccaccagcaatagctgaacgggtgaaagggaattattacccatcccagaaacactctgaaatttttccacagaactacagccagatgctgttgtcagggtatatataccagaatttacttccttaacatatatgccttcctcaaattaccaaatagaatttattttattaattcaaaagtaaaaatattcatttatggtctcatcaggaatgagttttgttgtagatggaatagctaacagctatttttagagaatcagcaaaaatccaatctttccaaaaatatctctttcactgctcctaaaattcacatttttagaatctttttgtgtgtgtatgcagtgtttttctagaaagccttttttaaaatttatttatggggccaggcatggtggctcatgcctgtaatcccagcacttcgggaggccgaggtgggcagatcgcttgaggcccagagtttgagaccagcctgggcaacatggtgaaaccccatctctactaaaaatacaaaaaatgatctgggtatgatggtgcatgcctataatcccagctactcaggaggctgaggcaggagagaatcacttgaacccgggaagtggcggttgcagtgagccaaaattgcaccactgtactccaacctaggcaacagagcgagactctgtctcaaaaaaaaaaaaattatttatgatgagagacattaaaacattacaaaattaggccaggcacagtggctcaatgcctataatcccagcatttggggaggccgaggtgggaagatcacttgaggccaggagttcaagaccagcctgagcaacgtagcaagaccccatctctataaaatatttaaaaattagctgggcatggtgacatgtgcctgtaattctagctacttgggagattgaggtaagaggattgggtaagcacaggagttcaaggctgcagtgagttatgattgcaccactgcactctagcctgggtaacagagcaacatcctgtctctaaaaaaaaagaaaaggctaggtacagtggctcacacctgtagtaccaacactttgggaggctgaggcaggtagattacctgagcccaggagtttgagaccagcctaggcaacatggagaaacccatctctacaaaaaataccccccccaaaaattagccgggcatggtggcacatgcctatggtcccagctacttgggaggctgaggtgggaggatcacctgagcccagggaggtcaaaattgcagtgagccgtgactgcgccactgcactccagtgacacagtgtgagaccctgtctaaaataaattaatttaatttaaaaataaaaataaatttaaaaagaaaagaggctgggtgtggtggctcacatccataatcccagcactttgggaggctgagataggtgtatcactggagcccaggacctcaagaccagcctgggcagcatagtgagaccttgtctctactaaaaattaaaaaaattagtcaggcatgggggcatgggcctgtagtcctagctacttgggaggctgtagcaagaggatcacttgaacccaggagatcgaggctgcagtgagctattgttcatgccactgcactccagtctgggcaacagagggagaccttgtctcaaaagaaaaaaaaaaaaagaattataaaattagctagccttggccgggcaaagcggacatgcctgtaatcccagcactttgggaggccgaggcgggtggatcacctgaggtcgggagttcaagaccagcctgaccaacatggagaaaccccatctctactaaaaatacaaaaaattagccgggcgtggtggcacatgcctgtaatcccagctactcaggaggctgaggtaggagaatcacttgaacccaggaggtggaggttgcagttagccgagatggcgccattgcactccagcctgggcaacgagtgaaactccatctcaaaaaagaaaaaaataattagctagccttttactttgaacatctccaattttggagatttaggacaaatacagttttatttaagggaagtttttgagagtgtttgagaatactgagtgggatgaaactaaagggtttgagtagaaggttagaggttggtgatcaaaagaactactttttttttttttttcctgtcagcagggaaaaaataactaccctttaattactttaccagttttactcctgtgtgatctgatgatccacttcttacaggtcatctggagccctccaaagggactttgctgaaacaacaccaacacctttgctgagtcattgtgggctttggtgaaactataggaatatatactgtcatgatacagggtgaaggcttctcatctaataaacatatattgagggtccactagatgccaggtactgtgcacagccctgtggatgatatgttgatggagacaaggttgccctgccatcaaggagcccatgatatagtggagagtgaacatgggaagctgaggtgcaaagggaacataagaggtgtgcataccaataaaaattagagacagtaggccgggcgcggtggctcacgactgtaatcccagcactttgggaggccgaggcgggcggatcacgaggtcaggagattgagaccatcctggctaacatgatgaaaccccgtctttactaaaaatacacaaaaaattagccgggagtggtggtgggcgcctgtagtcccagctacttgggaggctgaggcaggcgaatggtgtgaacccgggaggcagagcttgcagtgagccgagatggcaccactgcactccagcctgggcgacaagactccgtctcaaaaaaaaaaaaaaattagagacagtaggatgcagtcaaatagtcagagacttggataccagctgagtccatgccagtttgtagtatgatcttgggcaaagtcacctagcttctgtggccttgccttttccttctgaaaaatggtaaagatgctatattttttcccctgtcacctcaggtggtataaggagaatatgacttcaaggacaaaaaacactttgatttcttcaaaggactttgcaattgctataaaaattcaagatgtcagtattgacagttttataacacagagctaagatatctagataccattatcaggatatggtaacaatacccactaatacttattttatgctatctgaatgtttaaattttttaatggagtactgttatacaaaataacttttttttttttgagtcagagtcttgtgctgtccagcctggagtgcagtggcatgaccttgactcactgcagcctccgcctcccaggttcaagagattctcgtgcctcagcctctcctgagtagctgggattataggtgcccaccaccacacctagctaatttttgtaattttttttttttttttttagtagagacggggtttcaccatgttggccaggctggtctcgaactcctgacctcaagtaatctgcccacctcggcctcccaaagtattgggattacaggtgtgagccaccgtgccagccacaagataactttttatcagattttttttgtctctattcatattaactacaccaagatcaagttacaaaaagttgtcagccgggtgccatggctcacgcctgtaatcccaacactttgagaggccaaggcaggtggatcatttgaggtcaggagttcgagaccagcctggccaacatggtgaaagcccgcctctactaaaaatacaaaaattagccgggccgtagtggcgtgcgcctgtaatctcagctacttggtagactgaggcaggagtatcgcttgagcccgggaggcagaggttgcggtaagccaagatcgcgccactgcactccagtctgggcgagagagtgagaccctgtctcaaaaaaaaaaaaaaaaaaaaaattgtcatatctgttgccatagcaatgaagtaagctactcatcagtcttcctacacctctgtacatttattaagccttctatttgaataaatataaacttcatttcaggataaaatatatagggaatggcaaaactatgaaattatttaacttgcttaaaagattaaaactgaactcaactttaattctaggccctgggccggcccttcaaagcattggaaagtcgtgaaattgatgtgttgctctctcttttccagctgaactgtcccaagcaataaacagtggtacattgttatcaaaaccgtccccacccttaccacctaagagaggcattccatcaacctcagtacccaccttggagtctgctgctgccatcaccacaaaaacaccaagtgatgaaagagagaagagcacgtgttctatgggctcggaactactaccaatgatctcacctcgctctccgtcccccccactgcctactcatatacctccagagcctccacgcacccctccattccctgctaagacttttcaagttgtgccagaaattgagtttccaccatccttagatctacaccaggagattccccagcaggaagatcagaaaaaggaagtccccaagaggatactggaccagaactttggggagccccatataccctctaggctgcctccactcccactgcatattcgaatccagcaggccctcaccagcccacttcccatgactcctattctggagggttctcacagagctcattcgttgctttttgaaaacagtgacagcttttctgaggacagcagtacgctgggtcggaccaggtctcttcccatcactattgaaatgctaaaagtgtaagtgcctttaaagcttgcctcttatttctcctttactctagatagccctgcttggaaaaaattacttataaaaagaaaatgtgggccgggcctagtggcccacacctgtaagcccagcactttgggaagctgaggcaaatggaccgatcacctgaggtcaggagttcaagaccagcctggccaatacagtaaaaccctgtctcgatgaaaataacaaaaattggccaggcgtggtggcacatacctgtaatcccagctactcgggaggctgaggcaggagaatcgctttaacagggaggtggaggttgcagtgagccaagactgtgccactgtactccagcctgggcgacaaagcgagtctctgtctcacagaaaaaaagaaaatgtgaataatttttttttttccgagatggagtcctgctctgtcacccgggctggagtgcagtggcacgatctccgctcactgtaacctctgccgcccaggttcaagcgattctcctgcctcagcctcccgagtagctgagactacaggcatgtgccaccacattcggctgatttttgtatttttagtggagatggggtttcaacatgttggccaggctggtctcgaactcctgacctcaggtgatccacctgcatcggtctcacaaagtgctgggattgcaagtgtgagccaccgcgcccagcattgtgaataaatttaaagtacaaagaatactctgccaaaagaataagttatagaatttggactctttctttttttaatcttaccttaaaactttatttttatttatttatttatttatttatgtttgagacaggttctcactctctcactcaagctggagtcagtggtgcagtcttggctcactgcaacctccatctcctgggctcaagcaattctccctcctcagcctcccgagtaactgtgactacaggcgcatgccatcacacccagctaatttttatattttttgttagagatgggattttgccatgttgcccaggctcaccctgaactcctgggctcaagcagtctgcctgcctcaacctcccagaatgctgggatcatgggtgtgagccactgcgcctggccaaattttgattttttactcttgtgattttttttttttcatggagatttttgtgatgacacaaaatttacaaaattatgtacatgaaaaattacaaccgctagttttatatactacagggaaggcattgtataatgttgtgcttaagagcattcaccttggagtgagatagccctgggttcaaattgcagcactaccactcttagcttatagtagtgttaagttactgaagccttctgctctttagttatatcatctctaaatgggaataatatttactctgtaggcttgtgagaatgacattagacaaattctggaaagcaccagtgcctaataagtggtaaagctgggatctgaacccttagattaatacctgctaaaaagtttcttagtaagattgttaaagttaagggagagaattaattataagttacttcatccatagatttttttgtatttatggttatttcagtcctttgtcttttttttttttttgagatagaatctcactcttgtcacccaggctggaatgtagtggcacaatctcggttcacttcaacctctgcctcctgggttcaagagattctcctgcctcagcctctcaagtagctgggattacaggcacctgccaccatgccaggctaatttttgtatttttagtagacacagggtttcaccatgttggccaggctggtctcaaactcctgacctcaggtgaatttgcccacctccatctcccaaagtgctgggattacagccatgagccaccacgcccagtctttatttcagtcctttgtcttaaaagtcagttatcctcttcatttctaaaaggaaaatataattatgttaatttgttagtccagacgatgaagaagaagaggagcaaacctgtccatccacattcagtgaagaaatgacacctacctcagtcattcctaaattaccacagtgtctacgggaggaagaagagaaggagagcgactctgattcagaaggtcccattcagtaccgagatgaagaagatgaagatgaaagctatcagagtaagaaagggagggaaaagcaaaacagagaattcttttccagataaaactatttgctgatcttagcaagtgtcaaaagagatatggaaacaggtaccttctcccattaagtcatctggctaactgatgttggaagccactgtgaaggactccttgtccctattatcacccctctgttaaaacaagccaagacagggatccaagtagattgagtcactcaggttttaggttttttgtttttttttgttttaatttttttttttttttttggacaaggttttgatctgtcacccagctggagtacagtggtgcaatcgtcgctcactgtagcctccaactcctggacttaagtgatccttacgcctcaacctcccaaatagctaggacagatgtgtgccacaactggttaggtttctttgattttttgttttgttttttgtttttgtagagacagggtctcgttaggttgcctagcctgttctttttttttttttttgagacggagttttgctcttgttgcccaggctggagtgcaatggtgcgatctcggctcagtttaacctccacctcccaggttcaagcaattctcctgtctcagcctcccaagtagctgggattacaggcatgtgccaccacacctggctaattttgtatttttagtagagatggggcttcaccatgttggtcagactggtctcaaactcccgacctcaggtgatctgcctgcctcggcctcccaaagtgctgggattataggtgtcagccaccgtgcctggccataaaagatatatatataattttttttttttttttagacagagtcttgctctgtcatccagactggagtgcaggggcacgatctcaactcactgcaacctccacctcccgggttcaagcaattctcctgcctcagcctcccaagtagctgggattacaggcgtctgccactaggcccagctaatttttttttatttttagtagaggcggcgcttcactgtgttggccaggctggtctcgaactcgacctcgtgatccgcccacctcccacagtgctgagattataggtgtgagccactgtgcccagctgcccaggctgttattgaactcctgacctcatgtgatccccctgccttgacctcccaaagctctaggattacaggcatgagccaccgtgcctagcctatttttaatttttatagatatataatagtaatatatatttatggggtacatgagatattttgatataagcatgtgtgtatgggtaattaggctatccatctcaagcacttatcatttgtttgtattgggattattccaaatctacctttctggttatcttgaaatatacaatgaattattgttaactatagtcaccctattgtgccaccgaacactagatcttattcctttttttttgagacagtgtctcactctgcaggctagagtgcagtggcacaatctcagctcaatggaacctccacttcctggctcaagcaatgctccaacctcagcctcccaagtagctgagaacacaggtgtgagccaccacgcccagctcatttttgtatttttttatagagacagcgtttcaccatgttgcccaggctggtctcgaacttgtgagctcaaagtgatctgcccacctcagctcccaaagtgctgcgattacaggcatgagccaccacgcccggcctagatcttatttcttctatctaattctgtttttatacccattaaccagtctctctctcccccatcccctctacccttccctgcctctggtaaccaccattttatttattacctccatgagatcaacttttttagctcccacgtaagagtgagaacatacaacatttatctttctgtgcctggcttatttcacttaacgtaattgtcctccagttccatccattttgttgcacataacaggatttctttctttttcatggcagaataatcttcaattgtgtatatacaccacgttttctttatcccttcatttattgatggacatttagtctgattccatatcttggggattataaatagtactgcaataagcatgactgattgatttgctgatttcctttcttttggatatgtacccaacagtgggattgctggatcgtatggtagttctattttttttttaatagacggaggctcactctgtcaccaggcaggagtgcagaggcacgatctcagctcactgtaacctccgcctcccaggttcaagcgattctcctgcctcagcctcccaagtagctgggattacaggtgtgtatcaccatgcccagctcattttagtttttgtttttgtttttgtttttgtttttttagtggagacagggtttcaccatattggctgggatggtcttgatctcttgacctcatgatccacctgccttggcctcccaaagtgctgggattacaggcatgagccaccgtgactggcccggtagttctatttttaagggtgttttgtttgttttgttttgttttttaagtagagacacagtcttgctgtgttgctcagactgatctgaaactcccagcctcaagcaatcctcctgccttggcctcccaatgtgctgcattacaagcatgagccacctcatttggcctattttcagttttttaaggaacctccatagtgttttccacaatggctgtactaatttcaggtttttgtttgcccccaattttaaaactattcacctaagtgcctctaatcccagcactttgggaggccgaggccggtgaggtcaggagcttgagaccagcctggccaacatggtgaaaccccatctcttctaaagatagaaaaaattagccaggcatggctggccacggtggctcacacctataatcccaacactttgggaggccgaggcaggcggatcacctgaggtcaggagttcgagatcagcctggccaatgtggtgaaaccccatctctactaaaaataaaaaattggctgagcatggtagcaggcgcctgtaatcccagctactcaggaggctgaggcaggagaattgcttgaacccaggagacggaagtcgcagtgagccaagactgtgccactacactccagccggggtcacagagcgagactctgtcgcaaaaaaaaaaaaaaaaagccaggcatggtgacaggcacctgtaaccccagctactcaggaggctgaggcaggagaattgcttgagcctgggaggcggaggttgcagtgagccgagatcttgccactgcactgcaacctgggcaacagagcaagactccgcctcagaaaaaaaaaaaaaaaaagaggccaggcgtggtggctcacgcctataatccctgcactttgggaggccgaggtgggtggatcacctgaggtcaggagttcaaaccagcctggccaacataacgaaacccgaaacccggtgtctactaaaaatacaaaaaattagctgggcgtggtgacccacgcctataatctcagctactcaggaggctaaggcaggagaatcacttgaacctgggaggcggaggttgcaatgagctgaaatcgtgacactgcactccagcctgggcaacaagagcaaaagctctgtctcaaacaaacaaacaaacaaaaaaaccaacaacaatatggagtagaggaaaggtggcacatgggctaaggtgaaaagataaaagtgatgttttccctttggtctaatgaacttattgccacagggcagagaaaaataaacattttcataccctcacatctttgcaaataattgagtcctgattaattgaagtagaaaggcagctttaaaaacagatagactatgaggtgttagtatgaaagcctttatgttttaattcagagggctgtcccatgcttagattctctctcctgtagcaactcttaccaaggaggaaaaatgtagaggcctgatagaagagaaaagataccttttaaccatcttagtccacctggctaaaaagatttttaggtgtctttagctttacccccacctcagtgttcagctggatcatttgaggccaggtgggaactgggaattaaatattgtatttgttcagactcttgactagctccaggtaaggttgaacctttggctttaagcctcaagttctacatttttttcttccccgtgtgcaaaggtgctctcgccaacaaagtgaagaggaaagacacactggcaatgaagttgaaccacagacccagtgaaccagagttgaacctgaattcttggccttgtaaaagcaaggaggagtggaatgaaatacggcaccagattggaaacacactgatccggtaggcctttgcttagatttgcttgattgatttggttatgccagtatttgtgttagatgttgttagatgtgttgtttttttgtgtgtgttttgtttcgttttctgagacagggtcttgctctgtcacccaggctggagtagtggcgcgatctcggctcactgtaacctccacctcccaggttcgagcaattctcctgcatcagtctcctgagtagctggcgttataggcacctgccaccacgccaggctaatttttgtattcttagcaaagacagcgtttcgccatgttggccgggctggtctcgaactgctggcctcaagtgatcacccaccttggcctccacaagtgctgggattacaggcatgagcccctatacctagtctatatgtttactttgttgtggagtattcatttatcttttttagtgtgatttttttttcttttcagacagagtcttgatctgtcacccaggctggagtgcagtggttcaatcatggctcaccacctccaactcttgggttcaaggcaccctcccacctcagcctcttgactagctgggtcctcaggcatgcgccaccatgcactgctaatttttgtaattttttgtagagacagggtctctctgtgtttcccaggctggtctcaaactcatggcctcaaacattcctcccacgttgccctccgaaagtcctgggattataggtgtaagccaccacacccatcactttgagtataattttaaaaaatacatattgggttttgcatgaaaggagagaaggttagcactccacttgacaaggatggaagaggccctttgggcctgacaacacacatacaaggcattgccacctactacgtggcatctaactatctttacaaaaaaagaaaaagaaaagaaaagaggctgggtgcagtggctcatgcctgtaatcctagaacttcgggaggctgaggtaggcagatcatctgaggtcaggagttcaagaccagcctgaccaatatgatgaaaccccatctctactaaaaatacaaaaattagccaggcatggtggcatgcgcctatagtcccagctactcgggaggctgagatcggagaattgcttgaacccaagaggcagaggctgcagtgagctgagatcgcgccactgtactgcagcctgggcaacagagtgagactccatctaaaaaaaaaaaaaagaaaagaaaagaaacaaaaaaatatatattggacacagttgggtatcctctaagaatttggaaattgaagatgtagctgcctgtgagagttttattttatttattttatttttgagatggagcctcgctctgtcacccaggctggagtgcaatggtgcaatctcggcttactgcaacctctgcctcccgggttcaagtgcttctcctgcctcagcctcctgagtagctgggactacaagctcataccaccacacctggctaatttttgtatttttagtaaagatggggtttcaccatgttggccaggctggtctcgatctcctgactcaggtgatctgcccgccttcgactcacaaagtgctgggattacaggtgtgagccaccacacctggccagcctgtgagagctttaaaccatgagatagacatatggttttgcaaaagtttctacataaatcagaatggttcccagaacagaaaggctcctctgtcactttttttatctggttgcttaaccataagatgccaacccaattaacagtcacacccatatttgcattatatctgtttcatatgttccgtgtaactgcctcctttcaaagtgttggtatatttttcaagtcaactggaaccaaaagtatagagaaactgaatgcaagccagctttctgcatatgtaacagtgtaagaatccaggttgtatagatgggtttttgtttgacacagatgtttctcccagtaaagagaggataaggagctggaactcgtggcacagttccctacaaaataattaattgatcatgtctactaattaaaatttctttttctgtactattgcagatacctggttttggctgggcaaggtggctcacacctataatcccaacattttgggaggctcacttgaggtgggaggctcacttgagcccaggagtttcagagcaacccgggcaacaaagtgagatcccatctgtacaaaaaattaaaaaattagctgggcatggtggcacatacctctagtccagctattctggaagcttaggtagaaggatcacttgagcctgagagatcaaggccgcagtatgctgtaattgcaccactgcactccaccctgggtgacagagcaaaaccctgtctcaaaaaaaaaaaaaaagagacacctggctttactgtgtatgctgtacctcagggcaagttttccctttgtcttctaatagacactttttggatccagaaattgttctctgcaatttctttacttaaacataattatcagcctgtatgacctctgtggtctgactactttgaaattaagggagaaggctgggcacggtggctcactcctgtaatcccagcactttgggaggctgaggtgggcggatcacttgagcccaggagttcgaggcaacatgacaagaccctgtctcgacaaaaaaacaaaaaacttagccagacatggtgacacacgtttatggtcccagctactcaagaggctgaggcagggggattgcttgagcccaggaggggctcaaggtcggcccaggaggtcaagacccaggcgatcaaggcccaggaggtcaagactgcagtgagctgtgctcatgccccactgcactccagcccagtcatcagagcaaaaccttgtctcaaaaaaaagtaaagaaagacatgtttattatatggtagtttgaaaaattacaaaaaaaagagataaatcatggccggacgcggtggctcacgcctgtaatctcagcactttgggaggccgaggcgggtggatcatgaggtcaggagatcaaggccatcctggctaacacgatgaaaccccgtctctactaaaaatacaaaaaaattagctgggtgtggtgctgggcctgtagcccagctactcgggaggctgaggcaggagaatggcatgaacctgggaggtggagcttgcagtgagctgacatcgtgccactgcactccagcctgggtgacagagcaagactccgtctcaaaaaaaaaaaaaaaaaaaaagagagagataaatcagccataatcctataccctataagccaggatttggcaaacttcttctgtaaagaaccaaatagtaaatattttaggatagggtgcagtggctcatgcctataatctccgtactttgggaggccagtgtggaagaattgcttgaggccaggagtttgagaccagcctgggtaacatagtaagactctatcactacaaaaataaaaataggtcaggcacagtggctcacacctgtaatcccagcacgtttgaaggccgaggcaggtggatcacatgagatcaggagttccagaccagcctggccaacatggtgaaaccccatctactaaaaatacaaaaattagccaggcgtggtggcgcccacctgtaatcccagctactcaggacactgaggcaagagaatcacttgaacccaggaggcagaggtttcagtgagctgagatcacaccatggcactccagtctggacgacagagtaagactccatctcaaaaaataataaataaaatagccaggcatggtagcatgcccctgtagtcctagctacgtgggaggctgtggcagcagaactacttaagcccagtagtctatatactagacagggcataaatatagttatatttaatatatttaatatatgtgtgtatgtgtatatatatgtgtgtatgtgtatatatatgtgtgtatgtgtatatatgtgtgtatgtgtatatatatgtgtgtatgtaatatatatgtgtgtatgtaatatatatgtgtacgtgtgtgtatatatgtccatatatatatatggatttgatggccatataaactctctctttttttttttcctacctttaaaaatataaaaacatgggtcgggcgcagtggctcatgcctgtaatcccagcactttgggaggccgaggcgggtggatcacgaggtcaggagacagagaccatcctggctaacacggtgaaaccccatctctactaaaattacaaaaaatttagccgggtggtggcaggcacctgtagtcccagctactcgggaggctgaggcaggagaatcgcttgaacccaggggacagaggttgcagtgagctgagttcacaccactgcactccagcctgggcaacaagagcaaaagaaactccgtttcaaaagaaaatatagtttatacatacagtggaatattatttaatcttaaaaaagaaggaaatcctccaatatgctaacaacatagtcaaaccttgaggacattaatatgagtaagccagtcacagaacaataaatactgcatgattccacttctgcgaggtatctgaaatagtcacatttatagaagcagagagtagaaagatagttgtcaggggctcgggattgaaggcaggggtgatagggagttgctaataaataagtataaagttttagttatgcatgatgagtaagttctagagatccactgtacaacattgtgtttatagttaatactgtagactgggcgcggtggctcacgcctgtaatcccaacactttgggacaccgaggcaggcagatcacgaggtcaggaggtcaagaccagcctggccaacgtgatgaaaccccatctctactaaaaatacaaaaattagccgggtgttgtggcaggcacctgtaatcccagctagtcaggaggctgaggcaggagaattgcttgaacccgggaggcagaggtttcagtgagccgggatcccgtgccactgcactccagcctgggcaacagagtgagactctgtctcaatcaatcagtcaatagttaatactgtattggccaggtgtggtggctcatgcctataatcccaatactttgggaggccgaggcaggcgtatcacgaggtcaggagttccagaccagcctgaccaacatggtgaaaccccatctctactaaaaatacaaaaattagccgggtgtggtggcgcatgcctgtaatcccagctactcaggaggctgaggcaggagaatcgcttgaacctgggaggcagaggttgcaatgagccaagatcacgccactgcactccagcctgggcaacagagtgagactctccatctcaaaaaaaataataataatactgtattgtacacttaaaagtctgttcaaaaggtagatctcatagtaagtgttatcactataaaataagattgaaatttaaaaaaacacacacaataagagaccaccacgagtacactaggatggctaaagttatgcaatttaaaagactgacaaggccgggtgtggtggctcacccctgtaatcccagcactttgggaggccgaggcaggcagatcacctgaggttgggagttcgagaccagcctgatcaacatggagaaacttcatctctactaaaaatacaaaattagctgggcgtggtagcacatgcctgtaatcccagctacttgggaggctgaggcaggagaatcacttgaaccggggaggcagaggttacagtgagccaagatcgggccactgcactccagcttgggcaacagtgcaaaactctgtctcaaaaagaaaggaaaggaaataaatacaggagtgatatgttcattcttgcaattgtgatgatgatttcacaggtgatatatggcaaaagtggccaaattgtacatgttaagtatgtacacagttgtacatatttacagtattattgtgtcagttatatcgtattaaagctggtttgttttttgttttttgttttttgtttttccgaagaacatttaaaaaggaaggcccaggccaggcatggtggctcatgcctgtaatcccaacactttgggaggctgaggtaggaagatcacttaacgtctggagttcaagaccagcctgaccaacatgctgaaaccccatctctattaaaagttagctgggcctagtggtgcatgcctgtagtctcagctactcaggaggctgaggcagggcaatcacttgaacccaggaggctgaggttgcagtgagccaaggtggcgccagtgcactccagcctgggcgacagagtgagactctgtctcaaaaaaaaaaacaggaaggtccagctgggtgtggtggctaacatctctaattccagccctttgggaggctgagctgggggaatcacttgagcccaggaatttgagaccagcctgggcaatatggcaaaactccatcactaccaaaaataaaaaaattagccagcccagtctctaaataaataaatacatacatacatacatacgtactttttaaaaaataaaatggggcggggcacagtggctcacgcctgtaatcccagcactttgggaggccgaggcaggcggatcacaaggtcaggagattgagaccatcctggctaacacggtgaaacgccatctctactaaaactacaaaaacttagccgggcatggtggcacgcgcctatagtcccagctactcgggaggctgcggcaggagaatctcttgaacctgggaggcggaggttgcagtgagccgagatcaagccactgtattccagcctgggcggcagagcaagattctgcctaaaaaaaaataaaaataaaataaaaataaataaataaaatggaagatccttgaggtaggaggatcatttgagcctaggaggtggagctgcagtgagctgtgatcgcaccactgcactctagcctgggtacagagtgagaccctgacacacacacaaaaaaaaaaaaaaaaaaaggaaggtcttgttcagaaagaaaagttgtatatagaatgggactggaagttccttatgcaagcaacagaagagttgaaaattttgcaagtactagctaattagcccaaatactgtctgagaagtataaattaaaagtaagaaatgaataactttctgatttcaaaaatgacaaattgtagttttttgttgttttttttttttttttttttttttttgagatggaatctcactctgtcgcccaagcaggagtgcagtagcatgagcttcagctcactgcaacctccatctcccaggttcaagcattctcctgcctcagcctcccgagtagctgggactacaggagcacgccacaacatccggctaatttttgtatttttcagtagagacagggtttcaccatgttggccaggctggttttgagttcctgacctcaggtgatccacctgcttcagcttcccaaagtgctggggattacatgcatgagccaccacacctggccaacaaattgttattggtgaataacatctcagaactgtgatgaggtgagataactttatcaaatgcttcacagagaagactgagatttaaatcatagaattatagaatatcacacagaaagagacaaacttaaattccagtggttcctaaaccactgatttaaaaacctagctgggcatggccaggcgtggtggctcacgcctgtaatcccagcactttgggaggccgaggcaggcggatcacaaggtcaggagatcgagaccatcctggctaacacggtgaaaccccgtctctactaaaaatacaaaaaattagccaggcgtggtggcaggcgcctgtagtcccagctacttggaaggctgaggcaggagaatgtcatgaacccgggaggcggagcttgtagtgagccgagattgcaccactgcactccagcctaggtgacagagcaagactccatctcaaaaataacctagctggacataatggcttgcgcctataatcccagcagtttggggggccaaggcgggaagatagcttgagcccaggaggagttcaagactatcctgggcaacagagtgagaccctcatctctattttcaaaaaattgtaaaaaaaaaaaatctaaagaggggcatctgagtcatagaagaagttttgtgaaaaaaaaaatctatatatagatatatgtaatttcatttttcatcctgattttctgaatcagaatttctgttaacgtttcttgggaatctgtgttttctaaaaagtctctaatgcttctgaaggagcaaatttgtttaggagccaccagttcggtccaaaccttcgcttcacggatgaggacactcaaggtctaactgaacttttttgtgctaatagctcttatcaaggtctagaactagaatcctggccacttgtttgcatatacagttcctttttataatgtgatatctgtgttaacacttttaatgtgaaattgttttataaacaatcataaataaatgaaatatatcagtttgaaaatttgttgatttcttacttatataggggctaatatatactgtgaccaaaaaaatctttataaacaagattgggaggtttaacataaacattacctttatttatctcatttttaggcgactgagtcaaagaccaacaccagaagaactagaacaacgcaatatattgcaacgtgagtccagttatggaaataaagttgtatagattttctttgtatgtttctgactttaatatacataaaagaaaaaagaagcgtttgctacaagggctaagggagagtgttccagccaggcaaggactatttatttccccatgaaggaacagagcttaccaagcttcctttggaagatgctattatggtattgtttagtgtgctgtgatactctagaaagctttgtttcagtgttctcactgtatcctggaactgccttgggcatttgggaggctttgacagtatatgggagatgtgcccaatttttctgttttcagggagctaaggaggtagctgtgcatatggagaccttcctattcctagaatgtgagggctggggcccaaagcaagtcccaaatgcagcagcttttctcttggtttaatcccttaagactttcttacctctgtagttaccaaatgggaccatatatttaatttgctgtctgtgtacataattaatttcctgaaatagcattctaatctagtacatatttcatttgtttttccagaatatagagtgaaatttggccttaaaagtctcctcactgagaaggtttgggcttccttggggctatttgtgagcatgttcagtctgaccaatccatcccctgttctctcagcactacttgggtatacacaacttaataacttagtacattttctagtgtgggagcccttataacgtatcacacaaaactcagtgtgatcaccattgtccattcttagcagttactcttgagcaagaatctgcaggcttttccttaaagcatacatagtaaacattttgggttttgcaggccaaaaagcaaatgaacaactatacgtaataggtccttacaaaaccatttaaaaatgtgaagactattcttagttcatgggcaggaaaaatacaggcaactggcgagatgtggtgccatagtttgctgactcttgcttttaagtatttgtatcgttgacaagaaaattgttttgtttagccatccccaaagttagtattttattctgatttgggcctataagaaatatctgggccgaggcgagtggatcacaaggtcaggagatcgagaccatcctggctaacatggtgaaaccccgtctctactaaaaatacaaaaaaattagccgggcatggtggcgggcgcctgtagtcccagctactcgggaggctgaggcaggagaatggcgtgaacccgggaagcggagcttgcagtgagccgagattgcgccactgcactccagcatgggcgacaaagcaagactccatctcaaaaaaaaaaaagaaaaaaaaagaaatatctgggctgggcacggtggctcacgcctgtaatcccagcactttggaaggccgaggcgggtggatcacctgaggtcaggagtttgagaccagcctgaccaatatgatgaaactctgtctctactaaaaatacaaaaatcagctgtgcatggcatgtgcctgtaatcccagctactcgggaggctgagacaggagaatcgcttgaactcgggaggccgaggttgcagtgagccaagattgtaccattgcactccagcctgggcaacaagagcaaaactccgtctcaaaaaaaaaaaacaaaaaagaaatatctgtaatgtaattactaaaacgtttgatatgcaaattgtcatttgtgagtaatattccttccttctgattgtcaactgtagctaaaaatgaagctgatcgtcaggcagaaaaacgagaaattaaacgtcggctcactagaaaggtactactgcctgtgtgttcagttaactatatgtgttatatttggatggcctatttgattggaaatgaattcacagctgggcacagtggcttgcgcctgtaatcccagcactttggaaggccatggcaggaggattgcttgagcccaggagttcaagaccagcctggggaaaacagtgaaaccttgtgtctacattaaaaaaaaaaaaaagaagaagaaagaaaagaaaaagaaaaaaatgaatttgcagcctgggcaacatggcaagaccccacctctacaaaaaaaaatatatattagccaggcatggtggtatgcgcctgtaatatcagctacttgggaggctgaggtaggaggatcatttgagcttgggaggttgaggctgcagtgagctgtgattgtgccactgcactccagcctgggtgacagggcaagaccctgtctcaaaaaaaaaaacaaaacaaaaaaccacctgataaccataatcactgggggtgggacctccagggatcaatagtgtctaaagctcccccaggtgattccaatgaagattgaagcactgggttagaggcaatttgaatgcatgattgatgcctaattattggcttggtgaactaagaggctccgtttccttcagctcagtcaaaggccaactgtcgctgaactccttgccaggaagattctgaggtttaatgaatatgtagaggtaacagatgctcaagattatgaccggcgagccgacaaaccttggaccaaactgacccctgctgacaaggtacctggaaagcactctcttgctttttttctctttctctttttctctttatttggaggatccaagatactaactagaagggagaaccataaacaaaacttctagttttaatataatattaaatttcaaatcaagatacaaaatgccaagttgaacaagtcaaaatgttatactaactcagtatgttttggtaactccaccaccaatactgaaagaaagaaaatccctgctatctcacagagtaaaaatactggaaggaataaatacatttcaaacagtggttgtttggttagagggagtttgggctatatattttagtaattaccaatatttcatttttataatgctgtgaaaaactataaaagctggccaggcgtggtggcttatgcctgtaatcctagcactttgggaggccaatgcagagggatcactcgaggtaaggagttcgagaccagcctggccaacatggtgaaaccccatctctactaaaaatacaaaaattagctgggtgtgatggcatgcacctgtaataccagctacttggaaggctgaagcaggagaattgcttgaacctaggaggtggaggttgcagtgagccaagatcatgccaatgcactccagcctgggcagcagagtgagactccacctcaaaaataaaaataaaaaattaaaattaaaaaaaaaacaaaactagccaggtgcagtggctcacacctgtaatcccagcactttgggaggccgaagcaggtagatctcttgaggtcaggagttcaagaccagcctggccaacatggtgaaaccctgtctgtactaaaaatacaaaatagccggacgtggtagtgcgcacctgtaatcccagctattcgggaggctgaggcaggagaatcgcctgaacccaggagctgaaggttgcagtgagctgagattgcaccactgcactccagccccagcaacggagcgagattccatctcagggaaaaacaaaaataaaaacaaaactataaaagctacaatatatctttcaagattttcaagtattttgattaaactaaaaattttaggtttattatgagacagatgggtatcattgtgttgacctggtgtctgggttgcctgtgaggggttgcagtgacttacaaagttaaacacagtacagaaaaatgacaagttacactgctgtgcaaagcagccagaagaagctgaaacatttttgtctctactccacaggctgccataagaaaagaattaaatgaatttaaaagctccgagatggaggttcatgaagagagcaaacattttacacggtaagacccaaaagacccaatcatatatgtgctaggtagagttttccaaaaaattgttcagatatgaagggctctaatgacatcagtaaaaaggaaaacactcagtgttgattgcaagactgcattcaaagggatgaaaagtaagaagcaatagtaaatgcctaggccaggtgcggtggctcacgcctgtaatcccagtactttgggaggctgaggcaggtggatcacctgaggtcaggagtttgagaccagccggaccaacatggcaaaaccccatctctactaaaaatacaaaaattagctgggcctggtagcaggcgcctgtaatcccaactattagggaggatgatgcgggagaatcacttgaacccgggagatggaggttgtagtgagctgagatcatgccattgcactccagcctgggtgacaagagcaaaactccatctcaaaaaaaaaaaaaaaataagtaaatgtgtattctgattatggcatttcatgtatattatttaatccttgtaataaacatgcaagatgtgttaacatccccattttatcactgaggaaatggaggctcacaatggttaagtaacttggttgacttgctagtaaattgcagaaccaggattcggagaaagaaatcaatgacttcaaggatgtgaggtgctctcttccttgtaccttactctctcaggttataaatgaggagactgtgctaagttagacaagatcttgccctctctggttcagttctgtctagcacagttgatcttaccaacttaatgtataaacaacattttaattagctgtcttcatgaaacaagccaagaaatccaacaaagccaacaagccaacaaatcaagtgttttgatttggaattacggttgtgattaaggacccacccatatccaaagaatcagctagccacaaatggaatcagtgaaagtatctttacatgattcttagaacatttacaaaaagaggcaaatgaggctgagtgcagtggttcatgcctgtaatctcgacactttgagtggctgaggcgggaggatcgcttgagcacaggagtttgacaccagcctgagcaacatagtaagactccatccctacaaaaaaaaaaaaaatctattttttgatttaggcaggggcctggtgcagtggtacacacctgtaatcctagcactttgggaggccgaggtgggaggatcactttgagaccagcctgggaaacacggtgagccccatctctacaaaaaataaacttaaaaaaaaaataagcaaggtgcagccaggcgcagtggctcacacctgtaatcccagcactttgggaggctgaggcaggtggatcacttgaggccagttggagaccagcctggtcaacatggtgaaaccctgtctctactaaaaatacaaaaattagccgggcatggtggcatgcctgtagtcccagatacttgggaggctgaagcaggagaatcacttgaaccccggaagcagaggttgcagtgagccgagatcgcgcaactgcgctccaacctgggcaacagagcaagactgtctctcaaaaaaagaaaaagaaggaccagcttaagcaagacgatgggagagaggaaaacacatggtgtttctgggtaacagaaaatgtagctggatcagaggatgtttggggcagtgtggtgaaaataaactagaaaatgggttgcagtccctcgcaatgctttgactgttatgctaggatgttggaaccattggcagttcataagcaggaaattctgtgtatttcagaacaagctctgatgcaaacaacaaagatgatatggaaggatgaagagactagcagcaaggaaaacaggaagtatctgaaataatcttagtgagcatagtggtagctcacaccagagatagtgagaatgcaaaggtgatagatttgtaagacatttcaagcatagaatcaacaagatgtggcaatttgttggattccagagatgaaataaaggagtagtcaaaatgactctgatatttttaacttgtattttttgaggtctttgaaggtgataagtttagctgaacagtttagtttattcaacaaatactgagcacctaccacgataggtatagtgctaggtccttgggctacagcaggaaataagataaagtctctgtcctcaatgaggctttattctttttttttctttttttaatagagatggggtctcactatgtttcccaggctggtcttgaattcctggcctcaagtgatcctcccatcttggcctcccgaagtgttgggattacaagtgtgagccactatgcctggccaagcttttattctaaaagaagaaggcagacaatgaacaagctagaaaataaattgcatgtgtttagtttgaggagcctatgacacatggagatacctagaagaccattagatatgcagcctagaatccagaaagaaagcaaagtctcaagatacaaatgaaagaagatagtggacctttaggggggattttatttttatttatttattttttttttttttattttttgagacaaggtctcactctgtcacccaggctggagtgcagtggcatgatcgtggctcactgcagcctcaacctctcatgttcaagccatcctcccacctcagcctcctcagtagctgtgactacaggcacaggccaccacacctggctaactttttgatcatttgtagagacagggtctccgtatgttgcccaggctgctctcaaactcctggtctcaaatgatcttctcaccttggcctcccaaagtgttgggattgattacaggcatgagccaccgtgactggccaaggaaagttgttttttatttaaagggtagacagaggaaaatgaaccaggacagcatactgagaaagatcaattgaagaagagagaaaattatggaaaagatagtgttacagaagccaagagaagagttcttttttttttttttttttttttttgagacggagtctcgctgtgtcacccaggctggagtgcagtggcgcgatctcggctcactgcaaactccacctcccaggttcacgccattctcctgcctcagcctcgcgagtagctgggactacaggtgcgcgccaccacgcccagctaattttttgtatttttagtagagacagggtttcaccgtgttagccaggatggtctcaatctcctgacctcttgatccgcccgcctcggcctcccaaagtgctgggattacaggtgtgaaccattgcgcccagccgagaagagttttaagaaggaagcagatgaggagtatcagatgcaacagaaaggtcaggtcgaattagagcagaggaaaggcagtgttaattaggtataacatttcattactactgatacattaatagcaaagcaatgtacatcatgtggtaacttgtctcttttttaatctcttttagctaccatcgtccatgatgccaaaggttgagagaggaatcaacatggctgctttgctgcttccttctccaaagtgacatatggagggaactttagcacttcccagcacagccagaattgcatcctctgggatcttctgaggtggacagcactttgaatgtagcatttcactggaacagagtcttatgtgctgcaccgggggcaaaacaacactttgtcagtgcttttgaacctttcaatattgtagcatgcttgaggagtttttcccttactggccaccaaagttctgaaccacttgcaggttccaggttttactggctgcaccacaccccttcccctagatgactgcctgtgcagagacacagtttgcaccattagccttacctgccctgccctgattgtgagacccaaatgtgtaggctctaaattccagccatcaaatccaattcctggtggggaaaaccttctggagacccccaaccttctgataaaagagtctctacctccagggaaagccttcttaccacactggcatatcagatgaaagcattgcactgtacctctcgtaacacagcaatacagtcctcttgaggcactcaagcctgagaggaagctcaggatctgacatgttcttccttttcctcacaagtcatcatgattttttattttaaaataatctggaagtaatgggaacttagtttttcctgaactccaaccagaatccaaattggttagatgaggccaggcgcggtggctcacgcctgtaatcccagcactttgggaggccgaggtgggtggatcacctgaggtcaggagttcaagaccagcctggccaacatggtgaaaccccatctctactaaaaatacaaaaattagccaggtgtggtggcgcctggttgaggcatgagaatcgcttgaacccaggaggtggaggttgcagtgagccaagatcatgcctactgcactccagcctgggcaacaaagtgggactctgtcttaaaaaaaaaaaaaaaaaaaaaatcggttagatgagaaagcatgtatattttctatatacaaaaacaagaaaggcgttttgagcccctgtgctcaggcccactcccacactgtggagtgtactttcattttcaataaatccccttattccttccttgcaaaaaaaaaaaaaaaaaaagccttagccagattcagtggctcacgcctgtaatcccaacactttgggaggctgaggcgggtggatcacctgagttcaggagttcaagaccagcctggccaacatggcaaaaccctgtctctactaaaaagtaaaaaaaattagccgggcatggtggcttgtgccttgtagtcccagccactggggaggctgaggcgggagaattgcttgaacctgggaggtggagattgcagtgagccgagatcgcgccactgcactccagcctgggtgacagagcgagactccgtctcaaaaaaaaaaaaaaagccttaatattaatgctaacgtggcagaaaactagcaggttacattttataggctattgtagttttatttaccaaatgatattctctaaatcacttcgaccaataaatgtattctcctccttaaagcagagttgtatcaactctgtgggagcatttatgagctgtcagtccccacacttctagccagaatcacaataaggtctggctgggtgtggggtgctgcataggaaagggtctctggagaagcaagaagggcacaatcatggcccactgctcccctcttcttctcagtgctctttgccctctcctgctgcgtgcttcctcttcactccagtgctgatcctcctgctctctctggcagcttccacctcacccgcccctcttccacactataaccagtatggttggtgctggggcattgactcagcccccctgctttctgcatttgtaatagatattaatatgatttcctaaaacagaagattttgttgctttctttgaacttgtattgaaaaccatacagtctcactgttttgctttaattcctatccacactataaatggaagaaaaaaattaatagcttctgtttaatctgatgaatgtggctttttttcccttcactttaatgttcaagaagttgtggctatttcatagatttcttctgatttattctgtgggtccctgttatctgttctttatgtaatctttcagtagattttcatcctttcatatccacattcttatgtggacttgctgaagaaacagaatatcagttcaaaacaaaacctaggccaggcatggtggttcacgcctataatctcagcactttgggaagccaaggcggtcaggagtttgagaccagcctgaccaacatgatgaaaccctgtctctactaaaaatacaaaaattagcctggcgtggtggcacgcatctgtaatcccaactactcaggacgctgaggcaggagagtcgcttgaacccaggaggcggagattgcagtgagccaagattgcaccactgcactccagcctgggcaacagagcgagactccatcaaaaaaaaaaaaaaaaaagaaggaaggaaggaaagcaagccctgaatccacatctccttgaagttttttttgttttattttgtttttgagacagaattttgctcttgttgcccaggccggagtgcaatggtgcaatctcagctcactgcaacctccgcctcccgggttgaggcgattctcctacctcagcctcccaagtagctaggattacaggcatgagccaccacgcctggctaattttatatttctagtagagatgaggtttctccatgttggtcaggctggtctcaaactcccgacctcaggtgatccacccacctcagcctcccaaagtggtgggattacaggcatgagccaccgtgccgagccttccttgaagttttttgtttggttttgatttgttttgttttgttttgttttgttttgtttttggagatagggtctcactctgttacccatgctggagtgcagtggcacaatcttggctcagagcaacctctgcctcccaggctcaagcaatcctcccacttcagtctaagtagctgggactacaggcacgtgccaccaggcccagctaatttttgtgttttgttagagatgaggttttgccatattgcccaggctcgtcttgaacaccggggctcaaggaatctgcccatcttcgcctcccaaagttctgagatagcaggtgtgagtcatcatgcccagcctccttgaagtttactaacaattgggataactgagggaagagaagtgacaattccactcagtctattagaggtctggatataaggtagccacacaataactctaacttgacttctaaccattctatcttattgatttggaggctgtcttctgccagattttttgtggcttgagatgatattttcgaacccttctttcactacctttcttacccttaatgtgccaagcttgaaacaggatttgatttcctgagctacttgttcgccttctgtgcgtcaccaagtaatctggttcatctttcgtctcattcatgttattttcaagtgaaacaagacattttgggggtcaagtctctttgggtgttttgtttttatgtatataaaaatggattttgtgttccctttccatgtaagtaccaacttatatggaaactcacaatcataatgtaaagaagaaatgaaagcctggtgtattgtacttcaagatgcctccctgatgtatagaatctccttgtaaaataaataattgcattgtatatcagtcttcccatcaatattaattattaaatattttagaatttttaaataccaactata

SEQ ID NO: 696 - DNA, 4950 bp, Homo sapiens
gattctctaactgcgcatgcttctgcgcacgcgcaatagacattccaggacttccgggcacttcgtaaggtttaaaaaggatgcttcgcgttttctctctcctttttggagacagattcgcagtggtcgcttcttctccttggtaagtgtgatccttggtaagtgtgatcagatgcttgccaccggagttgtgggtctaatgctatagatcagtagccgagcttccctaggaagatcatatagtattttatttatttactttttttttttttttgagacggagtcggtttgtcactcaggctggactgcagtgctcgttgcaacctccgcctgccgggttcaagcgattctcgtgcctcagcctctccagcagctgggattacaggcacgtgccaccacgcccggccaatttttgtattcttagtggagacggggtttcgctatgttggtcaggctggttttgaactcctgatttccggtgatccaccaccctcggccttccaaagtgctgggattacaggcgtgagccaccgcgcctggccggaaatcatgtaatttaaaactatatatgggtgtcttaggcggcatcggtcccaactctaaagtacgcgttagacgggcctgggccagaagtgggccatggagacctcgggacccgcagggctgccgcccgacccagcgagcctctgaaggtgcaccgccacccccactgtttatcttactgcctcatagtaggcacattgtcgttctcaatataattgcacacagttttattctggatcctcatttgcctttaagaattttctcaatttttctttttatttgatcgcaccactgcaacctccgcctgctgggctcaagcaattctcctgccgcagcctcccgagtagctgggactacaggcgtgtaccaccgcgcctggcttatttttgtatttttagtagagacgggatttcaccatgttggccaggctggtctccaacgcctgaccttgtggtccgccacgccaggccgaagattttcataatttggaagcattgcgtttcgtaattatgctttctcgtatttttgtgatttgggtcatttttatttttatatttttaggattacaggcgtgagccatcgtgcctggccgatttgggggtaattaacaagtccacgtgtttcatttgaatttaggatagctgggcctaattgttgtctttgcttctgcggtaccttccacatagtactaaccgcctattgtaaagtaattagaatagctgaatatgcatgttaccagtctagaaaccgatttttttttaacaccccactgtggacagggtggaaactcgtttgctttcttgtttaagatctgtagtaacatgaatggatgaaattgtttcctattggattctgtaaatttatgcgttacactgattgtccaacgtggatacacccgggaggtcactctccccgggctctgtccaagtggcgtaggggagcatagggctctgccccatgatgtacaagtccctttccacaacgttggaaataaagctgggcctcgtgtctgcgcctgcatattcctacagcttcccagagtcctgtcgacaattactggggagacaaaccatgcaggaaacagccttctagagcactgaatctggattgaagtctttttttttttttttttttttggagatggagtcgctctgttgcccaggctggagtgcagtggcgcactccattgcctctgcctcccgggttcaagtgattatgctaagtgattctcctgccttggcctcctgagtagctgggattacaggcccccgccaccacgccaggctaatttttgtatttttagtaaagacagggtttcaccatgttggtcaggctggtctcaaactcctgaccttgtgatccgccagcctctggcctcccaaaatgttgggattacaggcgtgagccaccacacctggctggattgaagtcttaatacatgtttaagaaaaattggctaaaaagtagccaggcatgatgataggtagctggaggaaggagaatcgctggagcccaggagtgacctatactcaaacctatactccagtgccactgtactccaaccccaggcgatagcatgaggcccctcgttgaaaaagtttagggttttgctgtactaatagattaatatcttgttttgcaggatttgttaaggattccaagtaactcttatttggtgagtaaatctgctaattgttttttgcttatcagctctttgtcaatgatttctgtaatggaaataggattgaagagacttttattctagttggtcaggatttacctctgaggcatttaatcattctcagagcaatagccaaatatcgactttgctgcatttttgtaggcatgttgacataacttcaacatatgctctgttctgtaaaaattgctttttttagtcagctcattaaaagtgcaaagtagtaaaagctgccctagtgaactgtaggaagcctaattggctttatctacatgtgtagcctgagctgagaaagatactagcccttgaaaatactgtgggtgattagcaatattggatttgtcggttactccaattcctcactaatgagcattccaacgtggataccctgggaggtcactctccccaggctctgtccaagtggcataggggagcttagggctctgccccatgatgtacagtccctttccacaacgttgaagatgaagctgggcctcgtgtctgcgcctgcatattcctacagcttcccagagtcctgtggacaatgactggggagacaaaccatgcaggaaacatatctagtatactagattttaagttgaagtaggatcttcaggagtctaatcattatttcttttcttttaggagagaagacgatctgcacttcgcattttggcattgacatttaattttagggtcctttatatagaagggagagtaggtaaactgatttttttttttaacagggagggtttgacaatctttggcagacttggagcaaaagattgaggtgcatttcatgcctccttttgagagtcttgctctgtcgcccaggctgtagtgcagtggcgcaatcttggctgcaacctcagcctcccaagtagctgggattacaaacataagccaccacgcccagccctcatacctcttttaaaagtcgacctgttttgcagaaagtctgctgtttttgtactaaaggctttggaatttggcatttagctaggaatgcacattctttcacctcattcatactttaagaaccacagaagtgactctgcttggccagaaggcacactgtgttggtggttatattaaaagtccttgagtattttgcttttcatgatcttgctcactgcaacttccgcctcccaggttcaggcgattctcctgcctcagcctcccaagtagctgcgactacaggcgtgtagcaccacacctggctaatttttgtatttttagtagagatgaggtttcaccatattggccaggctgttctcaactcctgacctcgtgatccgcccacctcagcctcctaaagtgctgggattacagctgtgagccaccctgcccggccacttttgtatgatttctaatgtatttgtaatttacctaacaaattgcctaatctgctatgttaatgtatttatgaattaaaataaatacgactgcatgtttgtggttcatttttgtggaggtggctgtggtgacatcagccaagaatctgaatggtactgttgaaggaaactagcatgatagcttcagttctaaaggccctgaaacctagtctcaggtgggtcccccttgggttcactttatattggcagtttattgggaaaatggatattaggtcctgaccaataggaccgtaagtctgggttgagtgcaagatgagttagaccgattctttagcttcctgcagtgtagtggaggaaaaatcgatggtagcaacgggaggttgtatccctagctgatgagttgtatgagcctctactacctggcgcacctccgcctgaagattgccagaattgcttgcctcatgacgtgagtcacaatggaaactttgtcaagccccctgcactggctgccaacataaatgttcagtaccctgaaggatgggactgaagggggatcatctagaaggtaaagttacctactggcataggggaggtgggacagccgttaagccatttggaacttgatggagacaggtttgagggaggtgggtgagattggagtttggtggactgtagagcttgcttgccaaggtgttgaggtcagggttggtttgagaatggaagctagttactagctatgattgtgggggaacacagcttgatttttcttacaagctaagaggagtgaggcagtgtttaagagggcatgttaaatgcagccaggcttggtggctcacacccgtaatcccagcacttaggctaaggcaggcggatcacaacatctagagatcctggccaacgcggtgaaaccctgtctgtactaaaaatacaaaataactgggcatggtggtgtgcacctgtgggaggctgaggcagaattgctggaacccgggagatggaggttgtactgagctgagaccttgccactgcgctccagcctggtgacagagttaagtctcaaaaaaaaggcatcttcctaaagcaattgtatttgtgcttacctgtgccaggcactgttctaggtaagcactaagtgggctttaatacagcatattccaatggggaatcccaggaaccaaaagactaattgtccaagtccacaactagaagtggcacctctgcagaaacaagcatcaaattccctgctcaggaagaagccagatgagtcagccccattcgtctgtatgcccagtcccatccgtgtcctgctgtaactacatagatctcacctgagtaaagtgatttttttctgaa

SEQ ID NO: 697 - DNA, 4950 bp, Homo sapiens; identical to SEQ ID NO: 696

SEQ ID NO: 698 - DNA, 33254 bp, Homo sapiens
gattctctaactgcgcatgcttctgcgcacgcgcaatagacattccaggacttccgggcacttcgtaaggtttaaaaaggatgcttcgcgttttctctctcctttttggagacagattcgcagtggtcgcttcttctccttggtaagtgtgatccttggtaagtgtgatcagatgcttgccaccggagttgtgggtctaatgctatagatcagtagccgagcttccctaggaagatcatatagtattttatttatttactttttttttttttttgagacggagtcggtttgtcactcaggctggactgcagtgctcgttgcaacctccgcctgccgggttcaagcgattctcgtgcctcagcctctccagcagctgggattacaggcacgtgccaccacgcccggccaatttttgtattcttagtggagacggggtttcgctatgttggtcaggctggttttgaactcctgatttccggtgatccaccaccctcggccttccaaagtgctgggattacaggcgtgagccaccgcgcctggccggaaatcatgtaatttaaaactatatatgggtgtcttaggcggcatcggtcccaactctaaagtacgcgttagacgggcctgggccagaagtgggccatggagacctcgggacccgcagggctgccgcccgacccagcgagcctctgaaggtgcaccgccacccccactgtttatcttactgcctcatagtaggcacattgtcgttctcaatataattgcacacagttttattctggatcctcatttgcctttaagaattttctcaatttttctttttatttgatcgcaccactgcaacctccgcctgctgggctcaagcaattctcctgccgcagcctcccgagtagctgggactacaggcgtgtaccaccgcgcctggcttatttttgtatttttagtagagacgggatttcaccatgttggccaggctggtctccaacgcctgaccttgtggtccgccacgccaggccgaagattttcataatttggaagcattgcgtttcgtaattatgctttctcgtatttttgtgatttgggtcatttttatttttatatttttaggattacaggcgtgagccatcgtgcctggccgatttgggggtaattaacaagtccacgtgtttcatttgaatttaggatagctgggcctaattgttgtctttgcttctgcggtaccttccacatagtactaaccgcctattgtaaagtaattagaatagctgaatatgcatgttaccagtctagaaaccgatttttttttaacaccccactgtggacagggtggaaactcgtttgctttcttgtttaagatctgtagtaacatgaatggatgaaattgtttcctattggattctgtaaatttatgcgttacactgattgtccaacgtggatacacccgggaggtcactctccccgggctctgtccaagtggcgtaggggagcatagggctctgccccatgatgtacaagtccctttccacaacgttggaaataaagctgggcctcgtgtctgcgcctgcatattcctacagcttcccagagtcctgtcgacaattactggggagacaaaccatgcaggaaacagccttctagagcactgaatctggattgaagtctttttttttttttttttttttggagatggagtcgctctgttgcccaggctggagtgcagtggcgcactccattgcctctgcctcccgggttcaagtgattatgctaagtgattctcctgccttggcctcctgagtagctgggattacaggcccccgccaccacgccaggctaatttttgtatttttagtaaagacagggtttcaccatgttggtcaggctggtctcaaactcctgaccttgtgatccgccagcctctggcctcccaaaatgttgggattacaggcgtgagccaccacacctggctggattgaagtcttaatacatgtttaagaaaaattggctaaaaagtagccaggcatgatgataggtagctggaggaaggagaatcgctggagcccaggagtgacctatactcaaacctatactccagtgccactgtactccaaccccaggcgatagcatgaggcccctcgttgaaaaagtttagggttttgctgtactaatagattaatatcttgttttgcaggatttgttaaggattccaagtaactcttatttggtgagtaaatctgctaattgttttttgcttatcagctctttgtcaatgatttctgtaatggaaataggattgaagagacttttattctagttggtcaggatttacctctgaggcatttaatcattctcagagcaatagccaaatatcgactttgctgcatttttgtaggcatgttgacataacttcaacatatgctctgttctgtaaaaattgctttttttagtcagctcattaaaagtgcaaagtagtaaaagctgccctagtgaactgtaggaagcctaattggctttatctacatgtgtagcctgagctgagaaagatactagcccttgaaaatactgtgggtgattagcaatattggatttgtcggttactccaattcctcactaatgagcattccaacgtggataccctgggaggtcactctccccaggctctgtccaagtggcataggggagcttagggctctgccccatgatgtacagtccctttccacaacgttgaagatgaagctgggcctcgtgtctgcgcctgcatattcctacagcttcccagagtcctgtggacaatgactggggagacaaaccatgcaggaaacatatctagtatactagattttaagttgaagtaggatcttcaggagtctaatcattatttcttttcttttaggagagaagacgatctgcacttcgcattttggcattgacatttaattttagggtcctttatatagaagggagagtaggtaaactgatttttttttttaacagggagggtttgacaatctttggcagacttggagcaaaagattgaggtgcatttcatgcctccttttgagagtcttgctctgtcgcccaggctgtagtgcagtggcgcaatcttggctgcaacctcagcctcccaagtagctgggattacaaacataagccaccacgcccagccctcatacctcttttaaaagtcgacctgttttgcagaaagtctgctgtttttgtactaaaggctttggaatttggcatttagctaggaatgcacattctttcacctcattcatactttaagaaccacagaagtgactctgcttggccagaaggcacactgtgttggtggttatattaaaagtccttgagtattttgcttttcatgatcttgctcactgcaacttccgcctcccaggttcaggcgattctcctgcctcagcctcccaagtagctgcgactacaggcgtgtagcaccacacctggctaatttttgtatttttagtagagatgaggtttcaccatattggccaggctgttctcaactcctgacctcgtgatccgcccacctcagcctcctaaagtgctgggattacagctgtgagccaccctgcccggccacttttgtatgatttctaatgtatttgtaatttacctaacaaattgcctaatctgctatgttaatgtatttatgaattaaaataaatacgactgcatgtttgtggttcatttttgtggaggtggctgtggtgacatcagccaagaatctgaatggtactgttgaaggaaactagcatgatagcttcagttctaaaggccctgaaacctagtctcaggtgggtcccccttgggttcactttatattggcagtttattgggaaaatggatattaggtcctgaccaataggaccgtaagtctgggttgagtgcaagatgagttagaccgattctttagcttcctgcagtgtagtggaggaaaaatcgatggtagcaacgggaggttgtatccctagctgatgagttgtatgagcctctactacctggcgcacctccgcctgaagattgccagaattgcttgcctcatgacgtgagtcacaatggaaactttgtcaagccccctgcactggctgccaacataaatgttcagtaccctgaaggatgggactgaagggggatcatctagaaggtaaagttacctactggcataggggaggtgggacagccgttaagccatttggaacttgatggagacaggtttgagggaggtgggtgagattggagtttggtggactgtagagcttgcttgccaaggtgttgaggtcagggttggtttgagaatggaagctagttactagctatgattgtgggggaacacagcttgatttttcttacaagctaagaggagtgaggcagtgtttaagagggcatgttaaatgcagccaggcttggtggctcacacccgtaatcccagcacttaggctaaggcaggcggatcacaacatctagagatcctggccaacgcggtgaaaccctgtctgtactaaaaatacaaaataactgggcatggtggtgtgcacctgtgggaggctgaggcagaattgctggaacccgggagatggaggttgtactgagctgagaccttgccactgcgctccagcctggtgacagagttaagtctcaaaaaaaaggcatcttcctaaagcaattgtatttgtgcttacctgtgccaggcactgttctaggtaagcactaagtgggctttaatacagcatattccaatggggaatcccaggaaccaaaagactaattgtccaagtccacaactagaagtggcacctctgcagaaacaagcatcaaattccctgctcaggaagaagccagatgagtcagccccattcgtctgtatgcccagtcccatccgtgtcctgctgtaactacatagatctcacctgagtaaagtgatttttttctgaaccagtggttttagtatgttttcaatccatatactcaggtgggtttgggtaactgcagtgctgggcaggaaatgaatgaatttctattgacttgcaaggtagaggtgaagcaaagctgtcagtaggtgttcaggtcccactctgctaaacttcagcttgcaataccccttttttagactttccaaacaggcacttctggccttgttctttgtgtaggcagacagtattggttgcctatcttaggagtactagactgggtttgaatcctgatcccaccacttgctgttcatgagactttgggtgagttactcagcccctctgcctcaatttcatgttcacaaaataagtgataaactacctcatagagttgtaataaggacaaaggagttggtatttgtgaaaagattcttagggtctctagatggagtgcagcagcatgatcacttattaaataacattcttttgtgacttctcagaaaccaaggatacagtatccaattttttgttttttgtttttttttttttttgagagggagtctcgctctgtcgcccaggctggagtgcagtggcacaatctcagctcactgcaagctcagcctccccagcagctgggactacaggtgcacgccgccacacccggctaatttttttgtatttttagtagagaaggggtttcaccatgttagccaggaaggtctccatctcctgacctcgtgatccgcccacctcggcctcccaaagtgctgggtttacaggcgtcagccaccatgcccagcttttttttttttgagatctaatctcactctgtctccaggagggagtgcaatggagccatcttggcttgctgcaacctccacctcccgggttccagcaattctcccacctcagcctcccaagtagctgggattacaggcgcacgccaccatgcccggctaattttttttgcattttttagtagagacgggtttcaccatgttagccaggctggtctcgaactcctgacctcaagtgatccacctgcctcagcatcccaaagtgttgggattacaggcgtaagccactgcgcctagcctcaagcctgatccttttttttttttttttttttgagatggagtctttgcctcccaggctggagtgcagtggcgtgatctcagctcactgctacctctgcttcctgggttcaagcgattctcctgcctcaacctcccaagtagctgggattacaagcgcctgcaccgcacccggctaatttttgtgttttttttttcagtagagacagggtttcgccatgttggccaggctggtctcaaaactcctgacctcaggtgatccaccacgcccggcagagccttgatctcttaaccactatcctcacctcccctttccctaaggatccacaatggcctcactggctcttgaaggcaggctggcaccttgatcattcttcctggtcattagtattctgatctggttattttccattttatgtccatctaacctacttggaggatcctcaagagactgcatatgtaaactcagtacttattcttgtactgtgcctgccatatagcaagcactggctgatttaatttttctgtgttcttttttattgatttgtttttatctttattattttctttgcttattttggggttagtttgctcatctattcctagtttcttaagctagtagctgagctcattgattggagacctttctttttttctaatgtaggcatttagtgctataaatttcctccagatactgttaacaacacacaaattctggtatgttttgttttcattttaattcatttcaaaatatttttgagttccttttctattctttgatctatgggctacttgaaagtgtattattgttgttgtattagtgttgttcaaatctatccttgctagtttctttttttttggagactgcgtctccaaaggctggagtgcagtggcacaatcttggctcactgcaagctccgcctcctgggttcacaccattctcctgcctcagcgtccccagcagctgggactacaggtgcctgccaccatgccctgctaattttttgtagagatggggtttcaccatggtctcaatctcctgaccttgtgatccacccgcctcggcctcccaaagtgctgggattacaggtgtgagccaccgcgcccagcctcttttttttttttagacaagagtctcactctgttgccaaagccagagtgcagtggcacaatctcagctcactgcaacttctgcctccggagtagctggaattacagtcacgcaccaccacgcccagctaatttttttgtatttttagtagagatggggtttgcgcggctgaagtgcagtgatgcgatctcagctcactgcaacctctgcctcccaggttcaagcaattttcatgcctcagcctctggagcagctggtactacagcatgcaccaccatgcctggctaatttttttgtattttagtagagatggggtttcaccatgttgcccaggctggtctcaaactcctgagctcaggcagtccgcctgccctgacctcccaaagtgctagaattacaggcatgagccaccgtgcctggccttattttaaaattttatttcttgtaggtaacatgttgggtttttcagtatgacagtctatgtcttttaattggagtgtttaggctatttactttttttttttaagacagggtctcactctgtcacccaggccagagttcagtggcaagattatgactcactgcagccttaaactggaactcctgggctcaagccatcctcccagctcggtctcctgagtagtgaagaccacaggcatgtgccactatggctggctaaattttgtattttttgtagagacaaggtctcatgatgttgtcccagctggtcttgacctccagggctcaagcaatcctcccaccttggcctcccaaagtgctaggaatacaggcatgagtcaccatgcccagccatattatacatttttaacttacaatagtccacattcaattgatattaaaccagttcacttgtagtataagaatcttccccagcctggccaatatggtgaaaccccgcctctactaaaaatacaaaaaaaaaaaaattagccaggtgtggtggtgctcgcctgtagtctcagctacttgggaggctgaggcagaagattgcttgaacctggaagcagaggttgcagtgagctgagatcgtgccagcctaggcaacagagcaagactccgtctcaaaaaaaaaaaaggcggggcccggtggctcacgcctgttatcccagcattttgggaggccgaggcgggcggatcacgagatcaggagatcaagaccgtcttggctaacacggtgaaaccccatctctactaaaaatacaaaaaattagccgggcgtggtggcgggtgcctgtagtcccagctactagggaggctgaggcaggagaatggcatgaacccaggaggtggagcttgcagtgagccaagatcgcgccactgcactccagcctgggcgacagagcgagactccgtctcaaaaaaaaaacaaaaaaaaaaccttctggcggcctggtgtggtggctcacacttgtaatcccagcactttgggaggctgagactggcggatcacctgaggtcgggagtacaagaccagcctgaccaacatggagaaaccccgtctctactaaaaatacaaaattagccgggcatggtggcacatgcctataatcccagcaactcgggatgctgaggcaggagaattgcttgaacctgggaggcagaggttgcagtgagccgagatcatgccattgcactccagcctgggcaacaagagcaaaactccatctcaaaaaaaaaaaacaatcttccggctgggcacagtggctcacgcctgtaatccatcccagcactttgggaagccaaggcaggcagatcacgaggtcagagcgagactccgtctcgaaaaaataaataaatatttcttccatttctcactatatagtctttgatattgtcatgtgtcttacttttatatatgttataaaacccacagtacattattacagccagaacctccatatcagccagttgcgatggctcactcctgtaattccaacactttgggatgccaaggcaggctgactgctgaggctcagaagttcaagaccagcctggccaacatagtgaaaccctgtctctaccaaaaatacaaaaattagatgggcaattagctggacgtggtggtgcacgcctgtaatcccagctactcgggaggctgaaacaggagaattgcttgaacccaggaggcagagattgcagtgaactgagatcacgccattacactccagcctaggcaacagagtgagactccgtctcaaaaaaaaaaattagctgggcatggtggtgcacatctgtggtcccagctactcgggaggctgaggcagaggttgcagtgagccgagatcctgccactgcactccagcctggatgacagagtgagactcttgagacaaacaactggggctgggcgcagtagttcacacgtgtaatcccagcactttgggaggccgagatgggtggatcacttgaggtcaagagctcaagaccggcctggccaacatggtgaaaccctgtctctattaaaaatacaaaaatgagccgggcatggtggtgcgtgtctgtaatcccagctactctggagactgaggcaggaaaattgcttgaacccagggggcagaggttgcagtgagccgagattgcaccactgcactccagcctgggcaacagaatgagactccatctcaaaataaaataaaaaatacaaatacaaaactaaaaaaataaaaataaaggccaggtgcagttgctcatgcctgtaatcccagcactttgggaggccaagatgggcaggtcacctgaggtcgggagttccagaccagcctggcaaaaatggtgaaacccggtctctactaaaaatacacaaaatggccaggcgcggtggctcacgcctgtaatcccagcactttggtaggctgaggcgggtggatcacctgacgtttaggagttcaagtccaggctggccaacatggtaaaaccccgtctctactaaaaatacaaaaattagctgggcatggtggcaggcgcctgtaatcccagctactcaggaggctgaagcaggagaattgcttgaacccaggaggaagaggttgcagtgagctgaaatcgtgccattgcactctagcctgggcgggtcaggagttcgagatcagcctggccaacatggagaaaccccatctctactaaaagtacaaaaattaaggctgggcgcggaggctcacgcctgtaagcccagcactttgggaggatgaggtgggtggctcatgagatcaggaattcaagaccagcctggccaagatggtgaaaccctgtctctactaaaaatacaaaaattagctgggtgtggtggcaggcacctgtaatcccagctacctgggaggctgaggcaggagaattgcttgaacctggctgcagtgagccgagatcgcaccactgcactccagcctgggcaacagagtgagaccccatctcaaaaaaaaaaaaaaaaagagttgaggtctccttccaccacttgtgtgaagaccccagaaaacttgctttacctctttaaacttcagttttcttatcttccaactgccatgaggtttttgtgaggaacaaatgagctgacatggatgtttctgtagttaacaaaataaagggtcttacaaaataggcaataataataataatcacttattattattacatgaagctacatgaatgtgtaagatcttggaggaagacagcagagagagagagagagatcagagatcccagggttaaaagttggagaaatttcacagtacatcatccaaaagaggagtccatgatggaggcagaggtaaacttggagaggtaagaaaccctgaagacaggggagtgctttgtggcaggctctgcatataagaattcagcctggccaacatggcgaaacccagtctctactaaaaatacgaaaattagccaggctttgtggcaggcacctgtaatcccagctatttgggaggctgaggcaggagaatcgcttgaacctgggaggcagaggttgcagtgagccgagatctcaccattgcactccagcccgggtgacaagagcaagactcgatctcaaaaaaaaaaaaagttcagttcagttggtaagaactcatcaaaagtgtccatctagactttgggtgccgtagaatgactcagagtctgaatcaacatgaaatcgagaaaacgtcctttgcaagggtttcagggaacacctgaaatcctgaagaactgtttgtatccatcctgaagaatgggtgttaataagagacagccttttcttggtacctgttttccatctctaacccaaccccaactcacacccttctattttatctggtctctctcattcctcttgctcctccccacttggctcccgttttccccaagtccattctctattttgttctataagatctgatcatattaggatgctcttgtagctcataagaagatgactgggtgttcacacgcatatgagatgtgcctccctcaaaccttgttaagacatgggcacatacccatctgatgttaactcacggggaaaaaaatctgatcatgccattcccgtgcccaaattcccatatatccctactgcctcaggatagaggctggaccccttagacacacaagaccctgtatccatgatctgtcactcccacaggcaccctctactcccatctacttggcagtttcccacaacctccctgggttctcgtggttccctgtcattgcaaacgtcgcttctcctaggatgtcctgcccccctagacttaacttggaaagctgttcttaagccccggactgagtcagatgcccctctgggtatccctgtcatagcgttgtgtggttgttgatagtctgatttttcaaccttctccatgccctcttgagggtagggaagatgagtatcttttttctccgtacagaccctaccgcacaagattttcctaaacagaccgaactcaaggagtctttctggttgttagtccacgtgtcccgatttggggtttccaaaatacacgcccactggaaccgggccaggggagccagcctggccaagggctcccccagcccggccaagggctcccccagcccgggagcgcgccacatgcagatcctgggatggccgccaggggccgccgggctctttgttttcctttctcacccgggtcggggccagaggcctgcagagcgcatgctctggggcagttcgcggcccggcggggagcgccggagttccttgtggccgacgtgcaccaaggtaggtctcgcctgggacgcgcggagggtccgggcagagggcggtaagcggagcggccacagccggagcacgggccggtccacgcgggcctaagtcgctgcccgctctcgcccgtgtcgcgcggcgccggccccacgtgaagcccggaggcaggaaggcgcggtgcgggctcgcgattccccggccccgcggggcgctccagcagcggctgggcgctgcctcgctggagctagggccgcgcggcccctccgccgccgcgcctctcacgcccgcaccgcggcgcccgcgcaggcgggagattcaaactgcgcgagcgcggcgggccgggtgcgcgcggccgcccgggcgggggatgggtctctgccgcgaggaggatggttttgtccggcatgcgcttggagaaggcggtttgcagatcggggagggagccctgcccgggagagggtgggtcgtaggagctcgagggtctcccgctgtggacctttgggagccgtgtgtcttgaactccgcagcagctcagtctgtcagcagattatttgctggccatttattgcgtccctctcttgcggggctgggggacagtagtgagaagagcaggcccgtgtcattagcgaactatgcccttgaacccaggcgacggacgctactggcaagtcattcatacgtcacatattgacctaacttcgaccacgtgtgacttgtgtgccctagcagaagttgagtgtgtggggtgttacggggagccctcagggggatcccccaccctgcccaggaggctcagggatggctttccaggtgaagtgactcttgaatggggttttgaaggaacagagtttttcaggcagtctgagggtagtgggattagggtgatacaggcagagggattgcacgtgcaacggcatgaaggtataggtattgtggtcagggataccacaggtcttgaggtgactggaggaggagagtaacaagatgatacagcaggggctgggtcacgaagcgtcttgtgtgcaagactaaggaactctgcggggtggaggaggcagggaagatttcccccaagaagggtatcagagtgaaacctggacagatgaattaggagttcacgaggctcctgtttcaaagacatcccaagagcaggaatcctgttctgttcatcgttacaactttctcatcagatgcccttgggcaacccacccagtcccccagagcattggtttccttatctgtaaagcaatggtagggggcatgtggtgaggatataatttttttttttttgagacggagtttccactcttattacccaggctggagtgcagtggcgcgatctcagctcactgcaacctccacctcctaggttcaagcaattctgcctcagcctgctgagcagctgagactacaggaacacaccaccaggcccagctaatttttgtatttttttttttttagtagagacggggtttcaccatgttggccaggctggtcttgaactcctgacctcaggtgatccacctgcctcagcctcccaaagtgctggaattacaggtgtgagccaccgcacccggccaattttttttttttttctgatacagaatcttggtctatcgcccaggctgtagtatagtgtcgtgctctcagtcgctgcagcctccacctcccgggttcaagcgattctcctgtctcagcctcccgaatagtaatatcctataattttcataaagcagtgaagttgtgtgtcccttcccccaggaaaaatgaacacataggcccaggcacaggttgtatagaacggggatcccaggtgagaaactcctagtgtgaaatataccacctgtgtgcctggcataacagcagctcaccaaatgtatattgttgacacatgagccctctcctcccttccctcctggggaccttacacacagagatttttcagccttagtctggcaggcaagttcttcctcctggtgtgggggacggagggcacagctgcagtggcctgggagggctctgtctccttttacagaaatcgaggctgtggtgaggtcactggaggtcagggcaggagcaccaggctccgggcagactgtctagactggcgtgcctacccactttcttcaataaataaggaaggtgaggtgggggtagggcagctccagctctggtggagcatggtcatgagactgggatttcattccacctctctgtgacctgggtcacctttccctgagcctcatcttccccttagctgtaaaactgggatgagtctgctcacctcaaagggcagctgtgggcattcaggagtgcctgatggtggaagctgactctgtagccgacttatctgtgactgtctcactcttctcccagagactgtatgctccttgaagatggaagctgtgttgtgtggggcggggtggggaagcatgatgccaaaagccaactccttattcccagcccagacactcactgcctggttaagaaaacagccagagaggccgggctcggtggctcacgactgtaaccccagcaatttgggaggccaaggtgggcagatcacctgaggtcaggagttcaagaccagcctggccgacatggtgaaaccccgtctttactaaaaataccaagcagttagccaggcgtggtggcttgcgcctgtagtcccagcactagggaggctgaggcgggagaatcgcttgaacctgggaggcggaggttgcagtgagctgagatcgtgagtctgaactccagcttgggcaacagagtgaggctccatctcaaaaagaagaaaagaaaagcaaataaaggaaaacacacccagagcagtgagagaagtctgtatacaagacccatttgtgcagtagaggctgtgcaggcaggtaccgggaacagggctccaccttttagaaggtggtcctctggccgggagcagtggctcacgcctgtaatcccagcactttgggaggccgaggtgggtggatcatgaggtcaggagatcgagaccatcctggctaacacggtgaaaccccgtctctactaaaaatacaaaaaattagctgggtgtggtggcaggcgcctgtagtcccagctactcgggaggctgaggcaggagaatggcgtgaacctgggaggcggagcttgcagtgagccgatatcgcgccattgcctccagactgggcgacagagcgagactccacctcagaaaaaaaaaaaaaaaaaaaaaagaaggtggccctccatcccctgcccttccctggcgattgccagcccagtgcagggcctcaagtcttccattttggagaggaagcctctgggactcaaagagcactcaggtgccgtctccaccgcagcagggagttgtcgccactgtccttccccacatctgtgggtggatctgtcaccacccaccccaccttccctcaggctctagctgcctcattgtctcctctctggtctcaccatcctctcctcagctggcttctgctctctgcttcttggacttggccaagtgcataggggatactggggaggcctgcccagactgccttagcccctgcctggaccaaggtctgccttcagaatcagtcagataggcctgggttgcttttctaggctgccctttacttgctctgtgaacttaggccgataaagttatctttctgagcctcagttccttaactgtgaaataggagtgacagtgctgccttcttcagcttcctgtgaggaataaaagggttttgcatatggaagatacagtgagttagccggtgcccccaggggctcatattttaggaagttgattggtatggtggacaggcatgtaaattaaagtgattgtgatccaaaagtctgtcccagtttctcagagagaatgactagttcaggatggaggagggatcagaggaggtgactttgagacaccagtagatgttcttccagtgggataagggatgggaaggcgttccaggtaaagagatgcaaatagtatggagaggacagttagcattctggcctggtgggtctggcaaggagattgtgtgggaagagaagggaggatgtgatagataggaaatgaagctaaaggttctgtcagtacccgatgttggagacctctaatacccagctaagaaatgtgggctttatcttccaggaaaaggggaccactaaggagtccaagcaggccagcagcttgcttcaggtttgaggtttggaaagatcatgaatgaggccgggcatggtacctcacgcctataatcccagtactttgggaggtcgaggtgggaggatcacttgagcccgggagtttgagaccagcctgggcaacatagtgagaccttgtctctacaagaaaaaaaaaaattacaaattagccaagcgtggtggtacatgcctgtagtcccagctactctggaggctgaggcaggagggtcgcttgagcctaggaggtggaggttgcagtgagccgtgtacgtgctgctgcactacagcctgggcaacagagtgaaaccctgtctcaaaaaaaaataaatatatatatgtatatatatacacacacacatatttattgatcacgaatgacttggagaatgagaggaggggatgagggtggggaccggaagaccagtgaaaagttgctgtctttcctagggaaaggaggaggagacacagttccaggcaagctgagagactactagggagcatggggaggaaggaggcagaagaaatttcttttttttttttttttttttttgagacggagtcttgctctgtcacccaggctggagtgcagtggcgtgatctcgactcactgcaagctctgcctcccgggttcacgccattttcctgcctcagcctcccgagtagctaggactacaagcgcccgccaccacgcctgtctaattttttgtatttttagtagagacggggtttcaccgtggtctcgatctcctgacctcatgatccgcccgcctcggcctcccaaagtgctgggattacaggcgtgagccaccgcgcccggccagaagaaatttctaataacactcaaggacgccagctctggagtctgactaacttggttcagatcttggccttctcttccaatcttgagtgagatacttcacctttctgagcctcagttttcttctctgtagagtgggatcattgtggccagcttgtagtgaaacgctccagaatattagccaaacacaactaaggagatgttgactgggtttgttccatccatgataacagattttttggttaatgccccatgacaccaacacttcatatagcccttatgtgtctgactccattccgggctgtgctcatggcagcccagccatcagcaccaactgtgctgacataattgtttcctgctttttctcctgacttcttattgtgagtacttttcatgctaatacagtctccctcccaggcacagcagactgctacagattattctgatgaactgatgagatgtttgccttggcatacagctgtctatctaaaacaagggtgcctctttttttggtggagggacagagtttcactcttgttgcccaggctggagtgcaatggtgcaaactcggcttaccacaacctccacttcctgggttcaagcgattctcctgcctcagcctcccgagtagctgggattacagcacgcgtcaccacgcctggctaattttgtatttttagtagagatggggttcctccacgttggtcaggctggtctcgaactcctgacctcaggtgatccacccgccttggcctcccaatctgctgggattacaggcgtgagccaccgtgcccggccacaaagatgcctcttatatcccacatccctaccccatctaactttgcctgcctgacatcctttctgggatggctcccaagcacttcagattgaatgaaaacacctagcaacatggagcttcacgtctcttctctcctgtttgttcaacagtgttctctatctcactacatggaagtctaccatctacctggtcatttaagcccaagcctgggagtctttgtgtttggccaagctcatagggggatcttgggcaggcctgccaagaatcctctggacttttttaggatgaacaaatcaagccaagtgctgtggcacgtgcccatgatcccaggctcttgggaagctgaggtgggaagatcgcttgagtccatgagttcgaggctgcaataagctaattgcaccactgcactccagcctaggtgacagagtgagaccccctctcttaaaaaaataaaataaaaggccaggcatggtggcttacacctataatcccagcactttgggagtccaaggctagagaatcgcttgagcccaggagttcgggaccagcctgggcaacatggcaagacgttgtttctgcaaaatatacaaaaattagccgggcgtggtggtgcacacctgtagtcccagctatccaggatggctcaagcccgggtggttgaggctgcagtgagccatgaccatgccactgcactcaagtctgggcaggaccctgtctcaaaaataaatacaaaggatgaacaaattatgagagtaaaaaagggttagtctcctttatccttgctacacctcctcacccaaagccaagcagtagtgtagcaggataagccgcagacaaaaccccccagacacccagttaaagaaggaagggctttattcagctgggagctttggcaagattcacgtctccaaaaactgagctccccgagtgagcagttcctgtcccttttaagggcttacaactctaagggggtctgcatgaagaggtcgtgattgattgagcaagcaggggatatgtgactgggggctgcatgcactggttatcagaacggaacagaacaggacagggattttcacagtgcttttccatacgatgtctggaatctatagataacataaccggttaggtcaggggtcgatctttaaccagacacaggtcgcggcgccaggctgtctgcctgtggatttcatttctgccttttagtttttacttctttggaggcagaaattgggcataagacaatatgaggggtggtctcctcccttagtagtaaagcactataaatatttgtggatttacaaccatttcattcagtcttgatgacagccctgagaagtagtcattgcatccccttttatagatgaggatacagttcagagaggttaaggcaactggccagccacaagctctggaaggtgaacccagttccctctaatcccaaagaatgtgcactttttagtgtgggacaaggggtctcaaaagacaggtgggaggattctcagccctgggagaataaaagttgggtgaagttcagaactgccacctcatcagtcagaactgggccagtgacaacctgcagaagctcagcctgcaaaggcttatcaggattctagacctttggttactttcccatctttagtatttagttctccttccccaggataatcagcagaaaagtgcctggccttgtgtccatataccatggaggggagagctagagaggcgaggttctcgggaaccactagaaggaaggaatgagggggctgctggttaggcccagagctgagaccgagaagggctcttggagttctccttcccttcgtaacattaggtagaggcttagacaacttgattgtttttcatgaccttaaagactgtggctccggccgggcatggtggctcacagctgttgtaatcccagcactttgggaggctgaggcgggtagatcgcttgagcccaggagttctagaccagcctgggcaacttggcaaaaccctgtctctacaaaatatataaaaattagctggacactgtgatgcgcacttgtagtcccagctattctagaggctgaggtgggaggatcacctgagctcaagaggtcaaacctgcaatgagccgtgattgtgccactgcacttgagcctgggcaacagagagtgagatgctgtctcaaaaaaacaaacaaacaaacaaacaaaaacaagtacttgatgactccattggggtcaattatgaagagacctcttagtgcaagaccaggaccttctaacagcacaccgaagtctcgagaaattcgcttagttaaatctgacaagggtgcgatgtttatgtggcccaaagcaccattctttcttggtgtatttatccaggcaagacggctaaagtgggaatccactgagactgcaacaacttcaaagttcacatcgtgaaattccttagctttgtcactagaagcaacaatttctgtaggacacacaaaggtgaaatccaaaggatagggctgggcgcggtggctcacacctgtaatcccagcactttgggaggctgaggtgggtggatcacctgagttcaggagttcaagaccagcctcaccaacatggtgaaatcccatctctactaaaaatacaaaaattagccaggcgtcgtggcaggcgcctgtaattccaggtactcaggaggctgaggcaggagaattggcttgaacccaggagggggaggttgcagtgagccgagatcgtgccactgcactccagcctgggtgacacagcaagactccgtctcggaaaaaaaaaaaaaaagaaagaaatccaaaggatagaagaaaagcaccaaatatttcccctcaaagtcatcaaggcttaggtctttgaactctccattgaccacggctgtacccttaaaatagggcgcatgctgggtgacatcaggtgcatggtatgaggaactggtaccagaattttgcttgaccggaaccagaccacaatatgtttgtcaaacttgttcttccagaagcagcaggcctgagggctgcagtggcagaaatgcccccaaggaatggcactcacatgccgggcaactgatgctcagagtaaccttcccacagcagccgcgatcttcagtgcatgtgtgtttttgtttttttgagacagtgtctgtctctttcgcccaggctaaagtacagtggcacaatctcagctcaatttagcctcagcctcccaggctcacgccatcctcccacctcagcctcctgagtagccaggacttcaggcgtgcaccaccatgcccggctaatttttgtaattttttggatagaaatggggtttcgccatgttgcccacgctggtcttgaactcctgggctcaagcgatcctcctgcctcgacttcccaaagtgctaggattacaggtgtggtggcaccttgtctctaaaaaaaatcaatcaattaaataagaaaagaaaatagctcttctccccctctgattataacaacacattaccaaagttactggtgcttacatggggttgaatggagttatgatggatatttcatttaatgttgttcttcaatgttttaattttttacaacagacttaaaaattttttaaatacatgtggccaggcacgatggctcacgcctgtaatcccgcactttgggaggccaaggtgggtggatcatctgaggtcaggagttcaagaccagcgggaccaacatggagaaaccccatctctactaaaaatacaaaataagccgggcgtggtggcacatgcctgtaatcctagctactccagaggctgaggcaggagaatcacttgaacctgggaggtagaggttgtggtgagccgagattgcgccatggcactccagcctgggcaataagaacaaaactctgcttcaaaaaaaaaaaaaaaaaaacatgtaatcggctgtacgcagtggctcacgcctgtaatcccaggacttcgggaggctgaggcaggtggattacttgagattaggagtttgggaccagcctggccaacatggtgaaaccccgtctctactaaaaatacaaaatttgggctgggcacagtggctcacgcctataattccagcactttgggaggccaaggcggggtggatcactgagatcaggagttcgagaccagcctggccaaactggtgaaacctcgtctctactaaaaatacaaaaattagctgggtgtggtggtgggtgcctgtaatcccagctactcgagaggctgaggcaggagaatcacttgaacccaggaggcagaggttgcatgagccgagatcgcaccattgcactctagcctgggtgacagaacgagactccatttcaaaaaaacaaaaacaaaacaaaacttagcagggcatggtgatgcacacctgtaatctcagctactcggaaggctgaggcacaagaattgcttcaacccgggaggtggaggttgcagtgagctgagatcatgcctgtgcgctccagcctggcgacagagtgagactccgtctcaaaaaacagaaaaatacatgtaatgctccttgttaaacatcttagataatataggaagataaaacgaaacaagtaatgattatctataataccattttccgaggttaccattgttaatatgggatatattttcttccccacatttttctcacatattttttgtgtatgcattttttttccaaaaaaaaaaaaaatggatgataggctgtttttcttccttttttttttttttttttttggttggggggtggagtttcactactctttctcccaggctggagtgctgagtgcaatggcatgatcttggctcaccgcaacctccacctcctaggttcaagcaattctcctgcctcagcctcccaagtagctgggattacagtcgcacaccaccatgcctggctaatttttgtatttttttttttttttttggtggcgacggggtttcaccatgttggccaggctggtctcgaactcctgacctcaagtgatccacccaccttggcctccgaaagtgccaaagtactgggattacaggcgtgagccaccgcgcccaggctttttttttttttttttttttgagacagtctggctctgttgcccaggctggagtgcagtggctcgatcttggctcaccacaacctccacctcgcgggttcaagcgattctcctgcctcagcctcctgagtagctgggattacaggtgcccatcactgtgcctggctaatttttgtatttttagtagagacggggttttgccatgttggccaggctggtttggaactcctgatctcaggtaatccgcccgccccggcctcccacagtgttgggattacagatgtgagccaccacacctggccgtctgtttttcattctgcttgttttacttggcaatggggaacatctttctattcaatagattgatctctgaaaacatcacttttgatggcttcatactgttctatcatgaatataccacatatttagttcactactattgaacattcgggttctgtttttgttgtttttaaaatgttatgaaggatacagtagagaatatttgtgtaattaatctgtgggtgcatccattattctgttcttgggatacattttgagaagtggaattgttgggcaattcctcttaacgtatttctagagtgtttgataaatattgtctgattggcccaggaaaatgtttgccatttctcatatgtagtatttgactgactttcaggacaggaagatgtcacccaagcgcatagctaaaagaaggtcccccccagcagatgccatccccaaaagcaagaaggtgaagggtaagttggccttggcctctttgtgggtacaggtggccccttgaaaccctaagaacccgggactgggctcctttcttcctgaggcttgaagctgaagggtgtggatgtgcagagaccccacccagctggaaggtttcctgtagctcattgaatcctaccctctgggaatcacaaagtgggcagaaactcctctcaaagcactcaggcagcactggcacaaaaaaaaaaaaaaaaaaactagaccctagggcttcaccccaggcagtgatgcattatggttaggaccactgactttccgacatgggttcaagtccttgctctgccactttctagctgctgggcaagtcacttaatcccgcagtttggattatcaacttcttaaaatggcggcagccagagcagcgtcaccctctctgggctgtgtgaggatgagatgagataatggcctggcagcatttgagggaggtggctgtggtttcctctgtcctgggaccccggagggggacagggaggagagaaaagccagcaccaaactgggaggggaagtgtggacccacgctcagacagtgtctgtcttttgcagacacgagggccgctgcctcccgccgcgttcctggcgcccgctcctgccaaggtgcctgcgggccgagccctcctgaccagaaaacccgaccaggtggctccgcgcccggggcgccctctgtgctgccagcgcgggctcctcagcggtggccacatcctcgggggaggggctgggcgccattggctgcccggggctgcgggttggggggccgcctttggcccacagagagccccgggcgcgcacctcccgcaaatgccgctgtccgctcttcctcccgcccctcctgcctctccactggatggtggagggaagagtccgtttctgcagtggatttgcccgggagctgaacttattcactggcggacggcttgggcatggaggagggcttggatggagactggggattgttctctgacccacgtagtctcccttgctttcggtgcagattctgctattataattagctttctgcggggcaaggtggctcacgcctgtcagaagatcgagaccatcctggctaacacggtgaaaccccgtctctactaaaatacaaaaaattagccttgcgcggtggcgcgcgcctgtagtcccagctactcaggaggctgaggcagaggaatcgcttgaacccgggaggcagaggttgcaattagccaagatccaccactgcactccagactggcgacaaagggagactccgtctcaaaataacaataacaataattagctttcttttctttttctttttttttttttttttgagatcaagtatcactctgtcgcccagactggaggcggcagtggcacgatcttggctcactgccacctccgcctcccaggttcaagtgattctcctgcctcagcctcctgagtagctgagattacaggctactgttggcaaggctggtctcttaactcctgacctcaagtgatccgcccgccttggcctcccacagtgctaggattacaggtgtgagccaccgcacccagcccttcttgccctctccaccaagattcatttcacagtatccagtgtctccttgtttccctttctcccctttcacgtgaataatgtgctcagttcttaatctccacaaaaatcctgtgagagaggtacttttgttgtccccatttcacagatgacaaaacttagaaagttcatactaacagtctgtggcagagcaggggcttctgcacaggtttgtctgatcccagagcctgtgacctctcctcgctgtcgtcatcctctacactcagggtctatcttcttcacccttcagtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtaggtgttggggactggcacagggttggacaaggcctggggttgggtggcttggggcagggcttttgaaccacgcatgttcactgtggaaatggagctggctagtcaagtggggagtggcctacatgagaatggactgcgaggccagacgttgcattaatgagggcatcctgggcacaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggtaaggctgggtctgaaagtctgcatggtccctgaaagacagaattaattggcggggccccaaagataatccacttccatgcccccatggtacttactggtggggagatgaaagcccacaggtagagctgaggcccagacccaggactctagcttcctcatgtgggcctgtccacgccactggctgcttccttgaatccgatgtcatcaagtgtctgtcctgggaagtgagtgggtcaaggatgtccctgggttgaggctgatccaggaggcctgctgtcttcacccatctccctgacttctgtctccccctcaccttgccagcactgcctcttccacacttcccagaggcttggatggggcaaggaggtgtggaggcagggattgtcgcatctcagagtttccaaggtacagaggagtgtagttgaaaaaacagattgtgggtttttgttgttgttgttgttgttgtttttgtattgttttgagatggagtttcactcttgttgcccaggctggagtgcaatagcgcaatcttggctcactgcaacctctgcctcccaagtttaagtgattctcctgcctcagcctcccaagtagctgggattacaggcatgcgccaccacgcctggctaattttgtatttttagtagagacggggtttcccctgttggtcaggctggtctcgaactcccgaccccaggtgatccacccgcctcagcctcccaaagtgctaggattacaggcgtgggccaccacacccggcctgatgggtgtttccttatcacatctattttgaaattttcatggagaatttcaaacacatgaaagtaatcagaattgggctgggcgcggtggctcatgcctgtaatcccagcactttgggatgccaagatgggcagatcacgacgtcaggagatcgagaccatactggctaacatggtgaaaccccgtctctactaaaaatacaaaaaattagccaagcgtggtggcgggtgcctgtagtcccagctactcgggaggctgaggcaggagaatggcttgaacccgggaggcggagcttgcagtgagccaagatcgcgccactgcactccagcctaggggacagagcgagactccatctcaaaaaaaaaaaaagaagtccgggcgcagtagctcatgcttgtaatcccagcactttgggaggccgaagcaggctgatcacctgaggggtcgggagttcgagaccggcctgaccaacatggagaaaccctgtctctattaaaattacaaaattagctggacatggtggtgcatgcctgtaatcccagctactcgggaggctgaggcaggagaattgtttgaacctgggaggcggaggttgcagtgagccgagatcgcgccattgcactccagcctgggcaacaagagcgaaactctgtctcaaaaaaaaaaaaaaaaaaaaaaaaaggaagtaatcagaatatcagaattatatttttttcttttcttttcttttcttttttttttttttttttttttttttttttttttttttttttttttttttgagacagagtcttgctctatcacccaggttggagtgcaatgacacaatctcggctcagtgcaacctctgcctctcgggctcaagcaattctccttcctcagcctcccgagtagctgggattacaggcatgcgccaccacacctggttaatttttgtatttttagtagagacggggtttcaccatgttggccaggctggttgtgaatttctgatctcaggtgatccgcccgtctgggcctcccagagtgctggattgcaggcttgagccgccacgtctggcctcttttcttttttctttgttttgagacggagtctcgctttgtcgcccaggctggagtgcagtggcgcgatctcggctcactgcaagctctgcctccctgattcacgccattctcctgcctctgtctcccgagtagctgggactacaggcgcccgctacaacgcccggctaattttttgtattttttggtagagacggcatttcaccgtgttagccggaatggtctcgatctcctgacctcgtgatcgcccgccttggcctcccaaagtgctgggattacaggcatgagccaccgcgcccggcctcttttcttttttaattagagacgagatcctgctctgtcacccaggccagagtgcaatggcatcgtcttagctcattacagcctcaacttcctgggctcaggtgatttcttccacctcagcctcgcaagtagctggtactagaggcttgtgccaccacgcccagctaatttttgtattttttgtagggacggggtttcaccgtgttgcccaagctggtcctgagctcaagcgatctgcccacctgggcctaccaaagtgctaggattactggcatgaattaccatgcctggcccagaatagtatattgagtgcccatttacttgccacacagtttcaatgattatcagcttgtggccagacttgtttatctctatttgcatccgctctctgactccttgattattttaatgcaagtcgcagaccataaatgatttcattcataagtatttgagtatgtggcctggctcctgcccacttctccatccccatctggtgccactgcccttctggatttcactggcacggggcaggcaggactggctgataagtgccctgtccctcccttctaggacaataacggtgtgattggactgttggagcccatgaagaagagcatggtgcctgtgcaggtgcagctggatgtgcctgtggtaaaggtggcctcaggtgggtctgggggcacttgctcagggcaggagttggaggaccttgttctggggctggcctagccttgggccttacagttgtggcctgcatcccttaccttttcatccttaggaaacgaccacttggtgatgctgacagctgatggtgacctctacaccttgggctgcggggaacagggccagctaggccgtgtgcctgagttatttgccaaccgtggtggccggcaaggcctcggtaagtggccttggtacctccagcagggcaaattggcaggccacccccacagtgaaggccaaaggcaggaaggatttgctgtggtcaggcttgcatcagatgggcttgtggtgttggttaggactttggagacagactgctctggtagttttgccacctactgtctatgggactctgaacatagtttcttcatcactaagtctacctacctgtaaacctacttcattaggttgctgtgaagttaaatgagttaatgagaagaatatcaggcagatggtaagttccacgtaaatgatacccgtaatgactgtgggaatctgagcaaggcacttgtattctcttgatctcagtttccttttctataaaatagggataagagtccctacttagcctctcaagggcttttataatggaggagaattaaactcggggcagagagaagccatgtgtgtctgtctgtcactgaccgtggctttccctttgcctgcagaacgactcctggtccccaagtgtgtgatgctgaaatccaggggaagccggggccacgtgagattccaggatgccttttgtggtgcctatttcacctttgccatctcccatgagggccacgtgtacggcttcggcctctccaactaccatcagcttggtgagccccgagcccagcttcaggcatgacccagtggcctgcgttcctgtcctggctctgccactcattcattgtgcatcctttgcggggtcgtctaacccctccaagccagttttgtcatctgtaaagtgagaatgtccatatcctgatgggaggtggcctcactgtgggaggagattgagaagggcagctctcagaacaccttcacccctgatggctccggcctttcccccaggaactccgggcacagaatcttgcttcataccccagaacctaacatccttcaagaattccaccaagtcctgggtgggcttctctggtggccagcaccatacagtctgcatggattcggaaggtagggcctttacgtccttctctagtttgggggtggagtgttccctggcctaggcctagccagattcctgagaccatggtccttggagcctgggtctgttccatgggttgtaccatacatgggtccatgagagtcactctcatcctcctagagtcctggtgttcttccaagtgtgagttcaatgggggcccatgtagattctcctaggcctcctccaaaactgggaagagacactgcagatctccttctgatcgctctgggagcagggacacactcccatggacaggtggactcacctagcctgccacccattttgcctgtagcacgccctctgctattgctcatctctctccctcctcccataggaaaagcatacagcctgggccgggctgagtatgggcggctgggccttggagagggtgctgaggagaagagcatacccaccctcatctccaggctgcctgctgtctcctcggtggcttgtggggcctctgtggggtatgctgtgaccaaggatggtgagtggggctgcctacactctgtctagttgggacctgggggtcatggttcttacccaattccccaataggctgtgatgtccactctcgggggagccgaggtacagagagcagtgtttgtgatggcactttgttcctgcttctcagaagctctggcattgatgaatatgaaatgagtacacaaattattttagtaaaggtgacttattatgcagaggagagaaatagcaaagagtgagatatcactgaggcctaaggaggcaatgggactggaacccaagtctccagactcctaacccaggctgctctctcccctcagggtgaccccttcatatatcaccttgtatgttcccgctttccagggacttttacttagaatctaaatcaagaaaaaaaaaggcttagtagtcagagttgtagcaactatagcagaggagggtgtgaacaagtgaccaccaaagcctgagtgggtgagggggatagccatggaggtcctgtagaagcctggagctggcagaggtgcttgacctgaggttatctgggaagacttcctcaggaagtggggcttgcactgtaccttgaaggttccattccttgtgaaaagcaaagaatgccattccaggcagaggaacatcagggcagtctcaaaggtggctggtcctgggaacagagggtggggtaggaccttgaatgccacgcctaggagcagcctttggcagtgtgtagggactgtgctctctggtttacagagttcttttttatccatcatctccttgggttctcccaacttccctgaactcccagagtctggtaccttgccaagctgctattggccaaggccacagtccacgcccatgtcccaggtttctcctgctacagaaaggtgggctggggatcctggagacagctgtacccatttctctctcttgcaggtcgtgttttcgcctggggcatgggcaccaactaccagctgggcacagggcaggatgaggacgcctggagccctgtggagatgatgggcaaacagctggagaaccgtgtggtcttatctgtgtccagcgggggccagcatacagtcttattagtcaaggacaaagaacagagctgatgaagcctctgagggcctggcttctgtcctgcacaacctccctcacagaacagggaagcagtgacagctgcagatggcagcgggcctctccccagccctgagcactgtgtcagttcctgccttttctcatcagcagaacagaatccttttcctcttttccttcctcctctttggaattttcctgggacctacagaataaagggggggatggacagggggttttcaaaaggaacatggctcactcagagctatatggttagacgtttctccccttttccctaccttccatggtcctggttggccctggctttgcctactagaaaaccaaaacttcccccctggggttttgtgcccactctctgagaagttggggctccatcaagccccattctagtcatgtgcccctttcctgtccctaacagtccacaggcaaacaaatggtacagtcataagagccatctgtcacggacccacgcccagaggaacgtgcagaaaaaagcagagctacatggctgtgggcaactataagccaaatatttggctcagaacaggtgtccatgggacaaaaaagaacgatcctccacttgaccaagaaaaaagtgattctcccagaagcacaaagcatactcttgcccctcaggtgttgcttgtgtacatcgtacccatccattcggcttcacctgcagccaacggcctggaatcgcaaagagacaccactctgggcagagcagagcagggtatggggtggggagagagggtggagggttttataaacaaacttaacagcaatattgaaaggaggtgggggattgagggagggacagagtgttggagggccagagactagtcctgagatggaaacagcaacttgtacagtggctgagaaaataggatatagttttgatttttttaattgtaaaatattttggagggagaacaaaatcttttaacattttgaataaatttagagttttataaaataggccacttgttttctacacattccctgctttttaagggagcacatattatgtgccaggcactgctgggaaagacagaataaactataaacctggtgttgaggctacaacttaagtgatgtcaagatgtcctgaggtgccaaccagctgtcagtgtgactgtaacaaaggcttcaaatctgtcaagaagtaaggaaaagttttgtttg

SEQ ID NO: 699 - DNA, 33254 bp, Homo sapiens; identical to SEQ ID NO: 698

SEQ ID NO: 700 - DNA, 33254 bp, Homo sapiens; identical to SEQ ID NO: 698

SEQ ID NO: 701 - DNA, 20964 bp, Homo sapiens
tgcagagcgcatgctctggggcagttcgcggcccggcggggagcgccggagttccttgtggccgacgtgcaccaaggtaggtctcgcctgggacgcgcggagggtccgggcagagggcggtaagcggagcggccacagccggagcacgggccggtccacgcgggcctaagtcgctgcccgctctcgcccgtgtcgcgcggcgccggccccacgtgaagcccggaggcaggaaggcgcggtgcgggctcgcgattccccggccccgcggggcgctccagcagcggctgggcgctgcctcgctggagctagggccgcgcggcccctccgccgccgcgcctctcacgcccgcaccgcggcgcccgcgcaggcgggagattcaaactgcgcgagcgcggcgggccgggtgcgcgcggccgcccgggcgggggatgggtctctgccgcgaggaggatggttttgtccggcatgcgcttggagaaggcggtttgcagatcggggagggagccctgcccgggagagggtgggtcgtaggagctcgagggtctcccgctgtggacctttgggagccgtgtgtcttgaactccgcagcagctcagtctgtcagcagattatttgctggccatttattgcgtccctctcttgcggggctgggggacagtagtgagaagagcaggcccgtgtcattagcgaactatgcccttgaacccaggcgacggacgctactggcaagtcattcatacgtcacatattgacctaacttcgaccacgtgtgacttgtgtgccctagcagaagttgagtgtgtggggtgttacggggagccctcagggggatcccccaccctgcccaggaggctcagggatggctttccaggtgaagtgactcttgaatggggttttgaaggaacagagtttttcaggcagtctgagggtagtgggattagggtgatacaggcagagggattgcacgtgcaacggcatgaaggtataggtattgtggtcagggataccacaggtcttgaggtgactggaggaggagagtaacaagatgatacagcaggggctgggtcacgaagcgtcttgtgtgcaagactaaggaactctgcggggtggaggaggcagggaagatttcccccaagaagggtatcagagtgaaacctggacagatgaattaggagttcacgaggctcctgtttcaaagacatcccaagagcaggaatcctgttctgttcatcgttacaactttctcatcagatgcccttgggcaacccacccagtcccccagagcattggtttccttatctgtaaagcaatggtagggggcatgtggtgaggatataatttttttttttttgagacggagtttccactcttattacccaggctggagtgcagtggcgcgatctcagctcactgcaacctccacctcctaggttcaagcaattctgcctcagcctgctgagcagctgagactacaggaacacaccaccaggcccagctaatttttgtatttttttttttttagtagagacggggtttcaccatgttggccaggctggtcttgaactcctgacctcaggtgatccacctgcctcagcctcccaaagtgctggaattacaggtgtgagccaccgcacccggccaattttttttttttttctgatacagaatcttggtctatcgcccaggctgtagtatagtgtcgtgctctcagtcgctgcagcctccacctcccgggttcaagcgattctcctgtctcagcctcccgaatagtaatatcctataattttcataaagcagtgaagttgtgtgtcccttcccccaggaaaaatgaacacataggcccaggcacaggttgtatagaacggggatcccaggtgagaaactcctagtgtgaaatataccacctgtgtgcctggcataacagcagctcaccaaatgtatattgttgacacatgagccctctcctcccttccctcctggggaccttacacacagagatttttcagccttagtctggcaggcaagttcttcctcctggtgtgggggacggagggcacagctgcagtggcctgggagggctctgtctccttttacagaaatcgaggctgtggtgaggtcactggaggtcagggcaggagcaccaggctccgggcagactgtctagactggcgtgcctacccactttcttcaataaataaggaaggtgaggtgggggtagggcagctccagctctggtggagcatggtcatgagactgggatttcattccacctctctgtgacctgggtcacctttccctgagcctcatcttccccttagctgtaaaactgggatgagtctgctcacctcaaagggcagctgtgggcattcaggagtgcctgatggtggaagctgactctgtagccgacttatctgtgactgtctcactcttctcccagagactgtatgctccttgaagatggaagctgtgttgtgtggggcggggtggggaagcatgatgccaaaagccaactccttattcccagcccagacactcactgcctggttaagaaaacagccagagaggccgggctcggtggctcacgactgtaaccccagcaatttgggaggccaaggtgggcagatcacctgaggtcaggagttcaagaccagcctggccgacatggtgaaaccccgtctttactaaaaataccaagcagttagccaggcgtggtggcttgcgcctgtagtcccagcactagggaggctgaggcgggagaatcgcttgaacctgggaggcggaggttgcagtgagctgagatcgtgagtctgaactccagcttgggcaacagagtgaggctccatctcaaaaagaagaaaagaaaagcaaataaaggaaaacacacccagagcagtgagagaagtctgtatacaagacccatttgtgcagtagaggctgtgcaggcaggtaccgggaacagggctccaccttttagaaggtggtcctctggccgggagcagtggctcacgcctgtaatcccagcactttgggaggccgaggtgggtggatcatgaggtcaggagatcgagaccatcctggctaacacggtgaaaccccgtctctactaaaaatacaaaaaattagctgggtgtggtggcaggcgcctgtagtcccagctactcgggaggctgaggcaggagaatggcgtgaacctgggaggcggagcttgcagtgagccgatatcgcgccattgcctccagactgggcgacagagcgagactccacctcagaaaaaaaaaaaaaaaaaaaaaagaaggtggccctccatcccctgcccttccctggcgattgccagcccagtgcagggcctcaagtcttccattttggagaggaagcctctgggactcaaagagcactcaggtgccgtctccaccgcagcagggagttgtcgccactgtccttccccacatctgtgggtggatctgtcaccacccaccccaccttccctcaggctctagctgcctcattgtctcctctctggtctcaccatcctctcctcagctggcttctgctctctgcttcttggacttggccaagtgcataggggatactggggaggcctgcccagactgccttagcccctgcctggaccaaggtctgccttcagaatcagtcagataggcctgggttgcttttctaggctgccctttacttgctctgtgaacttaggccgataaagttatctttctgagcctcagttccttaactgtgaaataggagtgacagtgctgccttcttcagcttcctgtgaggaataaaagggttttgcatatggaagatacagtgagttagccggtgcccccaggggctcatattttaggaagttgattggtatggtggacaggcatgtaaattaaagtgattgtgatccaaaagtctgtcccagtttctcagagagaatgactagttcaggatggaggagggatcagaggaggtgactttgagacaccagtagatgttcttccagtgggataagggatgggaaggcgttccaggtaaagagatgcaaatagtatggagaggacagttagcattctggcctggtgggtctggcaaggagattgtgtgggaagagaagggaggatgtgatagataggaaatgaagctaaaggttctgtcagtacccgatgttggagacctctaatacccagctaagaaatgtgggctttatcttccaggaaaaggggaccactaaggagtccaagcaggccagcagcttgcttcaggtttgaggtttggaaagatcatgaatgaggccgggcatggtacctcacgcctataatcccagtactttgggaggtcgaggtgggaggatcacttgagcccgggagtttgagaccagcctgggcaacatagtgagaccttgtctctacaagaaaaaaaaaaattacaaattagccaagcgtggtggtacatgcctgtagtcccagctactctggaggctgaggcaggagggtcgcttgagcctaggaggtggaggttgcagtgagccgtgtacgtgctgctgcactacagcctgggcaacagagtgaaaccctgtctcaaaaaaaaataaatatatatatgtatatatatacacacacacatatttattgatcacgaatgacttggagaatgagaggaggggatgagggtggggaccggaagaccagtgaaaagttgctgtctttcctagggaaaggaggaggagacacagttccaggcaagctgagagactactagggagcatggggaggaaggaggcagaagaaatttcttttttttttttttttttttttgagacggagtcttgctctgtcacccaggctggagtgcagtggcgtgatctcgactcactgcaagctctgcctcccgggttcacgccattttcctgcctcagcctcccgagtagctaggactacaagcgcccgccaccacgcctgtctaattttttgtatttttagtagagacggggtttcaccgtggtctcgatctcctgacctcatgatccgcccgcctcggcctcccaaagtgctgggattacaggcgtgagccaccgcgcccggccagaagaaatttctaataacactcaaggacgccagctctggagtctgactaacttggttcagatcttggccttctcttccaatcttgagtgagatacttcacctttctgagcctcagttttcttctctgtagagtgggatcattgtggccagcttgtagtgaaacgctccagaatattagccaaacacaactaaggagatgttgactgggtttgttccatccatgataacagattttttggttaatgccccatgacaccaacacttcatatagcccttatgtgtctgactccattccgggctgtgctcatggcagcccagccatcagcaccaactgtgctgacataattgtttcctgctttttctcctgacttcttattgtgagtacttttcatgctaatacagtctccctcccaggcacagcagactgctacagattattctgatgaactgatgagatgtttgccttggcatacagctgtctatctaaaacaagggtgcctctttttttggtggagggacagagtttcactcttgttgcccaggctggagtgcaatggtgcaaactcggcttaccacaacctccacttcctgggttcaagcgattctcctgcctcagcctcccgagtagctgggattacagcacgcgtcaccacgcctggctaattttgtatttttagtagagatggggttcctccacgttggtcaggctggtctcgaactcctgacctcaggtgatccacccgccttggcctcccaatctgctgggattacaggcgtgagccaccgtgcccggccacaaagatgcctcttatatcccacatccctaccccatctaactttgcctgcctgacatcctttctgggatggctcccaagcacttcagattgaatgaaaacacctagcaacatggagcttcacgtctcttctctcctgtttgttcaacagtgttctctatctcactacatggaagtctaccatctacctggtcatttaagcccaagcctgggagtctttgtgtttggccaagctcatagggggatcttgggcaggcctgccaagaatcctctggacttttttaggatgaacaaatcaagccaagtgctgtggcacgtgcccatgatcccaggctcttgggaagctgaggtgggaagatcgcttgagtccatgagttcgaggctgcaataagctaattgcaccactgcactccagcctaggtgacagagtgagaccccctctcttaaaaaaataaaataaaaggccaggcatggtggcttacacctataatcccagcactttgggagtccaaggctagagaatcgcttgagcccaggagttcgggaccagcctgggcaacatggcaagacgttgtttctgcaaaatatacaaaaattagccgggcgtggtggtgcacacctgtagtcccagctatccaggatggctcaagcccgggtggttgaggctgcagtgagccatgaccatgccactgcactcaagtctgggcaggaccctgtctcaaaaataaatacaaaggatgaacaaattatgagagtaaaaaagggttagtctcctttatccttgctacacctcctcacccaaagccaagcagtagtgtagcaggataagccgcagacaaaaccccccagacacccagttaaagaaggaagggctttattcagctgggagctttggcaagattcacgtctccaaaaactgagctccccgagtgagcagttcctgtcccttttaagggcttacaactctaagggggtctgcatgaagaggtcgtgattgattgagcaagcaggggatatgtgactgggggctgcatgcactggttatcagaacggaacagaacaggacagggattttcacagtgcttttccatacgatgtctggaatctatagataacataaccggttaggtcaggggtcgatctttaaccagacacaggtcgcggcgccaggctgtctgcctgtggatttcatttctgccttttagtttttacttctttggaggcagaaattgggcataagacaatatgaggggtggtctcctcccttagtagtaaagcactataaatatttgtggatttacaaccatttcattcagtcttgatgacagccctgagaagtagtcattgcatccccttttatagatgaggatacagttcagagaggttaaggcaactggccagccacaagctctggaaggtgaacccagttccctctaatcccaaagaatgtgcactttttagtgtgggacaaggggtctcaaaagacaggtgggaggattctcagccctgggagaataaaagttgggtgaagttcagaactgccacctcatcagtcagaactgggccagtgacaacctgcagaagctcagcctgcaaaggcttatcaggattctagacctttggttactttcccatctttagtatttagttctccttccccaggataatcagcagaaaagtgcctggccttgtgtccatataccatggaggggagagctagagaggcgaggttctcgggaaccactagaaggaaggaatgagggggctgctggttaggcccagagctgagaccgagaagggctcttggagttctccttcccttcgtaacattaggtagaggcttagacaacttgattgtttttcatgaccttaaagactgtggctccggccgggcatggtggctcacagctgttgtaatcccagcactttgggaggctgaggcgggtagatcgcttgagcccaggagttctagaccagcctgggcaacttggcaaaaccctgtctctacaaaatatataaaaattagctggacactgtgatgcgcacttgtagtcccagctattctagaggctgaggtgggaggatcacctgagctcaagaggtcaaacctgcaatgagccgtgattgtgccactgcacttgagcctgggcaacagagagtgagatgctgtctcaaaaaaacaaacaaacaaacaaacaaaaacaagtacttgatgactccattggggtcaattatgaagagacctcttagtgcaagaccaggaccttctaacagcacaccgaagtctcgagaaattcgcttagttaaatctgacaagggtgcgatgtttatgtggcccaaagcaccattctttcttggtgtatttatccaggcaagacggctaaagtgggaatccactgagactgcaacaacttcaaagttcacatcgtgaaattccttagctttgtcactagaagcaacaatttctgtaggacacacaaaggtgaaatccaaaggatagggctgggcgcggtggctcacacctgtaatcccagcactttgggaggctgaggtgggtggatcacctgagttcaggagttcaagaccagcctcaccaacatggtgaaatcccatctctactaaaaatacaaaaattagccaggcgtcgtggcaggcgcctgtaattccaggtactcaggaggctgaggcaggagaattggcttgaacccaggagggggaggttgcagtgagccgagatcgtgccactgcactccagcctgggtgacacagcaagactccgtctcggaaaaaaaaaaaaaaagaaagaaatccaaaggatagaagaaaagcaccaaatatttcccctcaaagtcatcaaggcttaggtctttgaactctccattgaccacggctgtacccttaaaatagggcgcatgctgggtgacatcaggtgcatggtatgaggaactggtaccagaattttgcttgaccggaaccagaccacaatatgtttgtcaaacttgttcttccagaagcagcaggcctgagggctgcagtggcagaaatgcccccaaggaatggcactcacatgccgggcaactgatgctcagagtaaccttcccacagcagccgcgatcttcagtgcatgtgtgtttttgtttttttgagacagtgtctgtctctttcgcccaggctaaagtacagtggcacaatctcagctcaatttagcctcagcctcccaggctcacgccatcctcccacctcagcctcctgagtagccaggacttcaggcgtgcaccaccatgcccggctaatttttgtaattttttggatagaaatggggtttcgccatgttgcccacgctggtcttgaactcctgggctcaagcgatcctcctgcctcgacttcccaaagtgctaggattacaggtgtggtggcaccttgtctctaaaaaaaatcaatcaattaaataagaaaagaaaatagctcttctccccctctgattataacaacacattaccaaagttactggtgcttacatggggttgaatggagttatgatggatatttcatttaatgttgttcttcaatgttttaattttttacaacagacttaaaaattttttaaatacatgtggccaggcacgatggctcacgcctgtaatcccgcactttgggaggccaaggtgggtggatcatctgaggtcaggagttcaagaccagcgggaccaacatggagaaaccccatctctactaaaaatacaaaataagccgggcgtggtggcacatgcctgtaatcctagctactccagaggctgaggcaggagaatcacttgaacctgggaggtagaggttgtggtgagccgagattgcgccatggcactccagcctgggcaataagaacaaaactctgcttcaaaaaaaaaaaaaaaaaaacatgtaatcggctgtacgcagtggctcacgcctgtaatcccaggacttcgggaggctgaggcaggtggattacttgagattaggagtttgggaccagcctggccaacatggtgaaaccccgtctctactaaaaatacaaaatttgggctgggcacagtggctcacgcctataattccagcactttgggaggccaaggcggggtggatcactgagatcaggagttcgagaccagcctggccaaactggtgaaacctcgtctctactaaaaatacaaaaattagctgggtgtggtggtgggtgcctgtaatcccagctactcgagaggctgaggcaggagaatcacttgaacccaggaggcagaggttgcatgagccgagatcgcaccattgcactctagcctgggtgacagaacgagactccatttcaaaaaaacaaaaacaaaacaaaacttagcagggcatggtgatgcacacctgtaatctcagctactcggaaggctgaggcacaagaattgcttcaacccgggaggtggaggttgcagtgagctgagatcatgcctgtgcgctccagcctggcgacagagtgagactccgtctcaaaaaacagaaaaatacatgtaatgctccttgttaaacatcttagataatataggaagataaaacgaaacaagtaatgattatctataataccattttccgaggttaccattgttaatatgggatatattttcttccccacatttttctcacatattttttgtgtatgcattttttttccaaaaaaaaaaaaaatggatgataggctgtttttcttccttttttttttttttttttttggttggggggtggagtttcactactctttctcccaggctggagtgctgagtgcaatggcatgatcttggctcaccgcaacctccacctcctaggttcaagcaattctcctgcctcagcctcccaagtagctgggattacagtcgcacaccaccatgcctggctaatttttgtatttttttttttttttttggtggcgacggggtttcaccatgttggccaggctggtctcgaactcctgacctcaagtgatccacccaccttggcctccgaaagtgccaaagtactgggattacaggcgtgagccaccgcgcccaggctttttttttttttttttttttgagacagtctggctctgttgcccaggctggagtgcagtggctcgatcttggctcaccacaacctccacctcgcgggttcaagcgattctcctgcctcagcctcctgagtagctgggattacaggtgcccatcactgtgcctggctaatttttgtatttttagtagagacggggttttgccatgttggccaggctggtttggaactcctgatctcaggtaatccgcccgccccggcctcccacagtgttgggattacagatgtgagccaccacacctggccgtctgtttttcattctgcttgttttacttggcaatggggaacatctttctattcaatagattgatctctgaaaacatcacttttgatggcttcatactgttctatcatgaatataccacatatttagttcactactattgaacattcgggttctgtttttgttgtttttaaaatgttatgaaggatacagtagagaatatttgtgtaattaatctgtgggtgcatccattattctgttcttgggatacattttgagaagtggaattgttgggcaattcctcttaacgtatttctagagtgtttgataaatattgtctgattggcccaggaaaatgtttgccatttctcatatgtagtatttgactgactttcaggacaggaagatgtcacccaagcgcatagctaaaagaaggtcccccccagcagatgccatccccaaaagcaagaaggtgaagggtaagttggccttggcctctttgtgggtacaggtggccccttgaaaccctaagaacccgggactgggctcctttcttcctgaggcttgaagctgaagggtgtggatgtgcagagaccccacccagctggaaggtttcctgtagctcattgaatcctaccctctgggaatcacaaagtgggcagaaactcctctcaaagcactcaggcagcactggcacaaaaaaaaaaaaaaaaaaactagaccctagggcttcaccccaggcagtgatgcattatggttaggaccactgactttccgacatgggttcaagtccttgctctgccactttctagctgctgggcaagtcacttaatcccgcagtttggattatcaacttcttaaaatggcggcagccagagcagcgtcaccctctctgggctgtgtgaggatgagatgagataatggcctggcagcatttgagggaggtggctgtggtttcctctgtcctgggaccccggagggggacagggaggagagaaaagccagcaccaaactgggaggggaagtgtggacccacgctcagacagtgtctgtcttttgcagacacgagggccgctgcctcccgccgcgttcctggcgcccgctcctgccaaggtgcctgcgggccgagccctcctgaccagaaaacccgaccaggtggctccgcgcccggggcgccctctgtgctgccagcgcgggctcctcagcggtggccacatcctcgggggaggggctgggcgccattggctgcccggggctgcgggttggggggccgcctttggcccacagagagccccgggcgcgcacctcccgcaaatgccgctgtccgctcttcctcccgcccctcctgcctctccactggatggtggagggaagagtccgtttctgcagtggatttgcccgggagctgaacttattcactggcggacggcttgggcatggaggagggcttggatggagactggggattgttctctgacccacgtagtctcccttgctttcggtgcagattctgctattataattagctttctgcggggcaaggtggctcacgcctgtcagaagatcgagaccatcctggctaacacggtgaaaccccgtctctactaaaatacaaaaaattagccttgcgcggtggcgcgcgcctgtagtcccagctactcaggaggctgaggcagaggaatcgcttgaacccgggaggcagaggttgcaattagccaagatccaccactgcactccagactggcgacaaagggagactccgtctcaaaataacaataacaataattagctttcttttctttttctttttttttttttttttgagatcaagtatcactctgtcgcccagactggaggcggcagtggcacgatcttggctcactgccacctccgcctcccaggttcaagtgattctcctgcctcagcctcctgagtagctgagattacaggctactgttggcaaggctggtctcttaactcctgacctcaagtgatccgcccgccttggcctcccacagtgctaggattacaggtgtgagccaccgcacccagcccttcttgccctctccaccaagattcatttcacagtatccagtgtctccttgtttccctttctcccctttcacgtgaataatgtgctcagttcttaatctccacaaaaatcctgtgagagaggtacttttgttgtccccatttcacagatgacaaaacttagaaagttcatactaacagtctgtggcagagcaggggcttctgcacaggtttgtctgatcccagagcctgtgacctctcctcgctgtcgtcatcctctacactcagggtctatcttcttcacccttcagtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtaggtgttggggactggcacagggttggacaaggcctggggttgggtggcttggggcagggcttttgaaccacgcatgttcactgtggaaatggagctggctagtcaagtggggagtggcctacatgagaatggactgcgaggccagacgttgcattaatgagggcatcctgggcacaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggtaaggctgggtctgaaagtctgcatggtccctgaaagacagaattaattggcggggccccaaagataatccacttccatgcccccatggtacttactggtggggagatgaaagcccacaggtagagctgaggcccagacccaggactctagcttcctcatgtgggcctgtccacgccactggctgcttccttgaatccgatgtcatcaagtgtctgtcctgggaagtgagtgggtcaaggatgtccctgggttgaggctgatccaggaggcctgctgtcttcacccatctccctgacttctgtctccccctcaccttgccagcactgcctcttccacacttcccagaggcttggatggggcaaggaggtgtggaggcagggattgtcgcatctcagagtttccaaggtacagaggagtgtagttgaaaaaacagattgtgggtttttgttgttgttgttgttgttgtttttgtattgttttgagatggagtttcactcttgttgcccaggctggagtgcaatagcgcaatcttggctcactgcaacctctgcctcccaagtttaagtgattctcctgcctcagcctcccaagtagctgggattacaggcatgcgccaccacgcctggctaattttgtatttttagtagagacggggtttcccctgttggtcaggctggtctcgaactcccgaccccaggtgatccacccgcctcagcctcccaaagtgctaggattacaggcgtgggccaccacacccggcctgatgggtgtttccttatcacatctattttgaaattttcatggagaatttcaaacacatgaaagtaatcagaattgggctgggcgcggtggctcatgcctgtaatcccagcactttgggatgccaagatgggcagatcacgacgtcaggagatcgagaccatactggctaacatggtgaaaccccgtctctactaaaaatacaaaaaattagccaagcgtggtggcgggtgcctgtagtcccagctactcgggaggctgaggcaggagaatggcttgaacccgggaggcggagcttgcagtgagccaagatcgcgccactgcactccagcctaggggacagagcgagactccatctcaaaaaaaaaaaaagaagtccgggcgcagtagctcatgcttgtaatcccagcactttgggaggccgaagcaggctgatcacctgaggggtcgggagttcgagaccggcctgaccaacatggagaaaccctgtctctattaaaattacaaaattagctggacatggtggtgcatgcctgtaatcccagctactcgggaggctgaggcaggagaattgtttgaacctgggaggcggaggttgcagtgagccgagatcgcgccattgcactccagcctgggcaacaagagcgaaactctgtctcaaaaaaaaaaaaaaaaaaaaaaaaaggaagtaatcagaatatcagaattatatttttttcttttcttttcttttcttttttttttttttttttttttttttttttttttttttttttttttttttgagacagagtcttgctctatcacccaggttggagtgcaatgacacaatctcggctcagtgcaacctctgcctctcgggctcaagcaattctccttcctcagcctcccgagtagctgggattacaggcatgcgccaccacacctggttaatttttgtatttttagtagagacggggtttcaccatgttggccaggctggttgtgaatttctgatctcaggtgatccgcccgtctgggcctcccagagtgctggattgcaggcttgagccgccacgtctggcctcttttcttttttctttgttttgagacggagtctcgctttgtcgcccaggctggagtgcagtggcgcgatctcggctcactgcaagctctgcctccctgattcacgccattctcctgcctctgtctcccgagtagctgggactacaggcgcccgctacaacgcccggctaattttttgtattttttggtagagacggcatttcaccgtgttagccggaatggtctcgatctcctgacctcgtgatcgcccgccttggcctcccaaagtgctgggattacaggcatgagccaccgcgcccggcctcttttcttttttaattagagacgagatcctgctctgtcacccaggccagagtgcaatggcatcgtcttagctcattacagcctcaacttcctgggctcaggtgatttcttccacctcagcctcgcaagtagctggtactagaggcttgtgccaccacgcccagctaatttttgtattttttgtagggacggggtttcaccgtgttgcccaagctggtcctgagctcaagcgatctgcccacctgggcctaccaaagtgctaggattactggcatgaattaccatgcctggcccagaatagtatattgagtgcccatttacttgccacacagtttcaatgattatcagcttgtggccagacttgtttatctctatttgcatccgctctctgactccttgattattttaatgcaagtcgcagaccataaatgatttcattcataagtatttgagtatgtggcctggctcctgcccacttctccatccccatctggtgccactgcccttctggatttcactggcacggggcaggcaggactggctgataagtgccctgtccctcccttctaggacaataacggtgtgattggactgttggagcccatgaagaagagcatggtgcctgtgcaggtgcagctggatgtgcctgtggtaaaggtggcctcaggtgggtctgggggcacttgctcagggcaggagttggaggaccttgttctggggctggcctagccttgggccttacagttgtggcctgcatcccttaccttttcatccttaggaaacgaccacttggtgatgctgacagctgatggtgacctctacaccttgggctgcggggaacagggccagctaggccgtgtgcctgagttatttgccaaccgtggtggccggcaaggcctcggtaagtggccttggtacctccagcagggcaaattggcaggccacccccacagtgaaggccaaaggcaggaaggatttgctgtggtcaggcttgcatcagatgggcttgtggtgttggttaggactttggagacagactgctctggtagttttgccacctactgtctatgggactctgaacatagtttcttcatcactaagtctacctacctgtaaacctacttcattaggttgctgtgaagttaaatgagttaatgagaagaatatcaggcagatggtaagttccacgtaaatgatacccgtaatgactgtgggaatctgagcaaggcacttgtattctcttgatctcagtttccttttctataaaatagggataagagtccctacttagcctctcaagggcttttataatggaggagaattaaactcggggcagagagaagccatgtgtgtctgtctgtcactgaccgtggctttccctttgcctgcagaacgactcctggtccccaagtgtgtgatgctgaaatccaggggaagccggggccacgtgagattccaggatgccttttgtggtgcctatttcacctttgccatctcccatgagggccacgtgtacggcttcggcctctccaactaccatcagcttggtgagccccgagcccagcttcaggcatgacccagtggcctgcgttcctgtcctggctctgccactcattcattgtgcatcctttgcggggtcgtctaacccctccaagccagttttgtcatctgtaaagtgagaatgtccatatcctgatgggaggtggcctcactgtgggaggagattgagaagggcagctctcagaacaccttcacccctgatggctccggcctttcccccaggaactccgggcacagaatcttgcttcataccccagaacctaacatccttcaagaattccaccaagtcctgggtgggcttctctggtggccagcaccatacagtctgcatggattcggaaggtagggcctttacgtccttctctagtttgggggtggagtgttccctggcctaggcctagccagattcctgagaccatggtccttggagcctgggtctgttccatgggttgtaccatacatgggtccatgagagtcactctcatcctcctagagtcctggtgttcttccaagtgtgagttcaatgggggcccatgtagattctcctaggcctcctccaaaactgggaagagacactgcagatctccttctgatcgctctgggagcagggacacactcccatggacaggtggactcacctagcctgccacccattttgcctgtagcacgccctctgctattgctcatctctctccctcctcccataggaaaagcatacagcctgggccgggctgagtatgggcggctgggccttggagagggtgctgaggagaagagcatacccaccctcatctccaggctgcctgctgtctcctcggtggcttgtggggcctctgtggggtatgctgtgaccaaggatggtgagtggggctgcctacactctgtctagttgggacctgggggtcatggttcttacccaattccccaataggctgtgatgtccactctcgggggagccgaggtacagagagcagtgtttgtgatggcactttgttcctgcttctcagaagctctggcattgatgaatatgaaatgagtacacaaattattttagtaaaggtgacttattatgcagaggagagaaatagcaaagagtgagatatcactgaggcctaaggaggcaatgggactggaacccaagtctccagactcctaacccaggctgctctctcccctcagggtgaccccttcatatatcaccttgtatgttcccgctttccagggacttttacttagaatctaaatcaagaaaaaaaaaggcttagtagtcagagttgtagcaactatagcagaggagggtgtgaacaagtgaccaccaaagcctgagtgggtgagggggatagccatggaggtcctgtagaagcctggagctggcagaggtgcttgacctgaggttatctgggaagacttcctcaggaagtggggcttgcactgtaccttgaaggttccattccttgtgaaaagcaaagaatgccattccaggcagaggaacatcagggcagtctcaaaggtggctggtcctgggaacagagggtggggtaggaccttgaatgccacgcctaggagcagcctttggcagtgtgtagggactgtgctctctggtttacagagttcttttttatccatcatctccttgggttctcccaacttccctgaactcccagagtctggtaccttgccaagctgctattggccaaggccacagtccacgcccatgtcccaggtttctcctgctacagaaaggtgggctggggatcctggagacagctgtacccatttctctctcttgcaggtcgtgttttcgcctggggcatgggcaccaactaccagctgggcacagggcaggatgaggacgcctggagccctgtggagatgatgggcaaacagctggagaaccgtgtggtcttatctgtgtccagcgggggccagcatacagtcttattagtcaaggacaaagaacagagctgatgaagcctctgagggcctggcttctgtcctgcacaacctccctcacagaacagggaagcagtgacagctgcagatggcagcgggcctctccccagccctgagcactgtgtcagttcctgccttttctcatcagcagaacagaatccttttcctcttttccttcctcctctttggaattttcctgggacctacagaataaagggggggatggacagggggttttcaaaaggaacatggctcactcagagctatatggttagacgtttctccccttttccctaccttccatggtcctggttggccctggctttgcctactagaaaaccaaaacttcccccctggggttttgtgcccactctctgagaagttggggctccatcaagccccattctagtcatgtgcccctttcctgtccctaacagtccacaggcaaacaaatggtacagtcataagagccatctgtcacggacccacgcccagaggaacgtgcagaaaaaagcagagctacatggctgtgggcaactataagccaaatatttggctcagaacaggtgtccatgggacaaaaaagaacgatcctccacttgaccaagaaaaaagtgattctcccagaagcacaaagcatactcttgcccctcaggtgttgcttgtgtacatcgtacccatccattcggcttcacctgcagccaacggcctggaatcgcaaagagacaccactctgggcagagcagagcagggtatggggtggggagagagggtggagggttttataaacaaacttaacagcaatattgaaaggaggtgggggattgagggagggacagagtgttggagggccagagactagtcctgagatggaaacagcaacttgtacagtggctgagaaaataggatatagttttgatttttttaattgtaaaatattttggagggagaacaaaatcttttaacattttgaataaatttagagttttataaaataggccacttgttttctacacattccctgctttttaagggagcacatattatgtgccaggcactgctgggaaagacagaataaactataaacctggtgttgaggctacaacttaagtgatgtcaagatgtcctgaggtgccaaccagctgtcagtgtgactgtaacaaaggcttcaaatctgtcaagaagtaaggaaaagttttgtttg

SEQ ID NO: 702 - DNA, 20964 bp, Homo sapiens; identical to SEQ ID NO: 701

SEQ ID NO: 703 - DNA, 20964 bp, Homo sapiens; identical to SEQ ID NO: 701

SEQ ID NO: 704 - DNA, 20388 bp, Homo sapiens
tcaatgaaacaatgaagcaataaaagcacagatttattgaagcaaaagtatattccacagagtgggagcaggctaaagcaagctgctcaagagccccagttgcaaaatctggggtttaagtaccctttaggggtttcctattggttacaccctatgcgccaccaatcggaggccgaagtgaaggctcccagtctccagactcttattctcctagctcaaagaaatccactgatttcctctgtagcatcttcaggttccatcttgacaacttcctctaaatccccaggggaagagttgtttagagactcctggatgccctgagggagcggctccagagcttgccttccctcctctgttttcacaacggtccagcgataggcactgttctctgacaatccttcttggcactgtttatcgactggtggaggccctgggctatgttccactttggggaaaacagtagcagagagaggagatagttcctggggctctaatttgggttctaggccctgaaaggcattttccccatcagccacagcacaagcaatgtccacattcatgtgggccttatcttcaggggtggatggtataggaagattcacagaattgccagaaacaattaagggtgagacagaggaggccacaaggggctggttcaatggacaggggaaggaagtagggttaaccaagagggtggcgatgggaatagtctggggactctgggccacagccgcattgacaggctggatcatgttacagccaccgccaaggctcacaatcttcacagtggtagcaggaacagtgaagataacagatgcagggtggataacaggggcaggtttgatacagcgaaaggccctggctccccttctttttgagggtctccgtctcacatatggctttcgaaacatggaagaggcaggggagggcatcattaccttgggcacaggggcagaagagagcaaagtctgggactcagacagagggaagcttgtcctggcctcagggggcatagcaggcagtgctgcaggagactcaaaactctcacctccactgacccccagtggagggacacctggaactgtctgtaaaacagtggctggctgtattgggtgaggaatccggagcaccattttgctcggaggggcttctgaatgagttgattgggctggtgttttcccagggttgaagctgggctggagagaggggctgggttggataaggaggggtttcaggactgatgaacgcttctgtctccaagccttcttggggaaacggtcggcaactggcttcagtttcaggactacacccttaggcaatagcagtgggtaccgagtttcactccccaactctgagttgtctttttctaggccttgatctgagttgatctcagtggttccagtcatatttcctacctctctagcaccatcagccatgtgccgcagttcttcctggatggatggcagactggcctattggaaatgagaacactctgatccagcacatgtcagaatttgggaaaaagaataggactttctaagtttagggacctgagacaagctcaaggcatctttccaagggactctgcatatgaaatttctacaaagaccacagtccaattatacactttagaaactcttctctgaatttcctttagcaaattaccattttacccattattttgaaaatgttgtagaatcacccggagaagggcagaaaagtaagggaagaaaggtgaatcaggaagattcctgaagtcctagttctacaactaaagcattagacgattaaggaagtccttgatattctctcagaactttcagtgaccttctgcctcctacagacttcgaggaagagggctgtacctttaaccagaatgggagccggtgttcttctctctctataggtggcttccactgatgtggctggatctcttcacagcattttcctaggactggcagctgtttggtcttcttataaaacttaacatgaaaaaaatgcgcatgaattacattccttctggaaacactgtcttctgtcaggctggtgaatggggtggtggtggatcaagagaaacacacacacacacacacacacacacacacacacaagaccacatacacaaacatccatgaacacacatatacgaatagcatatgctgaatacttgtacatttcaaattaaactaatctctatttaaagattttatagttattcagtattttctttttgagacggagtcttgctctgtcgcccaggatggagtgcaatggcgcgatctccgctcactgcaagctccacctcccaggttcacgccattctcctgcctcagcctccggagtagctgggactacaggtgcccgccaccacacccggctgatttttttgtatttttagtagagacagggtttcactgtgttagccaggatggtctcgatctcctgacctcgtgatccacccgcctcggcctcccaaagtgctaggattacaggcgtcagccaccgcgcccagccctattcaatattttctaactgatgatctccattctggttgccaggaaggggagagtttaggtcacagagagaaaaggaagcagatgctaagagcaatcttatgtaagatttgttcctgctcaacagctgcaaagacagcatcgtaatctataaaatggacacatcaaagactttaagcaaatgatggtgtgaagggcatcagaagggaaggaaaaaaaaaaagaccgaggcagttcagttttaagagtaaataggctggccttggtggctcacatctgtaaacccagcactttgtgaggctgaggcgggcagatcacttgagattgagagtttgagaccagcctggccaacatggtgaaactccatctctactaaaaatacaaaaattagctgggtgtggtggtgggtgcctgtaatcccagttacttgggaggctggggcaaaagaatcgcttgaacctggcagtgggggtggtagggtggagattgcagtgagccaagatcatgccactgcactccagcgttggtaacagggtgagactccatctcaaaaaaaaaaaaagaagataagaactgaacttaaaccatgacaataagcatctgttcatccaacatgatgaacataagatgttttctatatcctaggcactgtgctaaaagctaagcacacacataagggaagcaattcctgctctcatggagcttacagactagtgggagagtcaagtggacaaatggcatcctacattaaaaaatgtacaaagggctgggcatggtggctcatgcctgtaatgccagcactttgggagaacgaggaggatggatcactggaggtcaggagttcatgaccagcctggccaacatggcgaaaccctgtctctaataaagtacaaaaaaaaattagctgggtgtggtggtgcacgcctgtgatcctagctacttggcaggctgaggcaggagaatcacttgaactgaggaattaagaggttgcagtgagccaagactgcaccactgcactccagcctgggcaacagagcaagactccaaccccgacaccccgccccatcccccaacaaaagtacaaaggtgtgcacgaaaaatgacacaaaactaaaacttaaacacaaattacttctggccaggcgtggtggcttatgcctgtaatcccagcactttgggaggccgaggcaggcagatcacaaggtcaggagatcaagaccatcctggccaacatggtgaaaccccatctctactaaaaatacaaaaattagctaagtgtggtggcgcgtgcctgtaatctcagctactcgggaggctgaggcacgagaatcacttgaacccaggaggtggagagtgcagtgggccgacatcacgccactgcactccagcctggcaacagagtgagactccatctcaaaaaaaaaaaaaaaaattatttctgcagaagaataaggtttatcacgtgtgccttaaaaccatggatacgccaggcatggtggcccacacctgtaatcccagcactctgggaggctgaggtgggtgggtcacgaggtcaggagtttgagaccagcctgaccaacaaggtgaaaccccgtctctactaaaaatacaaaaattagcagggtgtggtggtgagcgcctgtagtcccagctcctcgggacgctgaaacaggacaattgcttgaacctgggaggcagaggttccagtgagccaagatcacgccattgcactccagcctgggcaatggagcgagactctgtctcaaaacaaacaaacaaacaaaaacaaaaagaaagtactttttaaaaaaccatggataaaaatagacaaatactaaggcatattatcatgcattttcaaaatattgaagccaaaggaaaaatcctgcatgctgtcagaggttgagaaaaacaggtgttacacaaagactcaagagttaaatggggccatggctcatgcctataatcccattactttgggaggccaagacaggacgagcacttgaggccaggagtttgagaccagcctggccaacataacgagaccatgtcttaaaaaaaaaaaaaaaaaaaattagctgggcatagtggtgcacaccgggttggagacaccagtgagccatgatttagccacgctccaaactgggcaacagggtgggaccctgtctcggaaaaaaaaaaaaaaagttaaatggcatgaaatttcttaacaccacactaggagttagaagaaaatgaagtgaggcccttaaaagcttcttaaaaaaattatttcctatctagaattctagatacagtgacagaggagagtattattttttccttttattttgaaataattatattcataggaaattgcaaaaaatagtaccaagaggtcccatgtacccttcaaccagtttctcccaatataatgtttttatgttacatagaaacaagagctatacatataaacaaggtacacagtacaatattactaccaggaaactggccagacatggaggatgtggtggctcatgcctgtaatcccagcactatgggaggccaaggtgggcagatcacttgaggtcaggggttcgagatcacctggccaacatggcaaaaccccatctctactaaaaatacaaaaattagctgggtgtggtggctaatcccagctactcaggaggctgaggcaggagaatcgcttgaacccaggaggcagaggctgcagtgagcaacagtgagactctgtctcaaaaaaagaaaaaaaataaaacaaaaacaaaaacgaggaaactgacatcgatacaatcaaaagaccatgaatggagatttttttttttttttttttaatacggagtctcgctctgtcacccaggctggagtgtagtggcgagatctcggctcactgcaagctccacctcccaggttcacgccattctcctgcctcagcctccagagtacctgggactacagacgcccgccaccacacccggctaatttttttgtacttttagtagagacggggtttcaccacattagccaggatggtctcgatttcccgacctcgtgatccacccgcctcagcctcccaaagtgctgggattacaggcgtgagccactgcgcccggccccggagatggtttaaatgtgaaaattcccttcccaagcactctccctcaggatgctactggaatggggccatgcagggtggctcatgcctataatctcagcactttgggatgctgaagcaggaggatcacttgaacccaggagtctgagaccagcctgggcaaaaaactgagacccccccacctcaattttttaaaattcagaaaaaaattttttttaaaaaaaagctactagaatgtgttccactaaagtaaagaagtaatactcacgcctgtaatcccagcactttgggagaccgaaacgggtggatcaagaggtcaggagatcaaaaccatcctggctaacatggtgaaaccctgtctctactaaaaatacaaaaaattagccaggcgtagtggcatgtgcctataatcccagctactcgggaggctgaggcaggagaattgcttgaacccgggaggcggacgttgcagtgagccaagatcatcgcgcctttggactccagcctgggcaacaaagcgagactcggtctcaaaaaaaagcaaaacaaaacaaaaaacaaggccaggcgtggtgtctcacgcctgtaatccccgcactctgggaggctgaggtgggtggatcccctgaggtcaggagttcaagaccaagaccaaggttgcaggttgcagtgagccgagatccagcctgggggacagagcaagactctgtgtctcaaaaaaaaaaaaaaaaaaaaaaaaagtaatgcaaaagcaaagatgtggaattcaggaaataagaggatctaacacagtatgaggcaaaaggaattcctgggatgatggtgaagaaaaagcccaagaagacatcagtgcagcaacatggagagcaacacgcttaaagtggaataatgtcagagggctcagggagcaatttcttcaagatgaaagtgacagaatatctagaatacctgaacacactgaaagaagatgatctgggaaacaaaatgttcagcaggaaaggcaaggtaacacagtaacatagctgagctgtgaagagcatttatacagtccttaaaatctattttttttttttgagacggagtcttgctctggcaagactggagtgcagtggcgcgatctcggctcactgcaagctccacctcccgggttcacaccattctcctgcctcagcctcccgagtagctgggactacaggcgcccgccaccacgcccagccagttttttgtatttttagtagagctggggtttcaccatgttagccaggatggtctcgatttcctgacctcgttatccacctgccttggcctcccaaagtgctgggattacaggcgtgagccaccgcgcccagccaacagtccttaaaatcttacaatgtaaaccctgaatacaatctaaccaaaattctaccataactactagtgaggagtttggagagcagaaaatgtgcatgtttgtggtgggagtaagggagtgaggagagaggtaaatcttcggcttccgtggtttatggttaataagtaaggcctaaatccaatacaccaggcagtaccaattagaggctgagacaggagaattgcctaaggccaaaaattgaagaccagcctgggcaatatagggacaccccatccctaaaaaaaaaaagttttttgccaggcacagaggctcacgcctataattccagcactttgggaggccgaggtgggcagatcacctgagatcaggagttcaagatcagactgaccaacatggtgaaattatgtttctactaaaaatataaaaattagccaggtgtggtggcgcatgcctgtagtcccagctacttaggaggctaaggcatgaaaattgcttgaacccggtaggtggaggttgcagtgagctaaaattgtgccactgcactccagcctgggtgacagagacagattctgtctcaaaaaaataaaataaaataaataaataaataaatttaatggccaagcacagtggctaatgcatataatcccagctccttgggaggctgacgttggaagaatgcttgagcctaggagttcaaggctgcagtgagctatgactataccactgtactccagcctaggcaggagagtaagaccttgtctcaagaaaaatacaaaaacacaatgaaaccaaaggctgggcatcatggctcacgcctgtaatcccaacactctgggaggccgagctgaggcaagaggactgcttgaggtcaggacttcaagaccagcctgggaaacaaaatgacaccctgtcttcacacaaaataaaataatcggctagccttggtggcatgcacctgtagtccaagctacttggaaggctgaagtggaaggatcacccaggaatttgaggttgcagtgacctatgattgtgcccatgcactccagccaggatgacagagtgagaacctgtctctaaaaaaaaaaaaaaacataaataaatatctaaataaaaaagaaggctgggggcaatggctcacatttgtaatcccagcacttagggaggccgaggcagatggatcacctgaggtcaggagttcgagaccagcctggccaacatggtgaaaccccgactctactaaatacaaaaatcagctgggcatggtggcaggggcctgtaatcccagctacaagggaggctgaggcaggagaatcacttgaacccaggaggcagaggttgcagtcagccaagatcgcaccattgcactccagcctgggggtcaagagcgagactccatctcaatcaatcaatcaataagtaaaaagagttgagaaaaagtatataggctgggcctgggcgacaagagcgaaactccatctcaatacatacatacatacatacatacatacatacagacacagacacacacaaacacacacacacacacacacacacatacatgcatacatacaaacacaaaattgagaaaaagtatataggctgggcacggtggcttatgcctgcaatcctagcctctgggaagccaaaactggtggatcacttgaggtcagaagttcaagaccagcctggccaacatggtgaaacccgtatctactaaaaatacaaaaaattagctgagcgtggtgggcacgcctgtaatctcagctatttgggaggctgaggcaggagaatcacttgaacccgggaggcggaagctgcagtgagccaagatcatgccactatactcctgcactccagcctgggtgacagtgcaagattatgtctgaccaaaaaaacaaaacaaaacaaaaacccaaagcatgtaagtggaatactgcatatcatttctagaaagttcaagaaagagaattattacagggaaacatggatttgtggaatcttttaagaggatgaagatactccagaggaacgtaatgaatgaatcaatgtccctgaaaaggcaacaggggaattaatctagtatataagtaggagaaattagctttagataaaagaaggttcttcttttctttgagaataacaagagaaaagaacagatatgtgttggtgaggtgcctggatagtgcatgcaggaaacactcactttaatgatgttgtcaggagctctgttcatgttgaggttcttgattctcactgtcagttggcgggcagtcttgcaggttagaaggtacttgctgattagagggttaagaaactcagtcccttcaaaatgcttcagtcctaaagctaacaaactgagaaaggagcaataacactaaatctcacttcacagtccttccttctaaagggcctccccagactaacacattttacaatctactttttcttacttgttcttaaaacaaggtctcactctgtcacctgggctggagtgcagtggcgtgatcgcagcccactgcagctgctacttcctaagctgaagcgattctccagtctcagcctcccaaagtgctgagattacaggcatgagcccatggcgtgtggcccaatctactttttcatttttttcagacagggttttgctctgttgtccaggctggagagcagtggcatgattacagtgcactgcagtcttgaatgcctgggttcaatcgattcccgcacttcagcctcctgagtatctgtggctataaacgtttgctaccatgcctaactaatgttttatttcattatttgtagagaccagttctcactttgttgcctaggctgatcttgaacttctggcctcaagtgatcctcctgcctcggcctcccaaagtgtcgtcattacaggtgtgagccaccatggctggccaatctactttttctacaactaattcttgtagtgactactacaagttggtgactactcagtagaaaatttcaggtatttagtgagtagtgattaagtactatgaataagaatcaaatagttcacaattaagtaggagcaagagaaactagtcataaatcatcaataaatgtcagatcatgatgagctgtatattaacaacacaaaggaagttcaaagagaatacatgggaaggagaatgattctaataaaacaaatataaaatgaataataggtaccccgtcagacaaattaaactggcaccaatactaccctctaacataacatatataatcatggttacatatatacatatttgctgttaacagtgtggcaatacacacaaagggccataaaaatgttcataatctagctgggtgtggtggcttatgcctatagtcccagcactttgggaggccaggagtgggaggatcatttgaggtcaggaattcaagagcagcctgggcaacacagagataccctcacctgtacaaaaaaaatcagccatgtatggtggcacacgcttgtggtcccagctactccatggaggctgaggcaggaggatcacttgatcccaggagttcaaggctgcagtgagctgtgattgcaacactgtactccagcctgggtgacagagtaagatcctgtctctaaataaataataacattagaaaagccaacctcctgccttggcctttcaaagtgctgggattacaggtgggagccgccatgtccagtctaaaacattttaaaaatgtgtgtaacatccccccaaaaagcagtatttggcactgctagaacaagcacgttctagaggactctgctcatctatactgcttttccttttgtgtccatgtcttattatacaagtcttacttcccctaaactcctcaaaggaactacatcttctccttgggatatttgatcccccagagtaaacacttacttgtcctcagccttggtgaagaggatcttatcctggggattctttgccttcagggaacacactggaagtaactctggatacatgaaaaccttgcttgtggccaggatccaagccacttgctttggcaaacagggaaattcattggctataagaaaataaatctctgataaatcaacttctaggaaaaaagagggcttcaaaaagcctgtgaatgcatttttgcatttaggtagagctgtccttatctaacttgattccctcccatctgcctaccactccccaaagagtttccacagtctttcctcaactaacattaggtctaaagggagtcccattcactggcaataaaagttgactttttttttttttttttttagacggagtctggctctgtcgcccagactggagtgcgtggcgcaatcttggctcactgcaagctccgcctcccgggttcaggccattctcctgcctcagcctcctgagtagctgggactacaggcgcctgccaccacgcctggctgattttttgtatttttagtagagacggggtttcactgtagacaggatggtcttgatctcctgaccttgtcatccgacagcctcggcctcctaaagtgttggattacaggcgtaagccacggcgcccggcctctcttactctttcttacgtgtaacactttattcacaaagtaaaacaaacacttaaaaagtacctagtaatacctgtcacatagtgtatgctcaaaaatgttttacctcctttcccctttaaatctctgaaggataacagaccttcaacaatgcttttttcttccaggataagattccaggccaggcgtgctggctcacgcctgtaatcccagcactttgggaggccgaggcaggtggatcacctgaggtcaggagttcaagaccagcctggccaacatagtgaaaccccatctctaccaaaaatgtaaaaattagccaggcatggtggcacgcacctgtaattccagctacttgggaggctgaggcaggagaattgtttgaacctgggaggcggaggttgcagtgagccgagatcaccccactgcactccagcctaggtgacagagcgagactccatcttaaaaaaaaaaaaaagaaaaaagattccaacttctttaatctccctcacaaacctggtattccaaattttacttttatttcattctttcttaactttcattaagttctcccagattcctcctgaggttgggaacaaaagaaccataaaaggaatgagacaattcagtctcattcatttctgtctccctctctcagcctctcaattttaggcacctctgcatttctagagacaaaactactatatccatatttctccttccataagtgtcatttttatatctccagaagaaaaacacaggacactagatgtgtaagataatactataatttggtattaaatcacgttttcattaccatttcatataatatagctattaaagtagtttgggatctgtgtctatgatatagtacacttaaattcaactacattcaatgtaatgataagacttagggatttaaaatagaatccaaagacaaacccaaatccagaacaaaccacaactaatttgctaagtcagcaaacaaatcagaagtaaatatttggcttaagtaaatagcaaatattttctcaaaaaatactaaaccaatgcaaggtagaatctaaaccggcaaatttctttaaaatactgaacacggcaaatgtacaatctctaatttacgcctaacttgcaagtcaacatttcattcagaatggagatatcacctatgctacaatcattatggtaaataaagttagttgatcttaatgaagagaataaaaagctaaacatgaccgaactttaccacctgactttcatctttaccaggccccagtttatcttgatctgattcctaatacttacccctcatattgctgtagtccaattcttagcactgagcctcagatctctacctcccatattcctatactgtccactgcctccatgccttacccaggcccggagattatcatgtaattctagaacttggataatgagtacaaagggaggataaaagagagaaggaagaaattacaaatgtcctgtgtcctccattcctaggcaagtatcctaggaagttatctatgggataagattcccaccacctctcaccgcaagtaaaaacttaaagctgacacatctgtctcctaccagtcttcttgacagttttatgagggctgcagtcaatgctgacatgtgtgctgaagtcttcaatcagctgcatagctcccatcaagttacagggttggaacagggtctgaaacttggggttgtactgatggtgaagggcgatggagctttgagcaaaggttcccagctctttctgggaaaacacgacacaaggaagatctaagacaattccagacaattaataccaatagccttcagaatctaaatgagaagctgaccttcctactacaggataaaaacaggtaaaaataatcataaagtctttcacaataaactactgttaagattatgcctgagttctcagatattcagggattatattcttgttttatttttaaactgtttctcactaaggaatacatggtctagctcccgagctagaattaagagtctcaagaatggggactattactttaatttaattaattaatttattttgagacatggtctcactctgccgctcaggctggactgcagtggcatgatctcagctcactgcaaactccccctcccaggctcaagccatcctcccactgcctcctgagaagctgggactataggcatacacctccaaacctagctgatttttgtattttttgcagagacagcgttttcccatcttggccaggctgatctcgaactcctgggctcacaatccgcctgcctcggcctctcatagtgctgggattacagggatgagtcacctcacccgaccaggaccattacttttaaaattgttttgtcttttggtctcagaataatgcctacaaccaagtactcctcatcctcctctgaatacagtaagagatgaagacatcctgttgatcaccaaggaagttttagaatactagcaaatgtactcttcaaaatccaaagaagacttactgaagaagctgagagtattatcattacctgtccaaaagtttgaggcaatttttatgaggtaaagtatggttttgtttttgtgagacaggttctcactctgtcacccaggctggagtgatatataagcacggctccctacagtctcaacgtcccaggctcaagtgatcctcctacctcagtctcccaagttgctgggactacaggcactcggcaccatccccagctaatttttttattttttatttttttggtagggatggggtcttactatgttgcccaggctggtctcaaactcctgggctcaagcaatcctcccaccttgacctaccaaagtgctgggactacaggcatgagccaccatacctggccaaatttcaaatttaaaatctcaaaataggccgggcgcggtggctcacgcctgtaatcccagcactttgggaggccgaggtgggcggatcacgaggtcaggagatcgagaccatcccggctaaaacggtgaaaccccgtctctactaaaaatacaaaaaattagccgggcatagtggcgggtgcctgtagtcccagctacttgggaggctgaggcaagagaatggcgtgaacccgggaggcggagcttgcagtgagccgagatcccgccactgcactccagcctgggcgacagagcgagactccgtctcaaaaaaaaaaaaaaaaaaaaaaaaagctcaaaatacctcaaaacgtcatgagcaaaactagctctacacataaaacactaatattgagcttcatgaatggataatgaattcaacatctacatgtatatttacttcattatttaaattaaaacaaaacaaaacaaaaaaaacacagaccgggtcttactatgttgcccaggctgttcttgaccactgggctcaagtgatcctatcacctcagcctcccaaagtgctggaattacaggtgtgagccactatgcccagcctcaacatctatgaaatgaatagcggtaccaaaaacctaagaagtcagggtgaatctaaagatgaggaggaggacccaataaaaatatcagaaggacaggccaggcgcagtggctcatggctgtaatcccagtactttgggaggtagaggtgggcagatcacttgaagtcaggaattcgagaccagcctggccaacatggcaaaaccctgtctctactaaaaatacaaaaaaaattacccgtggtggtgcccgcctgtagtcccagctacttgggaggctgaggcaggagaatcacttgaacccgggaggcaggggttgcagtgaactgaaattgttccaccgcactccatcctgggtgaaagagcaagaccctgtctcaaaaaagaaaagaaaaaattgaatacactctttgtcctttcatgtgaatcagtggcttatgttcactcagcaaacataggaagccacagcaatcaaaaatacctgagagaataactgtgagaaataacctgccaagctaattttatattctagtctatagaattacggcaatttggaaacttacaagacatatcctggtgctactggcctccggattgagattggggttgcaggtggcaagaaggtggatttgtgtcaagagctgaacatgctggggagagaaagaaaataatgcagtgatatgttatgacactgccatttcaggagcccagagatatttttttttccccctggagacagggtcttgctctgtcacacagcttggagtgcagtggtgcaaccatgactcaatgccctctcaaccacctgtgctcaagcaatcttcccacctcagcctcccaagtagctgtgaccacaatgcctggctaatttattttattattattattattattatttttagacagagtctcgcactgacttttgggctggagtgcaatggcgtgatctcggctcactgtaacctctgcctcccaggttcaagtgattctcttgcctcaacctcccgagtagctgggattacaggtgcccgccgccacacccagctaattttttgttttcgtagagacggggtttcaccatgttggccaggcttgcctcaaactcctgacctcatgattcacccgccttggcctcccaaagtgctgggattacaggtgtgagccactgtgcccagccttatttttattttttgtagagacagagtctcactatgttgtccaggctgcttttgaactcccctgctcaagcaatcctcccacctcagcctcccaaagtgctgggattacatgtgtgagccactgcacccagccaccagagagtcattaactaagatgtttgcaactttatgacacaaattttgctttctgcaaagagtgtgagaacaacgtaggatcttggcataaatttctcagacatgttcccttgaacaaaatgacagaaccagaggaagtttaacctctaaacagaggaggaactgagattagaaaaggaaaaggccgggcgcagtgactcacgcgtgtaatcccagcactctgggaggccgaggcgggtggatcacgaggttaggagatcgagaccatcctggctaacacagtgaaccctgtctctactaaaaatacaaaaaattagctgggtgtggtggcgagtccctgtagtcacagctactcgggaggctgaggcaggagaatggcgtgaacccgggaggcagagcttgcagtgagctgagattgagccactgcactccagcctgggtgacagagcgagactacgtctcaaaaaaaaaagaaaaaagaaaagggaaaagggaaaaaaaactacttgtcacagtgaaggttaaatttcagaatagattactgaggactctttgaaatctgtaattccgaataccattagggtccttatgtgctgtcttccctgagccacaggacatgaacatgatgacttctcaagctcctaactgatgtgaagatactacggttttaatacgtagtaaggtaactatctctgacatttacaaagctgctaattttagattataccaaagcctcagagttaggccttggtataattcaatattaatatgaccaaggaaagtgttacctgctgcatctgctgctggagtctcttcctttgtgctgggtccagaatcagggtctgatgaacttccttacactggggtttaaccttctctacctccttctgctgtttggctgaaggtttcttcatcttcagctgttcaaatagttccttcgctatctgatgttgttcatttagtaggttggccagtagttcctcaaacctatcccaaacggggatgactgaatttgagtgttttcctaggtccacaacacatccaattctttgcaatgatgagcaaagagcctgaacaattttcattccctactaatccccccttttcactttagccaacagtcaaactcccagccttacacaaatcttttcccaaagtagttagcatgcatcaaatgattctgtattacaccccatcccattcctctacaattcctcttccaaataatatacaaatgaagaaaaaattaaacaaaaaactagggacagagaaatatatgggtaagaaagcagccaaggagctggtgggaactcatcattctcatttcttctctcattacttgttactccctgggatgttactcccatcccaggtccagcttgtcccattatcctatctactcaggctgcactgccctgctttcttaacaagtcaaagactttctagcatgaagcaggaaaaggatataccaaaataactgaagtacatggtagttcaaatgaacagaacggagaagttagttaaaatattatccatgaaggctatcttcttttagccctttaaattcctcttccaaggttcctaaccctaacttcccatccataccctcctgaaagattgtttgcagggctgaagcaaaaattccaatacctagcatgtcagttctatgtatgattactataccttttctatgtttacatagaaagaaataaagggagaataatatacctaaatgattaagcatatgctgataccctatgcaacaggataagatctgctgaagtagctataacaagcaggttatcatatttcaaggaaccccctatattacagcaatagttaaatggtaacgtttttcaatagtttttgcagataaagattacgtttgaataagttttcttttatagtatttactgtaggtttgggtagcacagagtaaaaacctgaagaccgtgggactgtctatacaatctttactgagaactgaaaatttgaacatccgcgctaccaccactgaaggaacagaagagaagaagcataaaaaagtagaaaatggaaacatagcctgcacttagttttaacaaggattatttaggtaattgataagggaagccccagagtttttgttttgactgtctttttctcctctctcttccttattgtgttttaagatgtgcttactctctatggacttacagagggatttttatttagtcaaagattaaaacaaaaacaggtttgtatttgcaatcgaaagagaagcagaagctgcccaagtacagtcatgcgccacagaatgtttcagtcaataacgaaccacatagtcagaggtggctccataagattactgtaccttttctatgtttacatacatatgtacttaccattgtgttacaactgcctacagtattcagtacagtacagtaacacactgtacaggttttgtagcctgggagcaataggtatgcagtaggctaaaccatttaggtttatgtaagtacattctacgatgtttacacaatgatgaatcgtttaatgatagatttcacagagggtatgaccatgagatgatatatgactatattccattgaataccagaaggtaactggattctaacaggaattttaaattagttctatattttccaaattttaagaagttataaagagttgatcagcaaaaccaaaatatttattaatcagatcctattatacgttcccaggatgaatggttccattctgctataccagaattttgttctatgaactataaattaaaataatgggtcaaatactgacttagcaatcttgagatttttgatgtagttgtattgtgatatttgttgtaatggagaatgactagtagttctagtttttaagacattggttggcctatcttatcttttttcactaaattggaaaatccctaaaggtctagctttcagatggaacccaagctctctgcttagtagtgctgttaagttcaaacacaggactaattacagggactattctctttgctttgttccacttatggcacaaactgcatcctgacctctcgccatcgacctaatgattatatgctgctacaacagaataaagtgcagatgcaaatccaccacaaaatgaggaaaaaattaaagcctctactttctggatgctgtaacacaagtgccaactttaggcaaaaaggtcagcacgtatgtttcagactccttactgcaggtgcttcagggtttgctccactaatgcctaggtgactaacaaattttcagtcacatttagcagatattaatggcacataaaaagaacaaaagggacagactggatattacaatatagggtagtttgtgtggctggccacattgagtcctacatacctctccagcaccactcacccggagaagtggatatggatgccagctactgttttttctcccttcccaaacagatacagcttggcctacagctgcactgccccataacaaggagacttcacttgacacctaactcctgacaggactctgcatccttacatcagtaacagaagctggctggggatgaaaaattgttaactgcaacttctgaaaaccttttcagaaataaactcttcctctattccaaatctcaaggtcttcaactagcctaccgtagagcttgaggggtgttaaagttagcttgaggctcagccacacgctcctcctcttctgggccatcatcttccatgttggagaatcccatctcatcttggaactgtgggcaaaggaaagggagggttttcctggggaatgggcttttgaatgttgctccagtgttgggaaggaaaagtgaaaactataaacaatactttaataatgctggcacccagaaagagcctacatcagaacctttctcacttcaggactcctacaaacccacatatggaatgactattatgccaggaaagaagttgctcaaccagtcaacttgtatcagtaagcacagagctaggataactcaaaatgatcaatttcttaaacagaaatatctttttagacaaatttatggaaaaggtaattatttgtgtgcaa

SEQ ID NO: 705 - DNA, 29215 bp, Homo sapiens
tcaatgaaacaatgaagcaataaaagcacagatttattgaagcaaaagtatattccacagagtgggagcaggctaaagcaagctgctcaagagccccagttgcaaaatctggggtttaagtaccctttaggggtttcctattggttacaccctatgcgccaccaatcggaggccgaagtgaaggctcccagtctccagactcttattctcctagctcaaagaaatccactgatttcctctgtagcatcttcaggttccatcttgacaacttcctctaaatccccaggggaagagttgtttagagactcctggatgccctgagggagcggctccagagcttgccttccctcctctgttttcacaacggtccagcgataggcactgttctctgacaatccttcttggcactgtttatcgactggtggaggccctgggctatgttccactttggggaaaacagtagcagagagaggagatagttcctggggctctaatttgggttctaggccctgaaaggcattttccccatcagccacagcacaagcaatgtccacattcatgtgggccttatcttcaggggtggatggtataggaagattcacagaattgccagaaacaattaagggtgagacagaggaggccacaaggggctggttcaatggacaggggaaggaagtagggttaaccaagagggtggcgatgggaatagtctggggactctgggccacagccgcattgacaggctggatcatgttacagccaccgccaaggctcacaatcttcacagtggtagcaggaacagtgaagataacagatgcagggtggataacaggggcaggtttgatacagcgaaaggccctggctccccttctttttgagggtctccgtctcacatatggctttcgaaacatggaagaggcaggggagggcatcattaccttgggcacaggggcagaagagagcaaagtctgggactcagacagagggaagcttgtcctggcctcagggggcatagcaggcagtgctgcaggagactcaaaactctcacctccactgacccccagtggagggacacctggaactgtctgtaaaacagtggctggctgtattgggtgaggaatccggagcaccattttgctcggaggggcttctgaatgagttgattgggctggtgttttcccagggttgaagctgggctggagagaggggctgggttggataaggaggggtttcaggactgatgaacgcttctgtctccaagccttcttggggaaacggtcggcaactggcttcagtttcaggactacacccttaggcaatagcagtgggtaccgagtttcactccccaactctgagttgtctttttctaggccttgatctgagttgatctcagtggttccagtcatatttcctacctctctagcaccatcagccatgtgccgcagttcttcctggatggatggcagactggcctattggaaatgagaacactctgatccagcacatgtcagaatttgggaaaaagaataggactttctaagtttagggacctgagacaagctcaaggcatctttccaagggactctgcatatgaaatttctacaaagaccacagtccaattatacactttagaaactcttctctgaatttcctttagcaaattaccattttacccattattttgaaaatgttgtagaatcacccggagaagggcagaaaagtaagggaagaaaggtgaatcaggaagattcctgaagtcctagttctacaactaaagcattagacgattaaggaagtccttgatattctctcagaactttcagtgaccttctgcctcctacagacttcgaggaagagggctgtacctttaaccagaatgggagccggtgttcttctctctctataggtggcttccactgatgtggctggatctcttcacagcattttcctaggactggcagctgtttggtcttcttataaaacttaacatgaaaaaaatgcgcatgaattacattccttctggaaacactgtcttctgtcaggctggtgaatggggtggtggtggatcaagagaaacacacacacacacacacacacacacacacacacaagaccacatacacaaacatccatgaacacacatatacgaatagcatatgctgaatacttgtacatttcaaattaaactaatctctatttaaagattttatagttattcagtattttctttttgagacggagtcttgctctgtcgcccaggatggagtgcaatggcgcgatctccgctcactgcaagctccacctcccaggttcacgccattctcctgcctcagcctccggagtagctgggactacaggtgcccgccaccacacccggctgatttttttgtatttttagtagagacagggtttcactgtgttagccaggatggtctcgatctcctgacctcgtgatccacccgcctcggcctcccaaagtgctaggattacaggcgtcagccaccgcgcccagccctattcaatattttctaactgatgatctccattctggttgccaggaaggggagagtttaggtcacagagagaaaaggaagcagatgctaagagcaatcttatgtaagatttgttcctgctcaacagctgcaaagacagcatcgtaatctataaaatggacacatcaaagactttaagcaaatgatggtgtgaagggcatcagaagggaaggaaaaaaaaaaagaccgaggcagttcagttttaagagtaaataggctggccttggtggctcacatctgtaaacccagcactttgtgaggctgaggcgggcagatcacttgagattgagagtttgagaccagcctggccaacatggtgaaactccatctctactaaaaatacaaaaattagctgggtgtggtggtgggtgcctgtaatcccagttacttgggaggctggggcaaaagaatcgcttgaacctggcagtgggggtggtagggtggagattgcagtgagccaagatcatgccactgcactccagcgttggtaacagggtgagactccatctcaaaaaaaaaaaaagaagataagaactgaacttaaaccatgacaataagcatctgttcatccaacatgatgaacataagatgttttctatatcctaggcactgtgctaaaagctaagcacacacataagggaagcaattcctgctctcatggagcttacagactagtgggagagtcaagtggacaaatggcatcctacattaaaaaatgtacaaagggctgggcatggtggctcatgcctgtaatgccagcactttgggagaacgaggaggatggatcactggaggtcaggagttcatgaccagcctggccaacatggcgaaaccctgtctctaataaagtacaaaaaaaaattagctgggtgtggtggtgcacgcctgtgatcctagctacttggcaggctgaggcaggagaatcacttgaactgaggaattaagaggttgcagtgagccaagactgcaccactgcactccagcctgggcaacagagcaagactccaaccccgacaccccgccccatcccccaacaaaagtacaaaggtgtgcacgaaaaatgacacaaaactaaaacttaaacacaaattacttctggccaggcgtggtggcttatgcctgtaatcccagcactttgggaggccgaggcaggcagatcacaaggtcaggagatcaagaccatcctggccaacatggtgaaaccccatctctactaaaaatacaaaaattagctaagtgtggtggcgcgtgcctgtaatctcagctactcgggaggctgaggcacgagaatcacttgaacccaggaggtggagagtgcagtgggccgacatcacgccactgcactccagcctggcaacagagtgagactccatctcaaaaaaaaaaaaaaaaattatttctgcagaagaataaggtttatcacgtgtgccttaaaaccatggatacgccaggcatggtggcccacacctgtaatcccagcactctgggaggctgaggtgggtgggtcacgaggtcaggagtttgagaccagcctgaccaacaaggtgaaaccccgtctctactaaaaatacaaaaattagcagggtgtggtggtgagcgcctgtagtcccagctcctcgggacgctgaaacaggacaattgcttgaacctgggaggcagaggttccagtgagccaagatcacgccattgcactccagcctgggcaatggagcgagactctgtctcaaaacaaacaaacaaacaaaaacaaaaagaaagtactttttaaaaaaccatggataaaaatagacaaatactaaggcatattatcatgcattttcaaaatattgaagccaaaggaaaaatcctgcatgctgtcagaggttgagaaaaacaggtgttacacaaagactcaagagttaaatggggccatggctcatgcctataatcccattactttgggaggccaagacaggacgagcacttgaggccaggagtttgagaccagcctggccaacataacgagaccatgtcttaaaaaaaaaaaaaaaaaaaattagctgggcatagtggtgcacaccgggttggagacaccagtgagccatgatttagccacgctccaaactgggcaacagggtgggaccctgtctcggaaaaaaaaaaaaaaagttaaatggcatgaaatttcttaacaccacactaggagttagaagaaaatgaagtgaggcccttaaaagcttcttaaaaaaattatttcctatctagaattctagatacagtgacagaggagagtattattttttccttttattttgaaataattatattcataggaaattgcaaaaaatagtaccaagaggtcccatgtacccttcaaccagtttctcccaatataatgtttttatgttacatagaaacaagagctatacatataaacaaggtacacagtacaatattactaccaggaaactggccagacatggaggatgtggtggctcatgcctgtaatcccagcactatgggaggccaaggtgggcagatcacttgaggtcaggggttcgagatcacctggccaacatggcaaaaccccatctctactaaaaatacaaaaattagctgggtgtggtggctaatcccagctactcaggaggctgaggcaggagaatcgcttgaacccaggaggcagaggctgcagtgagcaacagtgagactctgtctcaaaaaaagaaaaaaaataaaacaaaaacaaaaacgaggaaactgacatcgatacaatcaaaagaccatgaatggagatttttttttttttttttttaatacggagtctcgctctgtcacccaggctggagtgtagtggcgagatctcggctcactgcaagctccacctcccaggttcacgccattctcctgcctcagcctccagagtacctgggactacagacgcccgccaccacacccggctaatttttttgtacttttagtagagacggggtttcaccacattagccaggatggtctcgatttcccgacctcgtgatccacccgcctcagcctcccaaagtgctgggattacaggcgtgagccactgcgcccggccccggagatggtttaaatgtgaaaattcccttcccaagcactctccctcaggatgctactggaatggggccatgcagggtggctcatgcctataatctcagcactttgggatgctgaagcaggaggatcacttgaacccaggagtctgagaccagcctgggcaaaaaactgagacccccccacctcaattttttaaaattcagaaaaaaattttttttaaaaaaaagctactagaatgtgttccactaaagtaaagaagtaatactcacgcctgtaatcccagcactttgggagaccgaaacgggtggatcaagaggtcaggagatcaaaaccatcctggctaacatggtgaaaccctgtctctactaaaaatacaaaaaattagccaggcgtagtggcatgtgcctataatcccagctactcgggaggctgaggcaggagaattgcttgaacccgggaggcggacgttgcagtgagccaagatcatcgcgcctttggactccagcctgggcaacaaagcgagactcggtctcaaaaaaaagcaaaacaaaacaaaaaacaaggccaggcgtggtgtctcacgcctgtaatccccgcactctgggaggctgaggtgggtggatcccctgaggtcaggagttcaagaccaagaccaaggttgcaggttgcagtgagccgagatccagcctgggggacagagcaagactctgtgtctcaaaaaaaaaaaaaaaaaaaaaaaaagtaatgcaaaagcaaagatgtggaattcaggaaataagaggatctaacacagtatgaggcaaaaggaattcctgggatgatggtgaagaaaaagcccaagaagacatcagtgcagcaacatggagagcaacacgcttaaagtggaataatgtcagagggctcagggagcaatttcttcaagatgaaagtgacagaatatctagaatacctgaacacactgaaagaagatgatctgggaaacaaaatgttcagcaggaaaggcaaggtaacacagtaacatagctgagctgtgaagagcatttatacagtccttaaaatctattttttttttttgagacggagtcttgctctggcaagactggagtgcagtggcgcgatctcggctcactgcaagctccacctcccgggttcacaccattctcctgcctcagcctcccgagtagctgggactacaggcgcccgccaccacgcccagccagttttttgtatttttagtagagctggggtttcaccatgttagccaggatggtctcgatttcctgacctcgttatccacctgccttggcctcccaaagtgctgggattacaggcgtgagccaccgcgcccagccaacagtccttaaaatcttacaatgtaaaccctgaatacaatctaaccaaaattctaccataactactagtgaggagtttggagagcagaaaatgtgcatgtttgtggtgggagtaagggagtgaggagagaggtaaatcttcggcttccgtggtttatggttaataagtaaggcctaaatccaatacaccaggcagtaccaattagaggctgagacaggagaattgcctaaggccaaaaattgaagaccagcctgggcaatatagggacaccccatccctaaaaaaaaaaagttttttgccaggcacagaggctcacgcctataattccagcactttgggaggccgaggtgggcagatcacctgagatcaggagttcaagatcagactgaccaacatggtgaaattatgtttctactaaaaatataaaaattagccaggtgtggtggcgcatgcctgtagtcccagctacttaggaggctaaggcatgaaaattgcttgaacccggtaggtggaggttgcagtgagctaaaattgtgccactgcactccagcctgggtgacagagacagattctgtctcaaaaaaataaaataaaataaataaataaataaatttaatggccaagcacagtggctaatgcatataatcccagctccttgggaggctgacgttggaagaatgcttgagcctaggagttcaaggctgcagtgagctatgactataccactgtactccagcctaggcaggagagtaagaccttgtctcaagaaaaatacaaaaacacaatgaaaccaaaggctgggcatcatggctcacgcctgtaatcccaacactctgggaggccgagctgaggcaagaggactgcttgaggtcaggacttcaagaccagcctgggaaacaaaatgacaccctgtcttcacacaaaataaaataatcggctagccttggtggcatgcacctgtagtccaagctacttggaaggctgaagtggaaggatcacccaggaatttgaggttgcagtgacctatgattgtgcccatgcactccagccaggatgacagagtgagaacctgtctctaaaaaaaaaaaaaaacataaataaatatctaaataaaaaagaaggctgggggcaatggctcacatttgtaatcccagcacttagggaggccgaggcagatggatcacctgaggtcaggagttcgagaccagcctggccaacatggtgaaaccccgactctactaaatacaaaaatcagctgggcatggtggcaggggcctgtaatcccagctacaagggaggctgaggcaggagaatcacttgaacccaggaggcagaggttgcagtcagccaagatcgcaccattgcactccagcctgggggtcaagagcgagactccatctcaatcaatcaatcaataagtaaaaagagttgagaaaaagtatataggctgggcctgggcgacaagagcgaaactccatctcaatacatacatacatacatacatacatacatacagacacagacacacacaaacacacacacacacacacacacacatacatgcatacatacaaacacaaaattgagaaaaagtatataggctgggcacggtggcttatgcctgcaatcctagcctctgggaagccaaaactggtggatcacttgaggtcagaagttcaagaccagcctggccaacatggtgaaacccgtatctactaaaaatacaaaaaattagctgagcgtggtgggcacgcctgtaatctcagctatttgggaggctgaggcaggagaatcacttgaacccgggaggcggaagctgcagtgagccaagatcatgccactatactcctgcactccagcctgggtgacagtgcaagattatgtctgaccaaaaaaacaaaacaaaacaaaaacccaaagcatgtaagtggaatactgcatatcatttctagaaagttcaagaaagagaattattacagggaaacatggatttgtggaatcttttaagaggatgaagatactccagaggaacgtaatgaatgaatcaatgtccctgaaaaggcaacaggggaattaatctagtatataagtaggagaaattagctttagataaaagaaggttcttcttttctttgagaataacaagagaaaagaacagatatgtgttggtgaggtgcctggatagtgcatgcaggaaacactcactttaatgatgttgtcaggagctctgttcatgttgaggttcttgattctcactgtcagttggcgggcagtcttgcaggttagaaggtacttgctgattagagggttaagaaactcagtcccttcaaaatgcttcagtcctaaagctaacaaactgagaaaggagcaataacactaaatctcacttcacagtccttccttctaaagggcctccccagactaacacattttacaatctactttttcttacttgttcttaaaacaaggtctcactctgtcacctgggctggagtgcagtggcgtgatcgcagcccactgcagctgctacttcctaagctgaagcgattctccagtctcagcctcccaaagtgctgagattacaggcatgagcccatggcgtgtggcccaatctactttttcatttttttcagacagggttttgctctgttgtccaggctggagagcagtggcatgattacagtgcactgcagtcttgaatgcctgggttcaatcgattcccgcacttcagcctcctgagtatctgtggctataaacgtttgctaccatgcctaactaatgttttatttcattatttgtagagaccagttctcactttgttgcctaggctgatcttgaacttctggcctcaagtgatcctcctgcctcggcctcccaaagtgtcgtcattacaggtgtgagccaccatggctggccaatctactttttctacaactaattcttgtagtgactactacaagttggtgactactcagtagaaaatttcaggtatttagtgagtagtgattaagtactatgaataagaatcaaatagttcacaattaagtaggagcaagagaaactagtcataaatcatcaataaatgtcagatcatgatgagctgtatattaacaacacaaaggaagttcaaagagaatacatgggaaggagaatgattctaataaaacaaatataaaatgaataataggtaccccgtcagacaaattaaactggcaccaatactaccctctaacataacatatataatcatggttacatatatacatatttgctgttaacagtgtggcaatacacacaaagggccataaaaatgttcataatctagctgggtgtggtggcttatgcctatagtcccagcactttgggaggccaggagtgggaggatcatttgaggtcaggaattcaagagcagcctgggcaacacagagataccctcacctgtacaaaaaaaatcagccatgtatggtggcacacgcttgtggtcccagctactccatggaggctgaggcaggaggatcacttgatcccaggagttcaaggctgcagtgagctgtgattgcaacactgtactccagcctgggtgacagagtaagatcctgtctctaaataaataataacattagaaaagccaacctcctgccttggcctttcaaagtgctgggattacaggtgggagccgccatgtccagtctaaaacattttaaaaatgtgtgtaacatccccccaaaaagcagtatttggcactgctagaacaagcacgttctagaggactctgctcatctatactgcttttccttttgtgtccatgtcttattatacaagtcttacttcccctaaactcctcaaaggaactacatcttctccttgggatatttgatcccccagagtaaacacttacttgtcctcagccttggtgaagaggatcttatcctggggattctttgccttcagggaacacactggaagtaactctggatacatgaaaaccttgcttgtggccaggatccaagccacttgctttggcaaacagggaaattcattggctataagaaaataaatctctgataaatcaacttctaggaaaaaagagggcttcaaaaagcctgtgaatgcatttttgcatttaggtagagctgtccttatctaacttgattccctcccatctgcctaccactccccaaagagtttccacagtctttcctcaactaacattaggtctaaagggagtcccattcactggcaataaaagttgactttttttttttttttttttagacggagtctggctctgtcgcccagactggagtgcgtggcgcaatcttggctcactgcaagctccgcctcccgggttcaggccattctcctgcctcagcctcctgagtagctgggactacaggcgcctgccaccacgcctggctgattttttgtatttttagtagagacggggtttcactgtagacaggatggtcttgatctcctgaccttgtcatccgacagcctcggcctcctaaagtgttggattacaggcgtaagccacggcgcccggcctctcttactctttcttacgtgtaacactttattcacaaagtaaaacaaacacttaaaaagtacctagtaatacctgtcacatagtgtatgctcaaaaatgttttacctcctttcccctttaaatctctgaaggataacagaccttcaacaatgcttttttcttccaggataagattccaggccaggcgtgctggctcacgcctgtaatcccagcactttgggaggccgaggcaggtggatcacctgaggtcaggagttcaagaccagcctggccaacatagtgaaaccccatctctaccaaaaatgtaaaaattagccaggcatggtggcacgcacctgtaattccagctacttgggaggctgaggcaggagaattgtttgaacctgggaggcggaggttgcagtgagccgagatcaccccactgcactccagcctaggtgacagagcgagactccatcttaaaaaaaaaaaaaagaaaaaagattccaacttctttaatctccctcacaaacctggtattccaaattttacttttatttcattctttcttaactttcattaagttctcccagattcctcctgaggttgggaacaaaagaaccataaaaggaatgagacaattcagtctcattcatttctgtctccctctctcagcctctcaattttaggcacctctgcatttctagagacaaaactactatatccatatttctccttccataagtgtcatttttatatctccagaagaaaaacacaggacactagatgtgtaagataatactataatttggtattaaatcacgttttcattaccatttcatataatatagctattaaagtagtttgggatctgtgtctatgatatagtacacttaaattcaactacattcaatgtaatgataagacttagggatttaaaatagaatccaaagacaaacccaaatccagaacaaaccacaactaatttgctaagtcagcaaacaaatcagaagtaaatatttggcttaagtaaatagcaaatattttctcaaaaaatactaaaccaatgcaaggtagaatctaaaccggcaaatttctttaaaatactgaacacggcaaatgtacaatctctaatttacgcctaacttgcaagtcaacatttcattcagaatggagatatcacctatgctacaatcattatggtaaataaagttagttgatcttaatgaagagaataaaaagctaaacatgaccgaactttaccacctgactttcatctttaccaggccccagtttatcttgatctgattcctaatacttacccctcatattgctgtagtccaattcttagcactgagcctcagatctctacctcccatattcctatactgtccactgcctccatgccttacccaggcccggagattatcatgtaattctagaacttggataatgagtacaaagggaggataaaagagagaaggaagaaattacaaatgtcctgtgtcctccattcctaggcaagtatcctaggaagttatctatgggataagattcccaccacctctcaccgcaagtaaaaacttaaagctgacacatctgtctcctaccagtcttcttgacagttttatgagggctgcagtcaatgctgacatgtgtgctgaagtcttcaatcagctgcatagctcccatcaagttacagggttggaacagggtctgaaacttggggttgtactgatggtgaagggcgatggagctttgagcaaaggttcccagctctttctgggaaaacacgacacaaggaagatctaagacaattccagacaattaataccaatagccttcagaatctaaatgagaagctgaccttcctactacaggataaaaacaggtaaaaataatcataaagtctttcacaataaactactgttaagattatgcctgagttctcagatattcagggattatattcttgttttatttttaaactgtttctcactaaggaatacatggtctagctcccgagctagaattaagagtctcaagaatggggactattactttaatttaattaattaatttattttgagacatggtctcactctgccgctcaggctggactgcagtggcatgatctcagctcactgcaaactccccctcccaggctcaagccatcctcccactgcctcctgagaagctgggactataggcatacacctccaaacctagctgatttttgtattttttgcagagacagcgttttcccatcttggccaggctgatctcgaactcctgggctcacaatccgcctgcctcggcctctcatagtgctgggattacagggatgagtcacctcacccgaccaggaccattacttttaaaattgttttgtcttttggtctcagaataatgcctacaaccaagtactcctcatcctcctctgaatacagtaagagatgaagacatcctgttgatcaccaaggaagttttagaatactagcaaatgtactcttcaaaatccaaagaagacttactgaagaagctgagagtattatcattacctgtccaaaagtttgaggcaatttttatgaggtaaagtatggttttgtttttgtgagacaggttctcactctgtcacccaggctggagtgatatataagcacggctccctacagtctcaacgtcccaggctcaagtgatcctcctacctcagtctcccaagttgctgggactacaggcactcggcaccatccccagctaatttttttattttttatttttttggtagggatggggtcttactatgttgcccaggctggtctcaaactcctgggctcaagcaatcctcccaccttgacctaccaaagtgctgggactacaggcatgagccaccatacctggccaaatttcaaatttaaaatctcaaaataggccgggcgcggtggctcacgcctgtaatcccagcactttgggaggccgaggtgggcggatcacgaggtcaggagatcgagaccatcccggctaaaacggtgaaaccccgtctctactaaaaatacaaaaaattagccgggcatagtggcgggtgcctgtagtcccagctacttgggaggctgaggcaagagaatggcgtgaacccgggaggcggagcttgcagtgagccgagatcccgccactgcactccagcctgggcgacagagcgagactccgtctcaaaaaaaaaaaaaaaaaaaaaaaaagctcaaaatacctcaaaacgtcatgagcaaaactagctctacacataaaacactaatattgagcttcatgaatggataatgaattcaacatctacatgtatatttacttcattatttaaattaaaacaaaacaaaacaaaaaaaacacagaccgggtcttactatgttgcccaggctgttcttgaccactgggctcaagtgatcctatcacctcagcctcccaaagtgctggaattacaggtgtgagccactatgcccagcctcaacatctatgaaatgaatagcggtaccaaaaacctaagaagtcagggtgaatctaaagatgaggaggaggacccaataaaaatatcagaaggacaggccaggcgcagtggctcatggctgtaatcccagtactttgggaggtagaggtgggcagatcacttgaagtcaggaattcgagaccagcctggccaacatggcaaaaccctgtctctactaaaaatacaaaaaaaattacccgtggtggtgcccgcctgtagtcccagctacttgggaggctgaggcaggagaatcacttgaacccgggaggcaggggttgcagtgaactgaaattgttccaccgcactccatcctgggtgaaagagcaagaccctgtctcaaaaaagaaaagaaaaaattgaatacactctttgtcctttcatgtgaatcagtggcttatgttcactcagcaaacataggaagccacagcaatcaaaaatacctgagagaataactgtgagaaataacctgccaagctaattttatattctagtctatagaattacggcaatttggaaacttacaagacatatcctggtgctactggcctccggattgagattggggttgcaggtggcaagaaggtggatttgtgtcaagagctgaacatgctggggagagaaagaaaataatgcagtgatatgttatgacactgccatttcaggagcccagagatatttttttttccccctggagacagggtcttgctctgtcacacagcttggagtgcagtggtgcaaccatgactcaatgccctctcaaccacctgtgctcaagcaatcttcccacctcagcctcccaagtagctgtgaccacaatgcctggctaatttattttattattattattattattatttttagacagagtctcgcactgacttttgggctggagtgcaatggcgtgatctcggctcactgtaacctctgcctcccaggttcaagtgattctcttgcctcaacctcccgagtagctgggattacaggtgcccgccgccacacccagctaattttttgttttcgtagagacggggtttcaccatgttggccaggcttgcctcaaactcctgacctcatgattcacccgccttggcctcccaaagtgctgggattacaggtgtgagccactgtgcccagccttatttttattttttgtagagacagagtctcactatgttgtccaggctgcttttgaactcccctgctcaagcaatcctcccacctcagcctcccaaagtgctgggattacatgtgtgagccactgcacccagccaccagagagtcattaactaagatgtttgcaactttatgacacaaattttgctttctgcaaagagtgtgagaacaacgtaggatcttggcataaatttctcagacatgttcccttgaacaaaatgacagaaccagaggaagtttaacctctaaacagaggaggaactgagattagaaaaggaaaaggccgggcgcagtgactcacgcgtgtaatcccagcactctgggaggccgaggcgggtggatcacgaggttaggagatcgagaccatcctggctaacacagtgaaccctgtctctactaaaaatacaaaaaattagctgggtgtggtggcgagtccctgtagtcacagctactcgggaggctgaggcaggagaatggcgtgaacccgggaggcagagcttgcagtgagctgagattgagccactgcactccagcctgggtgacagagcgagactacgtctcaaaaaaaaaagaaaaaagaaaagggaaaagggaaaaaaaactacttgtcacagtgaaggttaaatttcagaatagattactgaggactctttgaaatctgtaattccgaataccattagggtccttatgtgctgtcttccctgagccacaggacatgaacatgatgacttctcaagctcctaactgatgtgaagatactacggttttaatacgtagtaaggtaactatctctgacatttacaaagctgctaattttagattataccaaagcctcagagttaggccttggtataattcaatattaatatgaccaaggaaagtgttacctgctgcatctgctgctggagtctcttcctttgtgctgggtccagaatcagggtctgatgaacttccttacactggggtttaaccttctctacctccttctgctgtttggctgaaggtttcttcatcttcagctgttcaaatagttccttcgctatctgatgttgttcatttagtaggttggccagtagttcctcaaacctatcccaaacggggatgactgaatttgagtgttttcctaggtccacaacacatccaattctttgcaatgatgagcaaagagcctgaacaattttcattccctactaatccccccttttcactttagccaacagtcaaactcccagccttacacaaatcttttcccaaagtagttagcatgcatcaaatgattctgtattacaccccatcccattcctctacaattcctcttccaaataatatacaaatgaagaaaaaattaaacaaaaaactagggacagagaaatatatgggtaagaaagcagccaaggagctggtgggaactcatcattctcatttcttctctcattacttgttactccctgggatgttactcccatcccaggtccagcttgtcccattatcctatctactcaggctgcactgccctgctttcttaacaagtcaaagactttctagcatgaagcaggaaaaggatataccaaaataactgaagtacatggtagttcaaatgaacagaacggagaagttagttaaaatattatccatgaaggctatcttcttttagccctttaaattcctcttccaaggttcctaaccctaacttcccatccataccctcctgaaagattgtttgcagggctgaagcaaaaattccaatacctagcatgtcagttctatgtatgattactataccttttctatgtttacatagaaagaaataaagggagaataatatacctaaatgattaagcatatgctgataccctatgcaacaggataagatctgctgaagtagctataacaagcaggttatcatatttcaaggaaccccctatattacagcaatagttaaatggtaacgtttttcaatagtttttgcagataaagattacgtttgaataagttttcttttatagtatttactgtaggtttgggtagcacagagtaaaaacctgaagaccgtgggactgtctatacaatctttactgagaactgaaaatttgaacatccgcgctaccaccactgaaggaacagaagagaagaagcataaaaaagtagaaaatggaaacatagcctgcacttagttttaacaaggattatttaggtaattgataagggaagccccagagtttttgttttgactgtctttttctcctctctcttccttattgtgttttaagatgtgcttactctctatggacttacagagggatttttatttagtcaaagattaaaacaaaaacaggtttgtatttgcaatcgaaagagaagcagaagctgcccaagtacagtcatgcgccacagaatgtttcagtcaataacgaaccacatagtcagaggtggctccataagattactgtaccttttctatgtttacatacatatgtacttaccattgtgttacaactgcctacagtattcagtacagtacagtaacacactgtacaggttttgtagcctgggagcaataggtatgcagtaggctaaaccatttaggtttatgtaagtacattctacgatgtttacacaatgatgaatcgtttaatgatagatttcacagagggtatgaccatgagatgatatatgactatattccattgaataccagaaggtaactggattctaacaggaattttaaattagttctatattttccaaattttaagaagttataaagagttgatcagcaaaaccaaaatatttattaatcagatcctattatacgttcccaggatgaatggttccattctgctataccagaattttgttctatgaactataaattaaaataatgggtcaaatactgacttagcaatcttgagatttttgatgtagttgtattgtgatatttgttgtaatggagaatgactagtagttctagtttttaagacattggttggcctatcttatcttttttcactaaattggaaaatccctaaaggtctagctttcagatggaacccaagctctctgcttagtagtgctgttaagttcaaacacaggactaattacagggactattctctttgctttgttccacttatggcacaaactgcatcctgacctctcgccatcgacctaatgattatatgctgctacaacagaataaagtgcagatgcaaatccaccacaaaatgaggaaaaaattaaagcctctactttctggatgctgtaacacaagtgccaactttaggcaaaaaggtcagcacgtatgtttcagactccttactgcaggtgcttcagggtttgctccactaatgcctaggtgactaacaaattttcagtcacatttagcagatattaatggcacataaaaagaacaaaagggacagactggatattacaatatagggtagtttgtgtggctggccacattgagtcctacatacctctccagcaccactcacccggagaagtggatatggatgccagctactgttttttctcccttcccaaacagatacagcttggcctacagctgcactgccccataacaaggagacttcacttgacacctaactcctgacaggactctgcatccttacatcagtaacagaagctggctggggatgaaaaattgttaactgcaacttctgaaaaccttttcagaaataaactcttcctctattccaaatctcaaggtcttcaactagcctaccgtagagcttgaggggtgttaaagttagcttgaggctcagccacacgctcctcctcttctgggccatcatcttccatgttggagaatcccatctcatcttggaactgtgggcaaaggaaagggagggttttcctggggaatgggcttttgaatgttgctccagtgttgggaaggaaaagtgaaaactataaacaatactttaataatgctggcacccagaaagagcctacatcagaacctttctcacttcaggactcctacaaacccacatatggaatgactattatgccaggaaagaagttgctcaaccagtcaacttgtatcagtaagcacagagctaggataactcaaaatgatcaatttcttaaacagaaatatctttttagacaaatttatggaaaaggtaattatttgtgtgcaaaatactttaaaactagttggcaatctttaaggacacaccaaatgacagtaggggaagccatcaaaagttttcaaggggcaagatgtgctggctcacacctgtaattccagcactttgggaggttgaggcaggaagattacttgagcctatgagttccagaacatggcaagaccctgtctctacaaaaaaataaaataattagccgggcctgtaggtgtgtgcctgtagtcccagctactcaggaggcttagatgagagaattgttttgagccctggaggtcgaggctgctgtgagctgagatttcaccactgtattctccagagcctgggtgacagagcaagactttgcctcaaaaaaaaaaaaaaaaagcttcaaggaaaattttagtaagaataacctacatgtggataatcaagagtctagcagttagcaaatttcttttgtcattatattctttcccaggtagactaaaaggagaattggttcagtccctcttctagaaggagcatcacagagatcaaaggacacattttgttggagaaccaacttacaatcccatgttctcacttgaggatcattactcacagtttcaaacagatcttccatcagctcatttgcttccttttctgcaaaaaagccaaacgttgttggtataaattagattcattttacaatatggaggaattccatgtagacaatgtatgatgttttcaacaaggcatctgacgaattcttcatatctatccttattcctgagacagggtctcactctgtcacccgggctggagggcagtggcttgatctcggctcactgcaatctctgcttcccaggctcaagcgatcctcccacttcagccctccaagtagctggggcaacaggagtgtgctgtcatgcccggctaattcttccatattttgtagagatgggttttccccatgttgcccaagctggtcttgaactcctgagctccagtgatccacccaccttggcttcccaaagtgctggggttacaggcatgagccaccacgcccagctatccttcattcatttattcaaaaacatttattgagtacttactatgtttcaatccctgttttagatgcttgggatatatgagagaatgagagagagagagagttctaatctcattgaacttaaattctaataggaagaagacaaggagaaaatgtgagctagatgatttttttttttttttgagacggagtttcgctcttgttgcccaggctggagtgcgatgacacgattttggctcactgcaacctccgcctcccaggttcaagctattctcctgcctcagcctcccaagtagctgggattacaggcatgcaccaccacgcccagctaattttgtgtttttagtagagatggggtttctccatattggtcaggctggtctcaaactcctgacctcaggtgatccgcccacctcagcctcccaaagtgctgggattacaggcatgagccaccatgaccagcccaatgattttataattagatggcctatccaaacccacacaatactgaatggaatcaagagacaagtctcccaacctgggcaaaatgtcaacatatctctaaaaaaaaatttatctgggcttggtcgcacatgcatatagtcccatatacttgagaggctgaggtgagagaatctctttgagtccaagaagcagaggctgtagtgagctgagaccgtcccactgcattccagcctgaacgacagagcaagacactgtctccaaaaaaaaaagagacagacagagacaagtttccaacagtgtttcataggactctatctttggacccgacctattcaaaaactccatcagtgaattagaagaccaagagaacatacttaacaaatctgtagatgatgtaaagctgtaaagctgaaagggactgccaatccaattgatggaaaattcagaatcatattttctcaaatcaactggatgtaacacgtaaggataaatttaaagttctacattgaggatttttttttttttttttttttaaatagagccagggacttgctatgttgcccaggctggtcttgaactcctgggctccagcgatcctcccacctcatcctcccaaagtgctgggattacagacatgagccaccccacctggcaagatcttatatgtgtattcaagatattacacaactcactaagtctccagatgaaaaccagaatctctaaatatagtttgacagtttgacaatgcccaatgacagactaaatgagaaattaggaggcagcttgatttttttttatttcctcagagatctttgttctgagttctgactcttgttctacaaatattcaaagtcgaaatgattatcatgttaatgggtaaagagcttcaaatctttggctatctcatttttttttaatttttattcatttgttttaccttatgtgttcctctacaatggttatctaggaagttaacaaccattctagctatctagcattctggttcttgatatcatgtaaaatgagcgttctgatctctgacacacaaagctatttagaagataaaaaatagacatttttttcaacaatcattttacttttttctctacatctacatactctacatgtcagagtttttgtttctgttttttcgagagtagctgggattacaggcacctgccacaacacctggataattttttgtatttttagtagagatggggtttcatcatgttggccaggttggtctccaactcctgacctcaggtgatccacctgcctcagcctcccaaagtgcagggattacaggcatgagccactgcacccagccaagtactttgattcttaatggaggatttaatccactgacatcccaaaggacaaactatccaatggaattcctggataaaacacaggcacacagtgtctcttcctcagaggaaagaaatttttgtcaacagaagaattttgctcttctgggcgtggtggctcctgcctgtaatcctagcactttgggaggctgagcctggaggatcacctgaggtcaggagttcgagaccagcctggccaacctggtgaaaccctgtctctactaaaaatacaaaaattagcctagcgtggtggctaatgcctgtaatcccagctacttgggaggctgaggcaggagaatcgcttgaacccgggagtcggaggttgcagtgagccgagattgcgccattgcactccagcctgggcgacaagagcgaaactccatctcaaaaaaaaaacaaaaaacaaaattgatttgctctagcagaaaaataattatatttcaggaattccttcaggaatcctataccagtactaaaagatcctatattggaaaatgaaaatgcccaaattaataagtcctgagatagaggagaagggatcttgttttgtccatcactgtatcttagtacctggaatagtgcttggcacataataagcattaaatacatacatggcagtcttgtttctgaaccaaaatgaggtggtttaatgaaagagatgggtttggctaggcgtggtggctcacacctgtaatcccagcactttgggaggctgaggcaggtggatcacttgaggtcaggagtatgagaacagcttggctactggctaacatggtgaaaccctgtctctactaacaatacaaaaattagccaggtgtagtggtgcgtgcctgtaaacccagctgctcaggacattgaggcaggagaatcacttgaatccgggtggcagaggctacagtgagtcaaaatcctgccactgcattccaaactgggctacagagcaagactccatctcaaaaaaaacaaaacaaaacaaaaaaaacaacaacaagtgaaatactgaaatactgatcagctttaaaaagagaactgtcataaccaccccaatttagttccaagacttaggcttccccaccaaggcaaaattaacacagtaagaaggctattccagttcattttggagaaaatcttggatttggtaagcaggtaaaaagagctgggcatgctggctcacatctgtaatcccagcaaactgggaggccaagacaggaggatggcttgaggccaggagttcaagaccagattgatctacatagcaagacctgggccaggtgcagtggctcactcctataatcccagcactttggaaggccgagacggctggagaacttgaggttaggagttcgtgaccagcctggccaacgtggggaaaccctgtctcaactaaaaatacaaaaatcagcagggcgtgttggcacgcgcctgtaatcccagctatttgggaagctgaggaaagagaatcacttgaacctgggaggcagaggttgcagtgaggcaagattgtgccattgtactccagcctgggcgaggagagcgaaactctctctcaaaaacaaaaacaaaaacaaaaaaccatagcgagacctaatctcaattaaaaaaataaagaaattgtatacacatacatgcacatatatgcacactacacacacatatcacatgtacgttttgagaaaaataacaccatgaacctactacccgttaaaaattagagaaaatattaaacttttcacaaatttacatagcattcttatacaggggccatgtcaatagaaagaaaggactatcagacaatttttcctaaaacttctccattatctcactgaatcctataatctgtcctattaaaacacctttttacatttcttgcttttttttttttttttgtgagacagagtgttgctctgatgccgaggctagagtgcagtggcatgatttcagctcactgcaacttccccctcccagttcaagcaattcttggttcaagcaattctcgtgcctcagcttcccgagtagctgggactacaggtgcactccaacacatgcagctaattttttgtattttagtagagacggggtttcaccgtgttgcccaggctggtctcgatcttctgagctctgacaatccatccgcctcgtcctcccaaagtgctaggattacaggcgtgagccaccccacctgaccaatttcttgttcttttaaaagtacagtaattatttttaagttccagtaataaattaatgggtagtctgtcaaatagctactggattttatatcaggagggctttctacatgtatgtatacccaaaaatgacattaagacctttttacataaactcactgtagagatacatcccaaaacaaggtaaggaatataaatgatgtttaccttcttttcaaaccaacagttcctttatacaaaaacaccagatgatacaaaacatatttttttaaagtacaaagttccatacagaataaaataaacactttatggttattcctaagaataagtagtgacaaaaagtctttgcaattgggtaataaaatttcagcttctaggaatatgtttccctcttccttgtccttttgagagctgccactatcacacaattcacagcatctcttcaaccacagaaaattagcgtctcttcaagcacagagaccatatattaattatctttgtgtctcctgcataggattaactcagtgtttgttataactaagttaaactccaagacaggagcttcaaatcacctcaggcccaatccaaaactgaaaaaaagacgcttctcagagtttgagaacaaaaagatactgacaaagaacaaagccatagatacttgtgcgacattagcttccctttttaccaaatacagagtcatttactaatactgcagaaatgtttgcagacgataaaaagaataaattaaaaatatggatcctgtcaacatgttcaaatactaacatagactccttcaccttaaactcatactaacatccacacacccgaacaatgaaaatgaaaggttttcaaatgagatctaaatataaattggctctatttcattacagtttaagttcctaaaatcatatatataaatcatgtgattgcgcttatgctcatcttctaacttgagggcccagtgtctttcatccgattctctgaaggataagtgaccccaaaaaacttttaagaaccactaatctagcctatcaagaaacatcccattttccagaagaatacagctaagttggcttagttcatgcattcttacctcatattcatagagttcatagacgggatccttactacatgaaatcagtcttttttttttttttttttttttttttggagatggagtctcctctgtggcccaggctggagtgcagtggcgcaatctcagctcactgcaagctctgcctcccgggttcacgccattctcctgcctcagcctccccgagtagctgggactacaggcgcccgccaccacgcccggctaattttttgtatttttagtagagacggggtttcatcctgttagccaggatagtctcgatctcctgacctcgtgattcgatctcctgacctcgtgatccgcccacctcggcctcccaaagtgctgggattacaggtgtgagccaccgcgccctgccgaaatcagtctttcaaaggattccttcagcccagccaagaagttccaacatccacaggcacatatattaacaattaccagtacccaaaaacagttctctggttttaattccacactgcctccctcaacttaatacctaccaccgtcaaaacaactcccctcagattgcatccaggctatttacagagacaccttgatgatcctcacctcaaggcatggaccattcattgaatggttatatttgttgaatgagtgaaaaaggatccttcctcccacagatttcaagttaagctgtcagcacccatgcagctgctctggtacaagttaagctgtgaaagccttctccctcacgcatacaaccttaagtgtcagaaatgctctgcttcctccataaatccaaaataatatagccatggatatgcatttcatacaggtcagactcggcaaggacagctacgttccacatacatatctgacacaatcggtctcccccaaatacaagccaaccagtcttatgtgctcctatctttccagcatactcagatttgccgacaaagacttcctgaggcaccatggtatgctgaatatactgctgcagtagtagtgaaaatatgggagttacagttccaactttgtcaccaatttaacatgcggccttggagaagttctctccttatgcctaaatttcctattttgtaaaatggaagaaagcatcctaccattttcacagagattcagtatcacaaagaaactgaaagagctttcttattgtattgtaaactattactataaacccgcgacaacaaataaggccacccattctttacagctttgtagcaatgattctgttaaagatattttggcccttcacatttacacaactcactctaaccaaaggcacaaactattcttaagaccacaactggctatgccaagtttctcccctccctgacctcacagacacatgctgtacagaacactaccattgccgctctttcccaacaagtaactaggggctcccaatccctaaaatacacacacatatcaacctgcaaggaacctcccaacatttattcaagaaataagctaacttataaggggaactccattacacttacacaaataaaggcaaactcttacggaaacacttgccatcctcacatacacacaccaacacagccgctacacaccaacagaccatctgtctgctagaccaaaaacatctctttccatgtacaaactaaccagtgacatttattaaacgtacaacactgagatcatcctgtcgttcccacataccgttcaacgcggcagggacaccacagaccttgtcacacaggtaaaatcccctctcaagatcgtgtcctcgaccactcttatcccttaattaaacacacacaaactggactatgggggaggctccgatcatgcctacaaacacaaactaacctgtcaggggcacagccgactccgcctccactcgcttacttcccagccccctccgggagtctgcctgtcagggacaccccttcaccccgcctggagggacttcccggtaggctcaggatccccctccctgctctcccctcccccatcttcaccactgctctcccagaggtccaggtccgggagatgacagtggctcccagaaagcccaggattcaatcgctgagagagtgcttaggcccgaatgccggcccaaatcgttctactcaccgtgtcggaggccgagagcgatgagagtacagggaagtgaggaagagggggtggccgccaggctcctccgcttccctgggtccaccgcggatccctcccgcttgtcaggaggcggccagcgggtaagccgactggcggaaatgcgagagaggagaagggaaaggtggagggctaaaggggcaaactgagaggaggcggatcccgcaaccgacactgggatcgtttcccctcgcaaagcgaacccaaaatggcggcggcagcggcggcagcagagtggccgcggcagctcctccagagggagggagctaagggcgcctagcgacacccccaacctcccactcctccctcctcgcgttcttccccacggtcccccgcttcgcccgactccggccatgtagcgcgcacgtcagcccgcacgcgtacgagtgtctacgggctcgtcgctggctgctcccaccaaccaccaccttcggccgtcctgcgagccagccatcccgtacgcgctcacccacgggaacctcctcgcccagttctccactccccctcagaccctgtcaagccggctccagcgcaggccctcacgcgt

SEQ ID NO: 706 - DNA, 29215 bp, Homo sapiens; identical to SEQ ID NO: 705

SEQ ID NO: 707 - DNA, 29283 bp, Homo sapiens
tcaatgaaacaatgaagcaataaaagcacagatttattgaagcaaaagtatattccacagagtgggagcaggctaaagcaagctgctcaagagccccagttgcaaaatctggggtttaagtaccctttaggggtttcctattggttacaccctatgcgccaccaatcggaggccgaagtgaaggctcccagtctccagactcttattctcctagctcaaagaaatccactgatttcctctgtagcatcttcaggttccatcttgacaacttcctctaaatccccaggggaagagttgtttagagactcctggatgccctgagggagcggctccagagcttgccttccctcctctgttttcacaacggtccagcgataggcactgttctctgacaatccttcttggcactgtttatcgactggtggaggccctgggctatgttccactttggggaaaacagtagcagagagaggagatagttcctggggctctaatttgggttctaggccctgaaaggcattttccccatcagccacagcacaagcaatgtccacattcatgtgggccttatcttcaggggtggatggtataggaagattcacagaattgccagaaacaattaagggtgagacagaggaggccacaaggggctggttcaatggacaggggaaggaagtagggttaaccaagagggtggcgatgggaatagtctggggactctgggccacagccgcattgacaggctggatcatgttacagccaccgccaaggctcacaatcttcacagtggtagcaggaacagtgaagataacagatgcagggtggataacaggggcaggtttgatacagcgaaaggccctggctccccttctttttgagggtctccgtctcacatatggctttcgaaacatggaagaggcaggggagggcatcattaccttgggcacaggggcagaagagagcaaagtctgggactcagacagagggaagcttgtcctggcctcagggggcatagcaggcagtgctgcaggagactcaaaactctcacctccactgacccccagtggagggacacctggaactgtctgtaaaacagtggctggctgtattgggtgaggaatccggagcaccattttgctcggaggggcttctgaatgagttgattgggctggtgttttcccagggttgaagctgggctggagagaggggctgggttggataaggaggggtttcaggactgatgaacgcttctgtctccaagccttcttggggaaacggtcggcaactggcttcagtttcaggactacacccttaggcaatagcagtgggtaccgagtttcactccccaactctgagttgtctttttctaggccttgatctgagttgatctcagtggttccagtcatatttcctacctctctagcaccatcagccatgtgccgcagttcttcctggatggatggcagactggcctattggaaatgagaacactctgatccagcacatgtcagaatttgggaaaaagaataggactttctaagtttagggacctgagacaagctcaaggcatctttccaagggactctgcatatgaaatttctacaaagaccacagtccaattatacactttagaaactcttctctgaatttcctttagcaaattaccattttacccattattttgaaaatgttgtagaatcacccggagaagggcagaaaagtaagggaagaaaggtgaatcaggaagattcctgaagtcctagttctacaactaaagcattagacgattaaggaagtccttgatattctctcagaactttcagtgaccttctgcctcctacagacttcgaggaagagggctgtacctttaaccagaatgggagccggtgttcttctctctctataggtggcttccactgatgtggctggatctcttcacagcattttcctaggactggcagctgtttggtcttcttataaaacttaacatgaaaaaaatgcgcatgaattacattccttctggaaacactgtcttctgtcaggctggtgaatggggtggtggtggatcaagagaaacacacacacacacacacacacacacacacacacaagaccacatacacaaacatccatgaacacacatatacgaatagcatatgctgaatacttgtacatttcaaattaaactaatctctatttaaagattttatagttattcagtattttctttttgagacggagtcttgctctgtcgcccaggatggagtgcaatggcgcgatctccgctcactgcaagctccacctcccaggttcacgccattctcctgcctcagcctccggagtagctgggactacaggtgcccgccaccacacccggctgatttttttgtatttttagtagagacagggtttcactgtgttagccaggatggtctcgatctcctgacctcgtgatccacccgcctcggcctcccaaagtgctaggattacaggcgtcagccaccgcgcccagccctattcaatattttctaactgatgatctccattctggttgccaggaaggggagagtttaggtcacagagagaaaaggaagcagatgctaagagcaatcttatgtaagatttgttcctgctcaacagctgcaaagacagcatcgtaatctataaaatggacacatcaaagactttaagcaaatgatggtgtgaagggcatcagaagggaaggaaaaaaaaaaagaccgaggcagttcagttttaagagtaaataggctggccttggtggctcacatctgtaaacccagcactttgtgaggctgaggcgggcagatcacttgagattgagagtttgagaccagcctggccaacatggtgaaactccatctctactaaaaatacaaaaattagctgggtgtggtggtgggtgcctgtaatcccagttacttgggaggctggggcaaaagaatcgcttgaacctggcagtgggggtggtagggtggagattgcagtgagccaagatcatgccactgcactccagcgttggtaacagggtgagactccatctcaaaaaaaaaaaaagaagataagaactgaacttaaaccatgacaataagcatctgttcatccaacatgatgaacataagatgttttctatatcctaggcactgtgctaaaagctaagcacacacataagggaagcaattcctgctctcatggagcttacagactagtgggagagtcaagtggacaaatggcatcctacattaaaaaatgtacaaagggctgggcatggtggctcatgcctgtaatgccagcactttgggagaacgaggaggatggatcactggaggtcaggagttcatgaccagcctggccaacatggcgaaaccctgtctctaataaagtacaaaaaaaaattagctgggtgtggtggtgcacgcctgtgatcctagctacttggcaggctgaggcaggagaatcacttgaactgaggaattaagaggttgcagtgagccaagactgcaccactgcactccagcctgggcaacagagcaagactccaaccccgacaccccgccccatcccccaacaaaagtacaaaggtgtgcacgaaaaatgacacaaaactaaaacttaaacacaaattacttctggccaggcgtggtggcttatgcctgtaatcccagcactttgggaggccgaggcaggcagatcacaaggtcaggagatcaagaccatcctggccaacatggtgaaaccccatctctactaaaaatacaaaaattagctaagtgtggtggcgcgtgcctgtaatctcagctactcgggaggctgaggcacgagaatcacttgaacccaggaggtggagagtgcagtgggccgacatcacgccactgcactccagcctggcaacagagtgagactccatctcaaaaaaaaaaaaaaaaattatttctgcagaagaataaggtttatcacgtgtgccttaaaaccatggatacgccaggcatggtggcccacacctgtaatcccagcactctgggaggctgaggtgggtgggtcacgaggtcaggagtttgagaccagcctgaccaacaaggtgaaaccccgtctctactaaaaatacaaaaattagcagggtgtggtggtgagcgcctgtagtcccagctcctcgggacgctgaaacaggacaattgcttgaacctgggaggcagaggttccagtgagccaagatcacgccattgcactccagcctgggcaatggagcgagactctgtctcaaaacaaacaaacaaacaaaaacaaaaagaaagtactttttaaaaaaccatggataaaaatagacaaatactaaggcatattatcatgcattttcaaaatattgaagccaaaggaaaaatcctgcatgctgtcagaggttgagaaaaacaggtgttacacaaagactcaagagttaaatggggccatggctcatgcctataatcccattactttgggaggccaagacaggacgagcacttgaggccaggagtttgagaccagcctggccaacataacgagaccatgtcttaaaaaaaaaaaaaaaaaaaattagctgggcatagtggtgcacaccgggttggagacaccagtgagccatgatttagccacgctccaaactgggcaacagggtgggaccctgtctcggaaaaaaaaaaaaaaagttaaatggcatgaaatttcttaacaccacactaggagttagaagaaaatgaagtgaggcccttaaaagcttcttaaaaaaattatttcctatctagaattctagatacagtgacagaggagagtattattttttccttttattttgaaataattatattcataggaaattgcaaaaaatagtaccaagaggtcccatgtacccttcaaccagtttctcccaatataatgtttttatgttacatagaaacaagagctatacatataaacaaggtacacagtacaatattactaccaggaaactggccagacatggaggatgtggtggctcatgcctgtaatcccagcactatgggaggccaaggtgggcagatcacttgaggtcaggggttcgagatcacctggccaacatggcaaaaccccatctctactaaaaatacaaaaattagctgggtgtggtggctaatcccagctactcaggaggctgaggcaggagaatcgcttgaacccaggaggcagaggctgcagtgagcaacagtgagactctgtctcaaaaaaagaaaaaaaataaaacaaaaacaaaaacgaggaaactgacatcgatacaatcaaaagaccatgaatggagatttttttttttttttttttaatacggagtctcgctctgtcacccaggctggagtgtagtggcgagatctcggctcactgcaagctccacctcccaggttcacgccattctcctgcctcagcctccagagtacctgggactacagacgcccgccaccacacccggctaatttttttgtacttttagtagagacggggtttcaccacattagccaggatggtctcgatttcccgacctcgtgatccacccgcctcagcctcccaaagtgctgggattacaggcgtgagccactgcgcccggccccggagatggtttaaatgtgaaaattcccttcccaagcactctccctcaggatgctactggaatggggccatgcagggtggctcatgcctataatctcagcactttgggatgctgaagcaggaggatcacttgaacccaggagtctgagaccagcctgggcaaaaaactgagacccccccacctcaattttttaaaattcagaaaaaaattttttttaaaaaaaagctactagaatgtgttccactaaagtaaagaagtaatactcacgcctgtaatcccagcactttgggagaccgaaacgggtggatcaagaggtcaggagatcaaaaccatcctggctaacatggtgaaaccctgtctctactaaaaatacaaaaaattagccaggcgtagtggcatgtgcctataatcccagctactcgggaggctgaggcaggagaattgcttgaacccgggaggcggacgttgcagtgagccaagatcatcgcgcctttggactccagcctgggcaacaaagcgagactcggtctcaaaaaaaagcaaaacaaaacaaaaaacaaggccaggcgtggtgtctcacgcctgtaatccccgcactctgggaggctgaggtgggtggatcccctgaggtcaggagttcaagaccaagaccaaggttgcaggttgcagtgagccgagatccagcctgggggacagagcaagactctgtgtctcaaaaaaaaaaaaaaaaaaaaaaaaagtaatgcaaaagcaaagatgtggaattcaggaaataagaggatctaacacagtatgaggcaaaaggaattcctgggatgatggtgaagaaaaagcccaagaagacatcagtgcagcaacatggagagcaacacgcttaaagtggaataatgtcagagggctcagggagcaatttcttcaagatgaaagtgacagaatatctagaatacctgaacacactgaaagaagatgatctgggaaacaaaatgttcagcaggaaaggcaaggtaacacagtaacatagctgagctgtgaagagcatttatacagtccttaaaatctattttttttttttgagacggagtcttgctctggcaagactggagtgcagtggcgcgatctcggctcactgcaagctccacctcccgggttcacaccattctcctgcctcagcctcccgagtagctgggactacaggcgcccgccaccacgcccagccagttttttgtatttttagtagagctggggtttcaccatgttagccaggatggtctcgatttcctgacctcgttatccacctgccttggcctcccaaagtgctgggattacaggcgtgagccaccgcgcccagccaacagtccttaaaatcttacaatgtaaaccctgaatacaatctaaccaaaattctaccataactactagtgaggagtttggagagcagaaaatgtgcatgtttgtggtgggagtaagggagtgaggagagaggtaaatcttcggcttccgtggtttatggttaataagtaaggcctaaatccaatacaccaggcagtaccaattagaggctgagacaggagaattgcctaaggccaaaaattgaagaccagcctgggcaatatagggacaccccatccctaaaaaaaaaaagttttttgccaggcacagaggctcacgcctataattccagcactttgggaggccgaggtgggcagatcacctgagatcaggagttcaagatcagactgaccaacatggtgaaattatgtttctactaaaaatataaaaattagccaggtgtggtggcgcatgcctgtagtcccagctacttaggaggctaaggcatgaaaattgcttgaacccggtaggtggaggttgcagtgagctaaaattgtgccactgcactccagcctgggtgacagagacagattctgtctcaaaaaaataaaataaaataaataaataaataaatttaatggccaagcacagtggctaatgcatataatcccagctccttgggaggctgacgttggaagaatgcttgagcctaggagttcaaggctgcagtgagctatgactataccactgtactccagcctaggcaggagagtaagaccttgtctcaagaaaaatacaaaaacacaatgaaaccaaaggctgggcatcatggctcacgcctgtaatcccaacactctgggaggccgagctgaggcaagaggactgcttgaggtcaggacttcaagaccagcctgggaaacaaaatgacaccctgtcttcacacaaaataaaataatcggctagccttggtggcatgcacctgtagtccaagctacttggaaggctgaagtggaaggatcacccaggaatttgaggttgcagtgacctatgattgtgcccatgcactccagccaggatgacagagtgagaacctgtctctaaaaaaaaaaaaaaacataaataaatatctaaataaaaaagaaggctgggggcaatggctcacatttgtaatcccagcacttagggaggccgaggcagatggatcacctgaggtcaggagttcgagaccagcctggccaacatggtgaaaccccgactctactaaatacaaaaatcagctgggcatggtggcaggggcctgtaatcccagctacaagggaggctgaggcaggagaatcacttgaacccaggaggcagaggttgcagtcagccaagatcgcaccattgcactccagcctgggggtcaagagcgagactccatctcaatcaatcaatcaataagtaaaaagagttgagaaaaagtatataggctgggcctgggcgacaagagcgaaactccatctcaatacatacatacatacatacatacatacatacagacacagacacacacaaacacacacacacacacacacacacatacatgcatacatacaaacacaaaattgagaaaaagtatataggctgggcacggtggcttatgcctgcaatcctagcctctgggaagccaaaactggtggatcacttgaggtcagaagttcaagaccagcctggccaacatggtgaaacccgtatctactaaaaatacaaaaaattagctgagcgtggtgggcacgcctgtaatctcagctatttgggaggctgaggcaggagaatcacttgaacccgggaggcggaagctgcagtgagccaagatcatgccactatactcctgcactccagcctgggtgacagtgcaagattatgtctgaccaaaaaaacaaaacaaaacaaaaacccaaagcatgtaagtggaatactgcatatcatttctagaaagttcaagaaagagaattattacagggaaacatggatttgtggaatcttttaagaggatgaagatactccagaggaacgtaatgaatgaatcaatgtccctgaaaaggcaacaggggaattaatctagtatataagtaggagaaattagctttagataaaagaaggttcttcttttctttgagaataacaagagaaaagaacagatatgtgttggtgaggtgcctggatagtgcatgcaggaaacactcactttaatgatgttgtcaggagctctgttcatgttgaggttcttgattctcactgtcagttggcgggcagtcttgcaggttagaaggtacttgctgattagagggttaagaaactcagtcccttcaaaatgcttcagtcctaaagctaacaaactgagaaaggagcaataacactaaatctcacttcacagtccttccttctaaagggcctccccagactaacacattttacaatctactttttcttacttgttcttaaaacaaggtctcactctgtcacctgggctggagtgcagtggcgtgatcgcagcccactgcagctgctacttcctaagctgaagcgattctccagtctcagcctcccaaagtgctgagattacaggcatgagcccatggcgtgtggcccaatctactttttcatttttttcagacagggttttgctctgttgtccaggctggagagcagtggcatgattacagtgcactgcagtcttgaatgcctgggttcaatcgattcccgcacttcagcctcctgagtatctgtggctataaacgtttgctaccatgcctaactaatgttttatttcattatttgtagagaccagttctcactttgttgcctaggctgatcttgaacttctggcctcaagtgatcctcctgcctcggcctcccaaagtgtcgtcattacaggtgtgagccaccatggctggccaatctactttttctacaactaattcttgtagtgactactacaagttggtgactactcagtagaaaatttcaggtatttagtgagtagtgattaagtactatgaataagaatcaaatagttcacaattaagtaggagcaagagaaactagtcataaatcatcaataaatgtcagatcatgatgagctgtatattaacaacacaaaggaagttcaaagagaatacatgggaaggagaatgattctaataaaacaaatataaaatgaataataggtaccccgtcagacaaattaaactggcaccaatactaccctctaacataacatatataatcatggttacatatatacatatttgctgttaacagtgtggcaatacacacaaagggccataaaaatgttcataatctagctgggtgtggtggcttatgcctatagtcccagcactttgggaggccaggagtgggaggatcatttgaggtcaggaattcaagagcagcctgggcaacacagagataccctcacctgtacaaaaaaaatcagccatgtatggtggcacacgcttgtggtcccagctactccatggaggctgaggcaggaggatcacttgatcccaggagttcaaggctgcagtgagctgtgattgcaacactgtactccagcctgggtgacagagtaagatcctgtctctaaataaataataacattagaaaagccaacctcctgccttggcctttcaaagtgctgggattacaggtgggagccgccatgtccagtctaaaacattttaaaaatgtgtgtaacatccccccaaaaagcagtatttggcactgctagaacaagcacgttctagaggactctgctcatctatactgcttttccttttgtgtccatgtcttattatacaagtcttacttcccctaaactcctcaaaggaactacatcttctccttgggatatttgatcccccagagtaaacacttacttgtcctcagccttggtgaagaggatcttatcctggggattctttgccttcagggaacacactggaagtaactctggatacatgaaaaccttgcttgtggccaggatccaagccacttgctttggcaaacagggaaattcattggctataagaaaataaatctctgataaatcaacttctaggaaaaaagagggcttcaaaaagcctgtgaatgcatttttgcatttaggtagagctgtccttatctaacttgattccctcccatctgcctaccactccccaaagagtttccacagtctttcctcaactaacattaggtctaaagggagtcccattcactggcaataaaagttgactttttttttttttttttttagacggagtctggctctgtcgcccagactggagtgcgtggcgcaatcttggctcactgcaagctccgcctcccgggttcaggccattctcctgcctcagcctcctgagtagctgggactacaggcgcctgccaccacgcctggctgattttttgtatttttagtagagacggggtttcactgtagacaggatggtcttgatctcctgaccttgtcatccgacagcctcggcctcctaaagtgttggattacaggcgtaagccacggcgcccggcctctcttactctttcttacgtgtaacactttattcacaaagtaaaacaaacacttaaaaagtacctagtaatacctgtcacatagtgtatgctcaaaaatgttttacctcctttcccctttaaatctctgaaggataacagaccttcaacaatgcttttttcttccaggataagattccaggccaggcgtgctggctcacgcctgtaatcccagcactttgggaggccgaggcaggtggatcacctgaggtcaggagttcaagaccagcctggccaacatagtgaaaccccatctctaccaaaaatgtaaaaattagccaggcatggtggcacgcacctgtaattccagctacttgggaggctgaggcaggagaattgtttgaacctgggaggcggaggttgcagtgagccgagatcaccccactgcactccagcctaggtgacagagcgagactccatcttaaaaaaaaaaaaaagaaaaaagattccaacttctttaatctccctcacaaacctggtattccaaattttacttttatttcattctttcttaactttcattaagttctcccagattcctcctgaggttgggaacaaaagaaccataaaaggaatgagacaattcagtctcattcatttctgtctccctctctcagcctctcaattttaggcacctctgcatttctagagacaaaactactatatccatatttctccttccataagtgtcatttttatatctccagaagaaaaacacaggacactagatgtgtaagataatactataatttggtattaaatcacgttttcattaccatttcatataatatagctattaaagtagtttgggatctgtgtctatgatatagtacacttaaattcaactacattcaatgtaatgataagacttagggatttaaaatagaatccaaagacaaacccaaatccagaacaaaccacaactaatttgctaagtcagcaaacaaatcagaagtaaatatttggcttaagtaaatagcaaatattttctcaaaaaatactaaaccaatgcaaggtagaatctaaaccggcaaatttctttaaaatactgaacacggcaaatgtacaatctctaatttacgcctaacttgcaagtcaacatttcattcagaatggagatatcacctatgctacaatcattatggtaaataaagttagttgatcttaatgaagagaataaaaagctaaacatgaccgaactttaccacctgactttcatctttaccaggccccagtttatcttgatctgattcctaatacttacccctcatattgctgtagtccaattcttagcactgagcctcagatctctacctcccatattcctatactgtccactgcctccatgccttacccaggcccggagattatcatgtaattctagaacttggataatgagtacaaagggaggataaaagagagaaggaagaaattacaaatgtcctgtgtcctccattcctaggcaagtatcctaggaagttatctatgggataagattcccaccacctctcaccgcaagtaaaaacttaaagctgacacatctgtctcctaccagtcttcttgacagttttatgagggctgcagtcaatgctgacatgtgtgctgaagtcttcaatcagctgcatagctcccatcaagttacagggttggaacagggtctgaaacttggggttgtactgatggtgaagggcgatggagctttgagcaaaggttcccagctctttctgggaaaacacgacacaaggaagatctaagacaattccagacaattaataccaatagccttcagaatctaaatgagaagctgaccttcctactacaggataaaaacaggtaaaaataatcataaagtctttcacaataaactactgttaagattatgcctgagttctcagatattcagggattatattcttgttttatttttaaactgtttctcactaaggaatacatggtctagctcccgagctagaattaagagtctcaagaatggggactattactttaatttaattaattaatttattttgagacatggtctcactctgccgctcaggctggactgcagtggcatgatctcagctcactgcaaactccccctcccaggctcaagccatcctcccactgcctcctgagaagctgggactataggcatacacctccaaacctagctgatttttgtattttttgcagagacagcgttttcccatcttggccaggctgatctcgaactcctgggctcacaatccgcctgcctcggcctctcatagtgctgggattacagggatgagtcacctcacccgaccaggaccattacttttaaaattgttttgtcttttggtctcagaataatgcctacaaccaagtactcctcatcctcctctgaatacagtaagagatgaagacatcctgttgatcaccaaggaagttttagaatactagcaaatgtactcttcaaaatccaaagaagacttactgaagaagctgagagtattatcattacctgtccaaaagtttgaggcaatttttatgaggtaaagtatggttttgtttttgtgagacaggttctcactctgtcacccaggctggagtgatatataagcacggctccctacagtctcaacgtcccaggctcaagtgatcctcctacctcagtctcccaagttgctgggactacaggcactcggcaccatccccagctaatttttttattttttatttttttggtagggatggggtcttactatgttgcccaggctggtctcaaactcctgggctcaagcaatcctcccaccttgacctaccaaagtgctgggactacaggcatgagccaccatacctggccaaatttcaaatttaaaatctcaaaataggccgggcgcggtggctcacgcctgtaatcccagcactttgggaggccgaggtgggcggatcacgaggtcaggagatcgagaccatcccggctaaaacggtgaaaccccgtctctactaaaaatacaaaaaattagccgggcatagtggcgggtgcctgtagtcccagctacttgggaggctgaggcaagagaatggcgtgaacccgggaggcggagcttgcagtgagccgagatcccgccactgcactccagcctgggcgacagagcgagactccgtctcaaaaaaaaaaaaaaaaaaaaaaaaagctcaaaatacctcaaaacgtcatgagcaaaactagctctacacataaaacactaatattgagcttcatgaatggataatgaattcaacatctacatgtatatttacttcattatttaaattaaaacaaaacaaaacaaaaaaaacacagaccgggtcttactatgttgcccaggctgttcttgaccactgggctcaagtgatcctatcacctcagcctcccaaagtgctggaattacaggtgtgagccactatgcccagcctcaacatctatgaaatgaatagcggtaccaaaaacctaagaagtcagggtgaatctaaagatgaggaggaggacccaataaaaatatcagaaggacaggccaggcgcagtggctcatggctgtaatcccagtactttgggaggtagaggtgggcagatcacttgaagtcaggaattcgagaccagcctggccaacatggcaaaaccctgtctctactaaaaatacaaaaaaaattacccgtggtggtgcccgcctgtagtcccagctacttgggaggctgaggcaggagaatcacttgaacccgggaggcaggggttgcagtgaactgaaattgttccaccgcactccatcctgggtgaaagagcaagaccctgtctcaaaaaagaaaagaaaaaattgaatacactctttgtcctttcatgtgaatcagtggcttatgttcactcagcaaacataggaagccacagcaatcaaaaatacctgagagaataactgtgagaaataacctgccaagctaattttatattctagtctatagaattacggcaatttggaaacttacaagacatatcctggtgctactggcctccggattgagattggggttgcaggtggcaagaaggtggatttgtgtcaagagctgaacatgctggggagagaaagaaaataatgcagtgatatgttatgacactgccatttcaggagcccagagatatttttttttccccctggagacagggtcttgctctgtcacacagcttggagtgcagtggtgcaaccatgactcaatgccctctcaaccacctgtgctcaagcaatcttcccacctcagcctcccaagtagctgtgaccacaatgcctggctaatttattttattattattattattattatttttagacagagtctcgcactgacttttgggctggagtgcaatggcgtgatctcggctcactgtaacctctgcctcccaggttcaagtgattctcttgcctcaacctcccgagtagctgggattacaggtgcccgccgccacacccagctaattttttgttttcgtagagacggggtttcaccatgttggccaggcttgcctcaaactcctgacctcatgattcacccgccttggcctcccaaagtgctgggattacaggtgtgagccactgtgcccagccttatttttattttttgtagagacagagtctcactatgttgtccaggctgcttttgaactcccctgctcaagcaatcctcccacctcagcctcccaaagtgctgggattacatgtgtgagccactgcacccagccaccagagagtcattaactaagatgtttgcaactttatgacacaaattttgctttctgcaaagagtgtgagaacaacgtaggatcttggcataaatttctcagacatgttcccttgaacaaaatgacagaaccagaggaagtttaacctctaaacagaggaggaactgagattagaaaaggaaaaggccgggcgcagtgactcacgcgtgtaatcccagcactctgggaggccgaggcgggtggatcacgaggttaggagatcgagaccatcctggctaacacagtgaaccctgtctctactaaaaatacaaaaaattagctgggtgtggtggcgagtccctgtagtcacagctactcgggaggctgaggcaggagaatggcgtgaacccgggaggcagagcttgcagtgagctgagattgagccactgcactccagcctgggtgacagagcgagactacgtctcaaaaaaaaaagaaaaaagaaaagggaaaagggaaaaaaaactacttgtcacagtgaaggttaaatttcagaatagattactgaggactctttgaaatctgtaattccgaataccattagggtccttatgtgctgtcttccctgagccacaggacatgaacatgatgacttctcaagctcctaactgatgtgaagatactacggttttaatacgtagtaaggtaactatctctgacatttacaaagctgctaattttagattataccaaagcctcagagttaggccttggtataattcaatattaatatgaccaaggaaagtgttacctgctgcatctgctgctggagtctcttcctttgtgctgggtccagaatcagggtctgatgaacttccttacactggggtttaaccttctctacctccttctgctgtttggctgaaggtttcttcatcttcagctgttcaaatagttccttcgctatctgatgttgttcatttagtaggttggccagtagttcctcaaacctatcccaaacggggatgactgaatttgagtgttttcctaggtccacaacacatccaattctttgcaatgatgagcaaagagcctgaacaattttcattccctactaatccccccttttcactttagccaacagtcaaactcccagccttacacaaatcttttcccaaagtagttagcatgcatcaaatgattctgtattacaccccatcccattcctctacaattcctcttccaaataatatacaaatgaagaaaaaattaaacaaaaaactagggacagagaaatatatgggtaagaaagcagccaaggagctggtgggaactcatcattctcatttcttctctcattacttgttactccctgggatgttactcccatcccaggtccagcttgtcccattatcctatctactcaggctgcactgccctgctttcttaacaagtcaaagactttctagcatgaagcaggaaaaggatataccaaaataactgaagtacatggtagttcaaatgaacagaacggagaagttagttaaaatattatccatgaaggctatcttcttttagccctttaaattcctcttccaaggttcctaaccctaacttcccatccataccctcctgaaagattgtttgcagggctgaagcaaaaattccaatacctagcatgtcagttctatgtatgattactataccttttctatgtttacatagaaagaaataaagggagaataatatacctaaatgattaagcatatgctgataccctatgcaacaggataagatctgctgaagtagctataacaagcaggttatcatatttcaaggaaccccctatattacagcaatagttaaatggtaacgtttttcaatagtttttgcagataaagattacgtttgaataagttttcttttatagtatttactgtaggtttgggtagcacagagtaaaaacctgaagaccgtgggactgtctatacaatctttactgagaactgaaaatttgaacatccgcgctaccaccactgaaggaacagaagagaagaagcataaaaaagtagaaaatggaaacatagcctgcacttagttttaacaaggattatttaggtaattgataagggaagccccagagtttttgttttgactgtctttttctcctctctcttccttattgtgttttaagatgtgcttactctctatggacttacagagggatttttatttagtcaaagattaaaacaaaaacaggtttgtatttgcaatcgaaagagaagcagaagctgcccaagtacagtcatgcgccacagaatgtttcagtcaataacgaaccacatagtcagaggtggctccataagattactgtaccttttctatgtttacatacatatgtacttaccattgtgttacaactgcctacagtattcagtacagtacagtaacacactgtacaggttttgtagcctgggagcaataggtatgcagtaggctaaaccatttaggtttatgtaagtacattctacgatgtttacacaatgatgaatcgtttaatgatagatttcacagagggtatgaccatgagatgatatatgactatattccattgaataccagaaggtaactggattctaacaggaattttaaattagttctatattttccaaattttaagaagttataaagagttgatcagcaaaaccaaaatatttattaatcagatcctattatacgttcccaggatgaatggttccattctgctataccagaattttgttctatgaactataaattaaaataatgggtcaaatactgacttagcaatcttgagatttttgatgtagttgtattgtgatatttgttgtaatggagaatgactagtagttctagtttttaagacattggttggcctatcttatcttttttcactaaattggaaaatccctaaaggtctagctttcagatggaacccaagctctctgcttagtagtgctgttaagttcaaacacaggactaattacagggactattctctttgctttgttccacttatggcacaaactgcatcctgacctctcgccatcgacctaatgattatatgctgctacaacagaataaagtgcagatgcaaatccaccacaaaatgaggaaaaaattaaagcctctactttctggatgctgtaacacaagtgccaactttaggcaaaaaggtcagcacgtatgtttcagactccttactgcaggtgcttcagggtttgctccactaatgcctaggtgactaacaaattttcagtcacatttagcagatattaatggcacataaaaagaacaaaagggacagactggatattacaatatagggtagtttgtgtggctggccacattgagtcctacatacctctccagcaccactcacccggagaagtggatatggatgccagctactgttttttctcccttcccaaacagatacagcttggcctacagctgcactgccccataacaaggagacttcacttgacacctaactcctgacaggactctgcatccttacatcagtaacagaagctggctggggatgaaaaattgttaactgcaacttctgaaaaccttttcagaaataaactcttcctctattccaaatctcaaggtcttcaactagcctaccgtagagcttgaggggtgttaaagttagcttgaggctcagccacacgctcctcctcttctgggccatcatcttccatgttggagaatcccatctcatcttggaactgtgggcaaaggaaagggagggttttcctggggaatgggcttttgaatgttgctccagtgttgggaaggaaaagtgaaaactataaacaatactttaataatgctggcacccagaaagagcctacatcagaacctttctcacttcaggactcctacaaacccacatatggaatgactattatgccaggaaagaagttgctcaaccagtcaacttgtatcagtaagcacagagctaggataactcaaaatgatcaatttcttaaacagaaatatctttttagacaaatttatggaaaaggtaattatttgtgtgcaaaatactttaaaactagttggcaatctttaaggacacaccaaatgacagtaggggaagccatcaaaagttttcaaggggcaagatgtgctggctcacacctgtaattccagcactttgggaggttgaggcaggaagattacttgagcctatgagttccagaacatggcaagaccctgtctctacaaaaaaataaaataattagccgggcctgtaggtgtgtgcctgtagtcccagctactcaggaggcttagatgagagaattgttttgagccctggaggtcgaggctgctgtgagctgagatttcaccactgtattctccagagcctgggtgacagagcaagactttgcctcaaaaaaaaaaaaaaaaagcttcaaggaaaattttagtaagaataacctacatgtggataatcaagagtctagcagttagcaaatttcttttgtcattatattctttcccaggtagactaaaaggagaattggttcagtccctcttctagaaggagcatcacagagatcaaaggacacattttgttggagaaccaacttacaatcccatgttctcacttgaggatcattactcacagtttcaaacagatcttccatcagctcatttgcttccttttctgcaaaaaagccaaacgttgttggtataaattagattcattttacaatatggaggaattccatgtagacaatgtatgatgttttcaacaaggcatctgacgaattcttcatatctatccttattcctgagacagggtctcactctgtcacccgggctggagggcagtggcttgatctcggctcactgcaatctctgcttcccaggctcaagcgatcctcccacttcagccctccaagtagctggggcaacaggagtgtgctgtcatgcccggctaattcttccatattttgtagagatgggttttccccatgttgcccaagctggtcttgaactcctgagctccagtgatccacccaccttggcttcccaaagtgctggggttacaggcatgagccaccacgcccagctatccttcattcatttattcaaaaacatttattgagtacttactatgtttcaatccctgttttagatgcttgggatatatgagagaatgagagagagagagagttctaatctcattgaacttaaattctaataggaagaagacaaggagaaaatgtgagctagatgatttttttttttttttgagacggagtttcgctcttgttgcccaggctggagtgcgatgacacgattttggctcactgcaacctccgcctcccaggttcaagctattctcctgcctcagcctcccaagtagctgggattacaggcatgcaccaccacgcccagctaattttgtgtttttagtagagatggggtttctccatattggtcaggctggtctcaaactcctgacctcaggtgatccgcccacctcagcctcccaaagtgctgggattacaggcatgagccaccatgaccagcccaatgattttataattagatggcctatccaaacccacacaatactgaatggaatcaagagacaagtctcccaacctgggcaaaatgtcaacatatctctaaaaaaaaatttatctgggcttggtcgcacatgcatatagtcccatatacttgagaggctgaggtgagagaatctctttgagtccaagaagcagaggctgtagtgagctgagaccgtcccactgcattccagcctgaacgacagagcaagacactgtctccaaaaaaaaaagagacagacagagacaagtttccaacagtgtttcataggactctatctttggacccgacctattcaaaaactccatcagtgaattagaagaccaagagaacatacttaacaaatctgtagatgatgtaaagctgtaaagctgaaagggactgccaatccaattgatggaaaattcagaatcatattttctcaaatcaactggatgtaacacgtaaggataaatttaaagttctacattgaggatttttttttttttttttttttaaatagagccagggacttgctatgttgcccaggctggtcttgaactcctgggctccagcgatcctcccacctcatcctcccaaagtgctgggattacagacatgagccaccccacctggcaagatcttatatgtgtattcaagatattacacaactcactaagtctccagatgaaaaccagaatctctaaatatagtttgacagtttgacaatgcccaatgacagactaaatgagaaattaggaggcagcttgatttttttttatttcctcagagatctttgttctgagttctgactcttgttctacaaatattcaaagtcgaaatgattatcatgttaatgggtaaagagcttcaaatctttggctatctcatttttttttaatttttattcatttgttttaccttatgtgttcctctacaatggttatctaggaagttaacaaccattctagctatctagcattctggttcttgatatcatgtaaaatgagcgttctgatctctgacacacaaagctatttagaagataaaaaatagacatttttttcaacaatcattttacttttttctctacatctacatactctacatgtcagagtttttgtttctgttttttcgagagtagctgggattacaggcacctgccacaacacctggataattttttgtatttttagtagagatggggtttcatcatgttggccaggttggtctccaactcctgacctcaggtgatccacctgcctcagcctcccaaagtgcagggattacaggcatgagccactgcacccagccaagtactttgattcttaatggaggatttaatccactgacatcccaaaggacaaactatccaatggaattcctggataaaacacaggcacacagtgtctcttcctcagaggaaagaaatttttgtcaacagaagaattttgctcttctgggcgtggtggctcctgcctgtaatcctagcactttgggaggctgagcctggaggatcacctgaggtcaggagttcgagaccagcctggccaacctggtgaaaccctgtctctactaaaaatacaaaaattagcctagcgtggtggctaatgcctgtaatcccagctacttgggaggctgaggcaggagaatcgcttgaacccgggagtcggaggttgcagtgagccgagattgcgccattgcactccagcctgggcgacaagagcgaaactccatctcaaaaaaaaaacaaaaaacaaaattgatttgctctagcagaaaaataattatatttcaggaattccttcaggaatcctataccagtactaaaagatcctatattggaaaatgaaaatgcccaaattaataagtcctgagatagaggagaagggatcttgttttgtccatcactgtatcttagtacctggaatagtgcttggcacataataagcattaaatacatacatggcagtcttgtttctgaaccaaaatgaggtggtttaatgaaagagatgggtttggctaggcgtggtggctcacacctgtaatcccagcactttgggaggctgaggcaggtggatcacttgaggtcaggagtatgagaacagcttggctactggctaacatggtgaaaccctgtctctactaacaatacaaaaattagccaggtgtagtggtgcgtgcctgtaaacccagctgctcaggacattgaggcaggagaatcacttgaatccgggtggcagaggctacagtgagtcaaaatcctgccactgcattccaaactgggctacagagcaagactccatctcaaaaaaaacaaaacaaaacaaaaaaaacaacaacaagtgaaatactgaaatactgatcagctttaaaaagagaactgtcataaccaccccaatttagttccaagacttaggcttccccaccaaggcaaaattaacacagtaagaaggctattccagttcattttggagaaaatcttggatttggtaagcaggtaaaaagagctgggcatgctggctcacatctgtaatcccagcaaactgggaggccaagacaggaggatggcttgaggccaggagttcaagaccagattgatctacatagcaagacctgggccaggtgcagtggctcactcctataatcccagcactttggaaggccgagacggctggagaacttgaggttaggagttcgtgaccagcctggccaacgtggggaaaccctgtctcaactaaaaatacaaaaatcagcagggcgtgttggcacgcgcctgtaatcccagctatttgggaagctgaggaaagagaatcacttgaacctgggaggcagaggttgcagtgaggcaagattgtgccattgtactccagcctgggcgaggagagcgaaactctctctcaaaaacaaaaacaaaaacaaaaaaccatagcgagacctaatctcaattaaaaaaataaagaaattgtatacacatacatgcacatatatgcacactacacacacatatcacatgtacgttttgagaaaaataacaccatgaacctactacccgttaaaaattagagaaaatattaaacttttcacaaatttacatagcattcttatacaggggccatgtcaatagaaagaaaggactatcagacaatttttcctaaaacttctccattatctcactgaatcctataatctgtcctattaaaacacctttttacatttcttgcttttttttttttttttgtgagacagagtgttgctctgatgccgaggctagagtgcagtggcatgatttcagctcactgcaacttccccctcccagttcaagcaattcttggttcaagcaattctcgtgcctcagcttcccgagtagctgggactacaggtgcactccaacacatgcagctaattttttgtattttagtagagacggggtttcaccgtgttgcccaggctggtctcgatcttctgagctctgacaatccatccgcctcgtcctcccaaagtgctaggattacaggcgtgagccaccccacctgaccaatttcttgttcttttaaaagtacagtaattatttttaagttccagtaataaattaatgggtagtctgtcaaatagctactggattttatatcaggagggctttctacatgtatgtatacccaaaaatgacattaagacctttttacataaactcactgtagagatacatcccaaaacaaggtaaggaatataaatgatgtttaccttcttttcaaaccaacagttcctttatacaaaaacaccagatgatacaaaacatatttttttaaagtacaaagttccatacagaataaaataaacactttatggttattcctaagaataagtagtgacaaaaagtctttgcaattgggtaataaaatttcagcttctaggaatatgtttccctcttccttgtccttttgagagctgccactatcacacaattcacagcatctcttcaaccacagaaaattagcgtctcttcaagcacagagaccatatattaattatctttgtgtctcctgcataggattaactcagtgtttgttataactaagttaaactccaagacaggagcttcaaatcacctcaggcccaatccaaaactgaaaaaaagacgcttctcagagtttgagaacaaaaagatactgacaaagaacaaagccatagatacttgtgcgacattagcttccctttttaccaaatacagagtcatttactaatactgcagaaatgtttgcagacgataaaaagaataaattaaaaatatggatcctgtcaacatgttcaaatactaacatagactccttcaccttaaactcatactaacatccacacacccgaacaatgaaaatgaaaggttttcaaatgagatctaaatataaattggctctatttcattacagtttaagttcctaaaatcatatatataaatcatgtgattgcgcttatgctcatcttctaacttgagggcccagtgtctttcatccgattctctgaaggataagtgaccccaaaaaacttttaagaaccactaatctagcctatcaagaaacatcccattttccagaagaatacagctaagttggcttagttcatgcattcttacctcatattcatagagttcatagacgggatccttactacatgaaatcagtcttttttttttttttttttttttttttggagatggagtctcctctgtggcccaggctggagtgcagtggcgcaatctcagctcactgcaagctctgcctcccgggttcacgccattctcctgcctcagcctccccgagtagctgggactacaggcgcccgccaccacgcccggctaattttttgtatttttagtagagacggggtttcatcctgttagccaggatagtctcgatctcctgacctcgtgattcgatctcctgacctcgtgatccgcccacctcggcctcccaaagtgctgggattacaggtgtgagccaccgcgccctgccgaaatcagtctttcaaaggattccttcagcccagccaagaagttccaacatccacaggcacatatattaacaattaccagtacccaaaaacagttctctggttttaattccacactgcctccctcaacttaatacctaccaccgtcaaaacaactcccctcagattgcatccaggctatttacagagacaccttgatgatcctcacctcaaggcatggaccattcattgaatggttatatttgttgaatgagtgaaaaaggatccttcctcccacagatttcaagttaagctgtcagcacccatgcagctgctctggtacaagttaagctgtgaaagccttctccctcacgcatacaaccttaagtgtcagaaatgctctgcttcctccataaatccaaaataatatagccatggatatgcatttcatacaggtcagactcggcaaggacagctacgttccacatacatatctgacacaatcggtctcccccaaatacaagccaaccagtcttatgtgctcctatctttccagcatactcagatttgccgacaaagacttcctgaggcaccatggtatgctgaatatactgctgcagtagtagtgaaaatatgggagttacagttccaactttgtcaccaatttaacatgcggccttggagaagttctctccttatgcctaaatttcctattttgtaaaatggaagaaagcatcctaccattttcacagagattcagtatcacaaagaaactgaaagagctttcttattgtattgtaaactattactataaacccgcgacaacaaataaggccacccattctttacagctttgtagcaatgattctgttaaagatattttggcccttcacatttacacaactcactctaaccaaaggcacaaactattcttaagaccacaactggctatgccaagtttctcccctccctgacctcacagacacatgctgtacagaacactaccattgccgctctttcccaacaagtaactaggggctcccaatccctaaaatacacacacatatcaacctgcaaggaacctcccaacatttattcaagaaataagctaacttataaggggaactccattacacttacacaaataaaggcaaactcttacggaaacacttgccatcctcacatacacacaccaacacagccgctacacaccaacagaccatctgtctgctagaccaaaaacatctctttccatgtacaaactaaccagtgacatttattaaacgtacaacactgagatcatcctgtcgttcccacataccgttcaacgcggcagggacaccacagaccttgtcacacaggtaaaatcccctctcaagatcgtgtcctcgaccactcttatcccttaattaaacacacacaaactggactatgggggaggctccgatcatgcctacaaacacaaactaacctgtcaggggcacagccgactccgcctccactcgcttacttcccagccccctccgggagtctgcctgtcagggacaccccttcaccccgcctggagggacttcccggtaggctcaggatccccctccctgctctcccctcccccatcttcaccactgctctcccagaggtccaggtccgggagatgacagtggctcccagaaagcccaggattcaatcgctgagagagtgcttaggcccgaatgccggcccaaatcgttctactcaccgtgtcggaggccgagagcgatgagagtacagggaagtgaggaagagggggtggccgccaggctcctccgcttccctgggtccaccgcggatccctcccgcttgtcaggaggcggccagcgggtaagccgactggcggaaatgcgagagaggagaagggaaaggtggagggctaaaggggcaaactgagaggaggcggatcccgcaaccgacactgggatcgtttcccctcgcaaagcgaacccaaaatggcggcggcagcggcggcagcagagtggccgcggcagctcctccagagggagggagctaagggcgcctagcgacacccccaacctcccactcctccctcctcgcgttcttccccacggtcccccgcttcgcccgactccggccatgtagcgcgcacgtcagcccgcacgcgtacgagtgtctacgggctcgtcgctggctgctcccaccaaccaccaccttcggccgtcctgcgagccagccatcccgtacgcgctcacccacgggaacctcctcgcccagttctccactccccctcagaccctgtcaagccggctccagcgcaggccctcacgcgtaccttcagcggcgcgagcccaagccttctccacctcctcttctctcctccccctccctccccgcccgc

SEQ ID NO: 708 - DNA, 29333 bp, Homo sapiens
tcaatgaaacaatgaagcaataaaagcacagatttattgaagcaaaagtatattccacagagtgggagcaggctaaagcaagctgctcaagagccccagttgcaaaatctggggtttaagtaccctttaggggtttcctattggttacaccctatgcgccaccaatcggaggccgaagtgaaggctcccagtctccagactcttattctcctagctcaaagaaatccactgatttcctctgtagcatcttcaggttccatcttgacaacttcctctaaatccccaggggaagagttgtttagagactcctggatgccctgagggagcggctccagagcttgccttccctcctctgttttcacaacggtccagcgataggcactgttctctgacaatccttcttggcactgtttatcgactggtggaggccctgggctatgttccactttggggaaaacagtagcagagagaggagatagttcctggggctctaatttgggttctaggccctgaaaggcattttccccatcagccacagcacaagcaatgtccacattcatgtgggccttatcttcaggggtggatggtataggaagattcacagaattgccagaaacaattaagggtgagacagaggaggccacaaggggctggttcaatggacaggggaaggaagtagggttaaccaagagggtggcgatgggaatagtctggggactctgggccacagccgcattgacaggctggatcatgttacagccaccgccaaggctcacaatcttcacagtggtagcaggaacagtgaagataacagatgcagggtggataacaggggcaggtttgatacagcgaaaggccctggctccccttctttttgagggtctccgtctcacatatggctttcgaaacatggaagaggcaggggagggcatcattaccttgggcacaggggcagaagagagcaaagtctgggactcagacagagggaagcttgtcctggcctcagggggcatagcaggcagtgctgcaggagactcaaaactctcacctccactgacccccagtggagggacacctggaactgtctgtaaaacagtggctggctgtattgggtgaggaatccggagcaccattttgctcggaggggcttctgaatgagttgattgggctggtgttttcccagggttgaagctgggctggagagaggggctgggttggataaggaggggtttcaggactgatgaacgcttctgtctccaagccttcttggggaaacggtcggcaactggcttcagtttcaggactacacccttaggcaatagcagtgggtaccgagtttcactccccaactctgagttgtctttttctaggccttgatctgagttgatctcagtggttccagtcatatttcctacctctctagcaccatcagccatgtgccgcagttcttcctggatggatggcagactggcctattggaaatgagaacactctgatccagcacatgtcagaatttgggaaaaagaataggactttctaagtttagggacctgagacaagctcaaggcatctttccaagggactctgcatatgaaatttctacaaagaccacagtccaattatacactttagaaactcttctctgaatttcctttagcaaattaccattttacccattattttgaaaatgttgtagaatcacccggagaagggcagaaaagtaagggaagaaaggtgaatcaggaagattcctgaagtcctagttctacaactaaagcattagacgattaaggaagtccttgatattctctcagaactttcagtgaccttctgcctcctacagacttcgaggaagagggctgtacctttaaccagaatgggagccggtgttcttctctctctataggtggcttccactgatgtggctggatctcttcacagcattttcctaggactggcagctgtttggtcttcttataaaacttaacatgaaaaaaatgcgcatgaattacattccttctggaaacactgtcttctgtcaggctggtgaatggggtggtggtggatcaagagaaacacacacacacacacacacacacacacacacacaagaccacatacacaaacatccatgaacacacatatacgaatagcatatgctgaatacttgtacatttcaaattaaactaatctctatttaaagattttatagttattcagtattttctttttgagacggagtcttgctctgtcgcccaggatggagtgcaatggcgcgatctccgctcactgcaagctccacctcccaggttcacgccattctcctgcctcagcctccggagtagctgggactacaggtgcccgccaccacacccggctgatttttttgtatttttagtagagacagggtttcactgtgttagccaggatggtctcgatctcctgacctcgtgatccacccgcctcggcctcccaaagtgctaggattacaggcgtcagccaccgcgcccagccctattcaatattttctaactgatgatctccattctggttgccaggaaggggagagtttaggtcacagagagaaaaggaagcagatgctaagagcaatcttatgtaagatttgttcctgctcaacagctgcaaagacagcatcgtaatctataaaatggacacatcaaagactttaagcaaatgatggtgtgaagggcatcagaagggaaggaaaaaaaaaaagaccgaggcagttcagttttaagagtaaataggctggccttggtggctcacatctgtaaacccagcactttgtgaggctgaggcgggcagatcacttgagattgagagtttgagaccagcctggccaacatggtgaaactccatctctactaaaaatacaaaaattagctgggtgtggtggtgggtgcctgtaatcccagttacttgggaggctggggcaaaagaatcgcttgaacctggcagtgggggtggtagggtggagattgcagtgagccaagatcatgccactgcactccagcgttggtaacagggtgagactccatctcaaaaaaaaaaaaagaagataagaactgaacttaaaccatgacaataagcatctgttcatccaacatgatgaacataagatgttttctatatcctaggcactgtgctaaaagctaagcacacacataagggaagcaattcctgctctcatggagcttacagactagtgggagagtcaagtggacaaatggcatcctacattaaaaaatgtacaaagggctgggcatggtggctcatgcctgtaatgccagcactttgggagaacgaggaggatggatcactggaggtcaggagttcatgaccagcctggccaacatggcgaaaccctgtctctaataaagtacaaaaaaaaattagctgggtgtggtggtgcacgcctgtgatcctagctacttggcaggctgaggcaggagaatcacttgaactgaggaattaagaggttgcagtgagccaagactgcaccactgcactccagcctgggcaacagagcaagactccaaccccgacaccccgccccatcccccaacaaaagtacaaaggtgtgcacgaaaaatgacacaaaactaaaacttaaacacaaattacttctggccaggcgtggtggcttatgcctgtaatcccagcactttgggaggccgaggcaggcagatcacaaggtcaggagatcaagaccatcctggccaacatggtgaaaccccatctctactaaaaatacaaaaattagctaagtgtggtggcgcgtgcctgtaatctcagctactcgggaggctgaggcacgagaatcacttgaacccaggaggtggagagtgcagtgggccgacatcacgccactgcactccagcctggcaacagagtgagactccatctcaaaaaaaaaaaaaaaaattatttctgcagaagaataaggtttatcacgtgtgccttaaaaccatggatacgccaggcatggtggcccacacctgtaatcccagcactctgggaggctgaggtgggtgggtcacgaggtcaggagtttgagaccagcctgaccaacaaggtgaaaccccgtctctactaaaaatacaaaaattagcagggtgtggtggtgagcgcctgtagtcccagctcctcgggacgctgaaacaggacaattgcttgaacctgggaggcagaggttccagtgagccaagatcacgccattgcactccagcctgggcaatggagcgagactctgtctcaaaacaaacaaacaaacaaaaacaaaaagaaagtactttttaaaaaaccatggataaaaatagacaaatactaaggcatattatcatgcattttcaaaatattgaagccaaaggaaaaatcctgcatgctgtcagaggttgagaaaaacaggtgttacacaaagactcaagagttaaatggggccatggctcatgcctataatcccattactttgggaggccaagacaggacgagcacttgaggccaggagtttgagaccagcctggccaacataacgagaccatgtcttaaaaaaaaaaaaaaaaaaaattagctgggcatagtggtgcacaccgggttggagacaccagtgagccatgatttagccacgctccaaactgggcaacagggtgggaccctgtctcggaaaaaaaaaaaaaaagttaaatggcatgaaatttcttaacaccacactaggagttagaagaaaatgaagtgaggcccttaaaagcttcttaaaaaaattatttcctatctagaattctagatacagtgacagaggagagtattattttttccttttattttgaaataattatattcataggaaattgcaaaaaatagtaccaagaggtcccatgtacccttcaaccagtttctcccaatataatgtttttatgttacatagaaacaagagctatacatataaacaaggtacacagtacaatattactaccaggaaactggccagacatggaggatgtggtggctcatgcctgtaatcccagcactatgggaggccaaggtgggcagatcacttgaggtcaggggttcgagatcacctggccaacatggcaaaaccccatctctactaaaaatacaaaaattagctgggtgtggtggctaatcccagctactcaggaggctgaggcaggagaatcgcttgaacccaggaggcagaggctgcagtgagcaacagtgagactctgtctcaaaaaaagaaaaaaaataaaacaaaaacaaaaacgaggaaactgacatcgatacaatcaaaagaccatgaatggagatttttttttttttttttttaatacggagtctcgctctgtcacccaggctggagtgtagtggcgagatctcggctcactgcaagctccacctcccaggttcacgccattctcctgcctcagcctccagagtacctgggactacagacgcccgccaccacacccggctaatttttttgtacttttagtagagacggggtttcaccacattagccaggatggtctcgatttcccgacctcgtgatccacccgcctcagcctcccaaagtgctgggattacaggcgtgagccactgcgcccggccccggagatggtttaaatgtgaaaattcccttcccaagcactctccctcaggatgctactggaatggggccatgcagggtggctcatgcctataatctcagcactttgggatgctgaagcaggaggatcacttgaacccaggagtctgagaccagcctgggcaaaaaactgagacccccccacctcaattttttaaaattcagaaaaaaattttttttaaaaaaaagctactagaatgtgttccactaaagtaaagaagtaatactcacgcctgtaatcccagcactttgggagaccgaaacgggtggatcaagaggtcaggagatcaaaaccatcctggctaacatggtgaaaccctgtctctactaaaaatacaaaaaattagccaggcgtagtggcatgtgcctataatcccagctactcgggaggctgaggcaggagaattgcttgaacccgggaggcggacgttgcagtgagccaagatcatcgcgcctttggactccagcctgggcaacaaagcgagactcggtctcaaaaaaaagcaaaacaaaacaaaaaacaaggccaggcgtggtgtctcacgcctgtaatccccgcactctgggaggctgaggtgggtggatcccctgaggtcaggagttcaagaccaagaccaaggttgcaggttgcagtgagccgagatccagcctgggggacagagcaagactctgtgtctcaaaaaaaaaaaaaaaaaaaaaaaaagtaatgcaaaagcaaagatgtggaattcaggaaataagaggatctaacacagtatgaggcaaaaggaattcctgggatgatggtgaagaaaaagcccaagaagacatcagtgcagcaacatggagagcaacacgcttaaagtggaataatgtcagagggctcagggagcaatttcttcaagatgaaagtgacagaatatctagaatacctgaacacactgaaagaagatgatctgggaaacaaaatgttcagcaggaaaggcaaggtaacacagtaacatagctgagctgtgaagagcatttatacagtccttaaaatctattttttttttttgagacggagtcttgctctggcaagactggagtgcagtggcgcgatctcggctcactgcaagctccacctcccgggttcacaccattctcctgcctcagcctcccgagtagctgggactacaggcgcccgccaccacgcccagccagttttttgtatttttagtagagctggggtttcaccatgttagccaggatggtctcgatttcctgacctcgttatccacctgccttggcctcccaaagtgctgggattacaggcgtgagccaccgcgcccagccaacagtccttaaaatcttacaatgtaaaccctgaatacaatctaaccaaaattctaccataactactagtgaggagtttggagagcagaaaatgtgcatgtttgtggtgggagtaagggagtgaggagagaggtaaatcttcggcttccgtggtttatggttaataagtaaggcctaaatccaatacaccaggcagtaccaattagaggctgagacaggagaattgcctaaggccaaaaattgaagaccagcctgggcaatatagggacaccccatccctaaaaaaaaaaagttttttgccaggcacagaggctcacgcctataattccagcactttgggaggccgaggtgggcagatcacctgagatcaggagttcaagatcagactgaccaacatggtgaaattatgtttctactaaaaatataaaaattagccaggtgtggtggcgcatgcctgtagtcccagctacttaggaggctaaggcatgaaaattgcttgaacccggtaggtggaggttgcagtgagctaaaattgtgccactgcactccagcctgggtgacagagacagattctgtctcaaaaaaataaaataaaataaataaataaataaatttaatggccaagcacagtggctaatgcatataatcccagctccttgggaggctgacgttggaagaatgcttgagcctaggagttcaaggctgcagtgagctatgactataccactgtactccagcctaggcaggagagtaagaccttgtctcaagaaaaatacaaaaacacaatgaaaccaaaggctgggcatcatggctcacgcctgtaatcccaacactctgggaggccgagctgaggcaagaggactgcttgaggtcaggacttcaagaccagcctgggaaacaaaatgacaccctgtcttcacacaaaataaaataatcggctagccttggtggcatgcacctgtagtccaagctacttggaaggctgaagtggaaggatcacccaggaatttgaggttgcagtgacctatgattgtgcccatgcactccagccaggatgacagagtgagaacctgtctctaaaaaaaaaaaaaaacataaataaatatctaaataaaaaagaaggctgggggcaatggctcacatttgtaatcccagcacttagggaggccgaggcagatggatcacctgaggtcaggagttcgagaccagcctggccaacatggtgaaaccccgactctactaaatacaaaaatcagctgggcatggtggcaggggcctgtaatcccagctacaagggaggctgaggcaggagaatcacttgaacccaggaggcagaggttgcagtcagccaagatcgcaccattgcactccagcctgggggtcaagagcgagactccatctcaatcaatcaatcaataagtaaaaagagttgagaaaaagtatataggctgggcctgggcgacaagagcgaaactccatctcaatacatacatacatacatacatacatacatacagacacagacacacacaaacacacacacacacacacacacacatacatgcatacatacaaacacaaaattgagaaaaagtatataggctgggcacggtggcttatgcctgcaatcctagcctctgggaagccaaaactggtggatcacttgaggtcagaagttcaagaccagcctggccaacatggtgaaacccgtatctactaaaaatacaaaaaattagctgagcgtggtgggcacgcctgtaatctcagctatttgggaggctgaggcaggagaatcacttgaacccgggaggcggaagctgcagtgagccaagatcatgccactatactcctgcactccagcctgggtgacagtgcaagattatgtctgaccaaaaaaacaaaacaaaacaaaaacccaaagcatgtaagtggaatactgcatatcatttctagaaagttcaagaaagagaattattacagggaaacatggatttgtggaatcttttaagaggatgaagatactccagaggaacgtaatgaatgaatcaatgtccctgaaaaggcaacaggggaattaatctagtatataagtaggagaaattagctttagataaaagaaggttcttcttttctttgagaataacaagagaaaagaacagatatgtgttggtgaggtgcctggatagtgcatgcaggaaacactcactttaatgatgttgtcaggagctctgttcatgttgaggttcttgattctcactgtcagttggcgggcagtcttgcaggttagaaggtacttgctgattagagggttaagaaactcagtcccttcaaaatgcttcagtcctaaagctaacaaactgagaaaggagcaataacactaaatctcacttcacagtccttccttctaaagggcctccccagactaacacattttacaatctactttttcttacttgttcttaaaacaaggtctcactctgtcacctgggctggagtgcagtggcgtgatcgcagcccactgcagctgctacttcctaagctgaagcgattctccagtctcagcctcccaaagtgctgagattacaggcatgagcccatggcgtgtggcccaatctactttttcatttttttcagacagggttttgctctgttgtccaggctggagagcagtggcatgattacagtgcactgcagtcttgaatgcctgggttcaatcgattcccgcacttcagcctcctgagtatctgtggctataaacgtttgctaccatgcctaactaatgttttatttcattatttgtagagaccagttctcactttgttgcctaggctgatcttgaacttctggcctcaagtgatcctcctgcctcggcctcccaaagtgtcgtcattacaggtgtgagccaccatggctggccaatctactttttctacaactaattcttgtagtgactactacaagttggtgactactcagtagaaaatttcaggtatttagtgagtagtgattaagtactatgaataagaatcaaatagttcacaattaagtaggagcaagagaaactagtcataaatcatcaataaatgtcagatcatgatgagctgtatattaacaacacaaaggaagttcaaagagaatacatgggaaggagaatgattctaataaaacaaatataaaatgaataataggtaccccgtcagacaaattaaactggcaccaatactaccctctaacataacatatataatcatggttacatatatacatatttgctgttaacagtgtggcaatacacacaaagggccataaaaatgttcataatctagctgggtgtggtggcttatgcctatagtcccagcactttgggaggccaggagtgggaggatcatttgaggtcaggaattcaagagcagcctgggcaacacagagataccctcacctgtacaaaaaaaatcagccatgtatggtggcacacgcttgtggtcccagctactccatggaggctgaggcaggaggatcacttgatcccaggagttcaaggctgcagtgagctgtgattgcaacactgtactccagcctgggtgacagagtaagatcctgtctctaaataaataataacattagaaaagccaacctcctgccttggcctttcaaagtgctgggattacaggtgggagccgccatgtccagtctaaaacattttaaaaatgtgtgtaacatccccccaaaaagcagtatttggcactgctagaacaagcacgttctagaggactctgctcatctatactgcttttccttttgtgtccatgtcttattatacaagtcttacttcccctaaactcctcaaaggaactacatcttctccttgggatatttgatcccccagagtaaacacttacttgtcctcagccttggtgaagaggatcttatcctggggattctttgccttcagggaacacactggaagtaactctggatacatgaaaaccttgcttgtggccaggatccaagccacttgctttggcaaacagggaaattcattggctataagaaaataaatctctgataaatcaacttctaggaaaaaagagggcttcaaaaagcctgtgaatgcatttttgcatttaggtagagctgtccttatctaacttgattccctcccatctgcctaccactccccaaagagtttccacagtctttcctcaactaacattaggtctaaagggagtcccattcactggcaataaaagttgactttttttttttttttttttagacggagtctggctctgtcgcccagactggagtgcgtggcgcaatcttggctcactgcaagctccgcctcccgggttcaggccattctcctgcctcagcctcctgagtagctgggactacaggcgcctgccaccacgcctggctgattttttgtatttttagtagagacggggtttcactgtagacaggatggtcttgatctcctgaccttgtcatccgacagcctcggcctcctaaagtgttggattacaggcgtaagccacggcgcccggcctctcttactctttcttacgtgtaacactttattcacaaagtaaaacaaacacttaaaaagtacctagtaatacctgtcacatagtgtatgctcaaaaatgttttacctcctttcccctttaaatctctgaaggataacagaccttcaacaatgcttttttcttccaggataagattccaggccaggcgtgctggctcacgcctgtaatcccagcactttgggaggccgaggcaggtggatcacctgaggtcaggagttcaagaccagcctggccaacatagtgaaaccccatctctaccaaaaatgtaaaaattagccaggcatggtggcacgcacctgtaattccagctacttgggaggctgaggcaggagaattgtttgaacctgggaggcggaggttgcagtgagccgagatcaccccactgcactccagcctaggtgacagagcgagactccatcttaaaaaaaaaaaaaagaaaaaagattccaacttctttaatctccctcacaaacctggtattccaaattttacttttatttcattctttcttaactttcattaagttctcccagattcctcctgaggttgggaacaaaagaaccataaaaggaatgagacaattcagtctcattcatttctgtctccctctctcagcctctcaattttaggcacctctgcatttctagagacaaaactactatatccatatttctccttccataagtgtcatttttatatctccagaagaaaaacacaggacactagatgtgtaagataatactataatttggtattaaatcacgttttcattaccatttcatataatatagctattaaagtagtttgggatctgtgtctatgatatagtacacttaaattcaactacattcaatgtaatgataagacttagggatttaaaatagaatccaaagacaaacccaaatccagaacaaaccacaactaatttgctaagtcagcaaacaaatcagaagtaaatatttggcttaagtaaatagcaaatattttctcaaaaaatactaaaccaatgcaaggtagaatctaaaccggcaaatttctttaaaatactgaacacggcaaatgtacaatctctaatttacgcctaacttgcaagtcaacatttcattcagaatggagatatcacctatgctacaatcattatggtaaataaagttagttgatcttaatgaagagaataaaaagctaaacatgaccgaactttaccacctgactttcatctttaccaggccccagtttatcttgatctgattcctaatacttacccctcatattgctgtagtccaattcttagcactgagcctcagatctctacctcccatattcctatactgtccactgcctccatgccttacccaggcccggagattatcatgtaattctagaacttggataatgagtacaaagggaggataaaagagagaaggaagaaattacaaatgtcctgtgtcctccattcctaggcaagtatcctaggaagttatctatgggataagattcccaccacctctcaccgcaagtaaaaacttaaagctgacacatctgtctcctaccagtcttcttgacagttttatgagggctgcagtcaatgctgacatgtgtgctgaagtcttcaatcagctgcatagctcccatcaagttacagggttggaacagggtctgaaacttggggttgtactgatggtgaagggcgatggagctttgagcaaaggttcccagctctttctgggaaaacacgacacaaggaagatctaagacaattccagacaattaataccaatagccttcagaatctaaatgagaagctgaccttcctactacaggataaaaacaggtaaaaataatcataaagtctttcacaataaactactgttaagattatgcctgagttctcagatattcagggattatattcttgttttatttttaaactgtttctcactaaggaatacatggtctagctcccgagctagaattaagagtctcaagaatggggactattactttaatttaattaattaatttattttgagacatggtctcactctgccgctcaggctggactgcagtggcatgatctcagctcactgcaaactccccctcccaggctcaagccatcctcccactgcctcctgagaagctgggactataggcatacacctccaaacctagctgatttttgtattttttgcagagacagcgttttcccatcttggccaggctgatctcgaactcctgggctcacaatccgcctgcctcggcctctcatagtgctgggattacagggatgagtcacctcacccgaccaggaccattacttttaaaattgttttgtcttttggtctcagaataatgcctacaaccaagtactcctcatcctcctctgaatacagtaagagatgaagacatcctgttgatcaccaaggaagttttagaatactagcaaatgtactcttcaaaatccaaagaagacttactgaagaagctgagagtattatcattacctgtccaaaagtttgaggcaatttttatgaggtaaagtatggttttgtttttgtgagacaggttctcactctgtcacccaggctggagtgatatataagcacggctccctacagtctcaacgtcccaggctcaagtgatcctcctacctcagtctcccaagttgctgggactacaggcactcggcaccatccccagctaatttttttattttttatttttttggtagggatggggtcttactatgttgcccaggctggtctcaaactcctgggctcaagcaatcctcccaccttgacctaccaaagtgctgggactacaggcatgagccaccatacctggccaaatttcaaatttaaaatctcaaaataggccgggcgcggtggctcacgcctgtaatcccagcactttgggaggccgaggtgggcggatcacgaggtcaggagatcgagaccatcccggctaaaacggtgaaaccccgtctctactaaaaatacaaaaaattagccgggcatagtggcgggtgcctgtagtcccagctacttgggaggctgaggcaagagaatggcgtgaacccgggaggcggagcttgcagtgagccgagatcccgccactgcactccagcctgggcgacagagcgagactccgtctcaaaaaaaaaaaaaaaaaaaaaaaaagctcaaaatacctcaaaacgtcatgagcaaaactagctctacacataaaacactaatattgagcttcatgaatggataatgaattcaacatctacatgtatatttacttcattatttaaattaaaacaaaacaaaacaaaaaaaacacagaccgggtcttactatgttgcccaggctgttcttgaccactgggctcaagtgatcctatcacctcagcctcccaaagtgctggaattacaggtgtgagccactatgcccagcctcaacatctatgaaatgaatagcggtaccaaaaacctaagaagtcagggtgaatctaaagatgaggaggaggacccaataaaaatatcagaaggacaggccaggcgcagtggctcatggctgtaatcccagtactttgggaggtagaggtgggcagatcacttgaagtcaggaattcgagaccagcctggccaacatggcaaaaccctgtctctactaaaaatacaaaaaaaattacccgtggtggtgcccgcctgtagtcccagctacttgggaggctgaggcaggagaatcacttgaacccgggaggcaggggttgcagtgaactgaaattgttccaccgcactccatcctgggtgaaagagcaagaccctgtctcaaaaaagaaaagaaaaaattgaatacactctttgtcctttcatgtgaatcagtggcttatgttcactcagcaaacataggaagccacagcaatcaaaaatacctgagagaataactgtgagaaataacctgccaagctaattttatattctagtctatagaattacggcaatttggaaacttacaagacatatcctggtgctactggcctccggattgagattggggttgcaggtggcaagaaggtggatttgtgtcaagagctgaacatgctggggagagaaagaaaataatgcagtgatatgttatgacactgccatttcaggagcccagagatatttttttttccccctggagacagggtcttgctctgtcacacagcttggagtgcagtggtgcaaccatgactcaatgccctctcaaccacctgtgctcaagcaatcttcccacctcagcctcccaagtagctgtgaccacaatgcctggctaatttattttattattattattattattatttttagacagagtctcgcactgacttttgggctggagtgcaatggcgtgatctcggctcactgtaacctctgcctcccaggttcaagtgattctcttgcctcaacctcccgagtagctgggattacaggtgcccgccgccacacccagctaattttttgttttcgtagagacggggtttcaccatgttggccaggcttgcctcaaactcctgacctcatgattcacccgccttggcctcccaaagtgctgggattacaggtgtgagccactgtgcccagccttatttttattttttgtagagacagagtctcactatgttgtccaggctgcttttgaactcccctgctcaagcaatcctcccacctcagcctcccaaagtgctgggattacatgtgtgagccactgcacccagccaccagagagtcattaactaagatgtttgcaactttatgacacaaattttgctttctgcaaagagtgtgagaacaacgtaggatcttggcataaatttctcagacatgttcccttgaacaaaatgacagaaccagaggaagtttaacctctaaacagaggaggaactgagattagaaaaggaaaaggccgggcgcagtgactcacgcgtgtaatcccagcactctgggaggccgaggcgggtggatcacgaggttaggagatcgagaccatcctggctaacacagtgaaccctgtctctactaaaaatacaaaaaattagctgggtgtggtggcgagtccctgtagtcacagctactcgggaggctgaggcaggagaatggcgtgaacccgggaggcagagcttgcagtgagctgagattgagccactgcactccagcctgggtgacagagcgagactacgtctcaaaaaaaaaagaaaaaagaaaagggaaaagggaaaaaaaactacttgtcacagtgaaggttaaatttcagaatagattactgaggactctttgaaatctgtaattccgaataccattagggtccttatgtgctgtcttccctgagccacaggacatgaacatgatgacttctcaagctcctaactgatgtgaagatactacggttttaatacgtagtaaggtaactatctctgacatttacaaagctgctaattttagattataccaaagcctcagagttaggccttggtataattcaatattaatatgaccaaggaaagtgttacctgctgcatctgctgctggagtctcttcctttgtgctgggtccagaatcagggtctgatgaacttccttacactggggtttaaccttctctacctccttctgctgtttggctgaaggtttcttcatcttcagctgttcaaatagttccttcgctatctgatgttgttcatttagtaggttggccagtagttcctcaaacctatcccaaacggggatgactgaatttgagtgttttcctaggtccacaacacatccaattctttgcaatgatgagcaaagagcctgaacaattttcattccctactaatccccccttttcactttagccaacagtcaaactcccagccttacacaaatcttttcccaaagtagttagcatgcatcaaatgattctgtattacaccccatcccattcctctacaattcctcttccaaataatatacaaatgaagaaaaaattaaacaaaaaactagggacagagaaatatatgggtaagaaagcagccaaggagctggtgggaactcatcattctcatttcttctctcattacttgttactccctgggatgttactcccatcccaggtccagcttgtcccattatcctatctactcaggctgcactgccctgctttcttaacaagtcaaagactttctagcatgaagcaggaaaaggatataccaaaataactgaagtacatggtagttcaaatgaacagaacggagaagttagttaaaatattatccatgaaggctatcttcttttagccctttaaattcctcttccaaggttcctaaccctaacttcccatccataccctcctgaaagattgtttgcagggctgaagcaaaaattccaatacctagcatgtcagttctatgtatgattactataccttttctatgtttacatagaaagaaataaagggagaataatatacctaaatgattaagcatatgctgataccctatgcaacaggataagatctgctgaagtagctataacaagcaggttatcatatttcaaggaaccccctatattacagcaatagttaaatggtaacgtttttcaatagtttttgcagataaagattacgtttgaataagttttcttttatagtatttactgtaggtttgggtagcacagagtaaaaacctgaagaccgtgggactgtctatacaatctttactgagaactgaaaatttgaacatccgcgctaccaccactgaaggaacagaagagaagaagcataaaaaagtagaaaatggaaacatagcctgcacttagttttaacaaggattatttaggtaattgataagggaagccccagagtttttgttttgactgtctttttctcctctctcttccttattgtgttttaagatgtgcttactctctatggacttacagagggatttttatttagtcaaagattaaaacaaaaacaggtttgtatttgcaatcgaaagagaagcagaagctgcccaagtacagtcatgcgccacagaatgtttcagtcaataacgaaccacatagtcagaggtggctccataagattactgtaccttttctatgtttacatacatatgtacttaccattgtgttacaactgcctacagtattcagtacagtacagtaacacactgtacaggttttgtagcctgggagcaataggtatgcagtaggctaaaccatttaggtttatgtaagtacattctacgatgtttacacaatgatgaatcgtttaatgatagatttcacagagggtatgaccatgagatgatatatgactatattccattgaataccagaaggtaactggattctaacaggaattttaaattagttctatattttccaaattttaagaagttataaagagttgatcagcaaaaccaaaatatttattaatcagatcctattatacgttcccaggatgaatggttccattctgctataccagaattttgttctatgaactataaattaaaataatgggtcaaatactgacttagcaatcttgagatttttgatgtagttgtattgtgatatttgttgtaatggagaatgactagtagttctagtttttaagacattggttggcctatcttatcttttttcactaaattggaaaatccctaaaggtctagctttcagatggaacccaagctctctgcttagtagtgctgttaagttcaaacacaggactaattacagggactattctctttgctttgttccacttatggcacaaactgcatcctgacctctcgccatcgacctaatgattatatgctgctacaacagaataaagtgcagatgcaaatccaccacaaaatgaggaaaaaattaaagcctctactttctggatgctgtaacacaagtgccaactttaggcaaaaaggtcagcacgtatgtttcagactccttactgcaggtgcttcagggtttgctccactaatgcctaggtgactaacaaattttcagtcacatttagcagatattaatggcacataaaaagaacaaaagggacagactggatattacaatatagggtagtttgtgtggctggccacattgagtcctacatacctctccagcaccactcacccggagaagtggatatggatgccagctactgttttttctcccttcccaaacagatacagcttggcctacagctgcactgccccataacaaggagacttcacttgacacctaactcctgacaggactctgcatccttacatcagtaacagaagctggctggggatgaaaaattgttaactgcaacttctgaaaaccttttcagaaataaactcttcctctattccaaatctcaaggtcttcaactagcctaccgtagagcttgaggggtgttaaagttagcttgaggctcagccacacgctcctcctcttctgggccatcatcttccatgttggagaatcccatctcatcttggaactgtgggcaaaggaaagggagggttttcctggggaatgggcttttgaatgttgctccagtgttgggaaggaaaagtgaaaactataaacaatactttaataatgctggcacccagaaagagcctacatcagaacctttctcacttcaggactcctacaaacccacatatggaatgactattatgccaggaaagaagttgctcaaccagtcaacttgtatcagtaagcacagagctaggataactcaaaatgatcaatttcttaaacagaaatatctttttagacaaatttatggaaaaggtaattatttgtgtgcaaaatactttaaaactagttggcaatctttaaggacacaccaaatgacagtaggggaagccatcaaaagttttcaaggggcaagatgtgctggctcacacctgtaattccagcactttgggaggttgaggcaggaagattacttgagcctatgagttccagaacatggcaagaccctgtctctacaaaaaaataaaataattagccgggcctgtaggtgtgtgcctgtagtcccagctactcaggaggcttagatgagagaattgttttgagccctggaggtcgaggctgctgtgagctgagatttcaccactgtattctccagagcctgggtgacagagcaagactttgcctcaaaaaaaaaaaaaaaaagcttcaaggaaaattttagtaagaataacctacatgtggataatcaagagtctagcagttagcaaatttcttttgtcattatattctttcccaggtagactaaaaggagaattggttcagtccctcttctagaaggagcatcacagagatcaaaggacacattttgttggagaaccaacttacaatcccatgttctcacttgaggatcattactcacagtttcaaacagatcttccatcagctcatttgcttccttttctgcaaaaaagccaaacgttgttggtataaattagattcattttacaatatggaggaattccatgtagacaatgtatgatgttttcaacaaggcatctgacgaattcttcatatctatccttattcctgagacagggtctcactctgtcacccgggctggagggcagtggcttgatctcggctcactgcaatctctgcttcccaggctcaagcgatcctcccacttcagccctccaagtagctggggcaacaggagtgtgctgtcatgcccggctaattcttccatattttgtagagatgggttttccccatgttgcccaagctggtcttgaactcctgagctccagtgatccacccaccttggcttcccaaagtgctggggttacaggcatgagccaccacgcccagctatccttcattcatttattcaaaaacatttattgagtacttactatgtttcaatccctgttttagatgcttgggatatatgagagaatgagagagagagagagttctaatctcattgaacttaaattctaataggaagaagacaaggagaaaatgtgagctagatgatttttttttttttttgagacggagtttcgctcttgttgcccaggctggagtgcgatgacacgattttggctcactgcaacctccgcctcccaggttcaagctattctcctgcctcagcctcccaagtagctgggattacaggcatgcaccaccacgcccagctaattttgtgtttttagtagagatggggtttctccatattggtcaggctggtctcaaactcctgacctcaggtgatccgcccacctcagcctcccaaagtgctgggattacaggcatgagccaccatgaccagcccaatgattttataattagatggcctatccaaacccacacaatactgaatggaatcaagagacaagtctcccaacctgggcaaaatgtcaacatatctctaaaaaaaaatttatctgggcttggtcgcacatgcatatagtcccatatacttgagaggctgaggtgagagaatctctttgagtccaagaagcagaggctgtagtgagctgagaccgtcccactgcattccagcctgaacgacagagcaagacactgtctccaaaaaaaaaagagacagacagagacaagtttccaacagtgtttcataggactctatctttggacccgacctattcaaaaactccatcagtgaattagaagaccaagagaacatacttaacaaatctgtagatgatgtaaagctgtaaagctgaaagggactgccaatccaattgatggaaaattcagaatcatattttctcaaatcaactggatgtaacacgtaaggataaatttaaagttctacattgaggatttttttttttttttttttttaaatagagccagggacttgctatgttgcccaggctggtcttgaactcctgggctccagcgatcctcccacctcatcctcccaaagtgctgggattacagacatgagccaccccacctggcaagatcttatatgtgtattcaagatattacacaactcactaagtctccagatgaaaaccagaatctctaaatatagtttgacagtttgacaatgcccaatgacagactaaatgagaaattaggaggcagcttgatttttttttatttcctcagagatctttgttctgagttctgactcttgttctacaaatattcaaagtcgaaatgattatcatgttaatgggtaaagagcttcaaatctttggctatctcatttttttttaatttttattcatttgttttaccttatgtgttcctctacaatggttatctaggaagttaacaaccattctagctatctagcattctggttcttgatatcatgtaaaatgagcgttctgatctctgacacacaaagctatttagaagataaaaaatagacatttttttcaacaatcattttacttttttctctacatctacatactctacatgtcagagtttttgtttctgttttttcgagagtagctgggattacaggcacctgccacaacacctggataattttttgtatttttagtagagatggggtttcatcatgttggccaggttggtctccaactcctgacctcaggtgatccacctgcctcagcctcccaaagtgcagggattacaggcatgagccactgcacccagccaagtactttgattcttaatggaggatttaatccactgacatcccaaaggacaaactatccaatggaattcctggataaaacacaggcacacagtgtctcttcctcagaggaaagaaatttttgtcaacagaagaattttgctcttctgggcgtggtggctcctgcctgtaatcctagcactttgggaggctgagcctggaggatcacctgaggtcaggagttcgagaccagcctggccaacctggtgaaaccctgtctctactaaaaatacaaaaattagcctagcgtggtggctaatgcctgtaatcccagctacttgggaggctgaggcaggagaatcgcttgaacccgggagtcggaggttgcagtgagccgagattgcgccattgcactccagcctgggcgacaagagcgaaactccatctcaaaaaaaaaacaaaaaacaaaattgatttgctctagcagaaaaataattatatttcaggaattccttcaggaatcctataccagtactaaaagatcctatattggaaaatgaaaatgcccaaattaataagtcctgagatagaggagaagggatcttgttttgtccatcactgtatcttagtacctggaatagtgcttggcacataataagcattaaatacatacatggcagtcttgtttctgaaccaaaatgaggtggtttaatgaaagagatgggtttggctaggcgtggtggctcacacctgtaatcccagcactttgggaggctgaggcaggtggatcacttgaggtcaggagtatgagaacagcttggctactggctaacatggtgaaaccctgtctctactaacaatacaaaaattagccaggtgtagtggtgcgtgcctgtaaacccagctgctcaggacattgaggcaggagaatcacttgaatccgggtggcagaggctacagtgagtcaaaatcctgccactgcattccaaactgggctacagagcaagactccatctcaaaaaaaacaaaacaaaacaaaaaaaacaacaacaagtgaaatactgaaatactgatcagctttaaaaagagaactgtcataaccaccccaatttagttccaagacttaggcttccccaccaaggcaaaattaacacagtaagaaggctattccagttcattttggagaaaatcttggatttggtaagcaggtaaaaagagctgggcatgctggctcacatctgtaatcccagcaaactgggaggccaagacaggaggatggcttgaggccaggagttcaagaccagattgatctacatagcaagacctgggccaggtgcagtggctcactcctataatcccagcactttggaaggccgagacggctggagaacttgaggttaggagttcgtgaccagcctggccaacgtggggaaaccctgtctcaactaaaaatacaaaaatcagcagggcgtgttggcacgcgcctgtaatcccagctatttgggaagctgaggaaagagaatcacttgaacctgggaggcagaggttgcagtgaggcaagattgtgccattgtactccagcctgggcgaggagagcgaaactctctctcaaaaacaaaaacaaaaacaaaaaaccatagcgagacctaatctcaattaaaaaaataaagaaattgtatacacatacatgcacatatatgcacactacacacacatatcacatgtacgttttgagaaaaataacaccatgaacctactacccgttaaaaattagagaaaatattaaacttttcacaaatttacatagcattcttatacaggggccatgtcaatagaaagaaaggactatcagacaatttttcctaaaacttctccattatctcactgaatcctataatctgtcctattaaaacacctttttacatttcttgcttttttttttttttttgtgagacagagtgttgctctgatgccgaggctagagtgcagtggcatgatttcagctcactgcaacttccccctcccagttcaagcaattcttggttcaagcaattctcgtgcctcagcttcccgagtagctgggactacaggtgcactccaacacatgcagctaattttttgtattttagtagagacggggtttcaccgtgttgcccaggctggtctcgatcttctgagctctgacaatccatccgcctcgtcctcccaaagtgctaggattacaggcgtgagccaccccacctgaccaatttcttgttcttttaaaagtacagtaattatttttaagttccagtaataaattaatgggtagtctgtcaaatagctactggattttatatcaggagggctttctacatgtatgtatacccaaaaatgacattaagacctttttacataaactcactgtagagatacatcccaaaacaaggtaaggaatataaatgatgtttaccttcttttcaaaccaacagttcctttatacaaaaacaccagatgatacaaaacatatttttttaaagtacaaagttccatacagaataaaataaacactttatggttattcctaagaataagtagtgacaaaaagtctttgcaattgggtaataaaatttcagcttctaggaatatgtttccctcttccttgtccttttgagagctgccactatcacacaattcacagcatctcttcaaccacagaaaattagcgtctcttcaagcacagagaccatatattaattatctttgtgtctcctgcataggattaactcagtgtttgttataactaagttaaactccaagacaggagcttcaaatcacctcaggcccaatccaaaactgaaaaaaagacgcttctcagagtttgagaacaaaaagatactgacaaagaacaaagccatagatacttgtgcgacattagcttccctttttaccaaatacagagtcatttactaatactgcagaaatgtttgcagacgataaaaagaataaattaaaaatatggatcctgtcaacatgttcaaatactaacatagactccttcaccttaaactcatactaacatccacacacccgaacaatgaaaatgaaaggttttcaaatgagatctaaatataaattggctctatttcattacagtttaagttcctaaaatcatatatataaatcatgtgattgcgcttatgctcatcttctaacttgagggcccagtgtctttcatccgattctctgaaggataagtgaccccaaaaaacttttaagaaccactaatctagcctatcaagaaacatcccattttccagaagaatacagctaagttggcttagttcatgcattcttacctcatattcatagagttcatagacgggatccttactacatgaaatcagtcttttttttttttttttttttttttttggagatggagtctcctctgtggcccaggctggagtgcagtggcgcaatctcagctcactgcaagctctgcctcccgggttcacgccattctcctgcctcagcctccccgagtagctgggactacaggcgcccgccaccacgcccggctaattttttgtatttttagtagagacggggtttcatcctgttagccaggatagtctcgatctcctgacctcgtgattcgatctcctgacctcgtgatccgcccacctcggcctcccaaagtgctgggattacaggtgtgagccaccgcgccctgccgaaatcagtctttcaaaggattccttcagcccagccaagaagttccaacatccacaggcacatatattaacaattaccagtacccaaaaacagttctctggttttaattccacactgcctccctcaacttaatacctaccaccgtcaaaacaactcccctcagattgcatccaggctatttacagagacaccttgatgatcctcacctcaaggcatggaccattcattgaatggttatatttgttgaatgagtgaaaaaggatccttcctcccacagatttcaagttaagctgtcagcacccatgcagctgctctggtacaagttaagctgtgaaagccttctccctcacgcatacaaccttaagtgtcagaaatgctctgcttcctccataaatccaaaataatatagccatggatatgcatttcatacaggtcagactcggcaaggacagctacgttccacatacatatctgacacaatcggtctcccccaaatacaagccaaccagtcttatgtgctcctatctttccagcatactcagatttgccgacaaagacttcctgaggcaccatggtatgctgaatatactgctgcagtagtagtgaaaatatgggagttacagttccaactttgtcaccaatttaacatgcggccttggagaagttctctccttatgcctaaatttcctattttgtaaaatggaagaaagcatcctaccattttcacagagattcagtatcacaaagaaactgaaagagctttcttattgtattgtaaactattactataaacccgcgacaacaaataaggccacccattctttacagctttgtagcaatgattctgttaaagatattttggcccttcacatttacacaactcactctaaccaaaggcacaaactattcttaagaccacaactggctatgccaagtttctcccctccctgacctcacagacacatgctgtacagaacactaccattgccgctctttcccaacaagtaactaggggctcccaatccctaaaatacacacacatatcaacctgcaaggaacctcccaacatttattcaagaaataagctaacttataaggggaactccattacacttacacaaataaaggcaaactcttacggaaacacttgccatcctcacatacacacaccaacacagccgctacacaccaacagaccatctgtctgctagaccaaaaacatctctttccatgtacaaactaaccagtgacatttattaaacgtacaacactgagatcatcctgtcgttcccacataccgttcaacgcggcagggacaccacagaccttgtcacacaggtaaaatcccctctcaagatcgtgtcctcgaccactcttatcccttaattaaacacacacaaactggactatgggggaggctccgatcatgcctacaaacacaaactaacctgtcaggggcacagccgactccgcctccactcgcttacttcccagccccctccgggagtctgcctgtcagggacaccccttcaccccgcctggagggacttcccggtaggctcaggatccccctccctgctctcccctcccccatcttcaccactgctctcccagaggtccaggtccgggagatgacagtggctcccagaaagcccaggattcaatcgctgagagagtgcttaggcccgaatgccggcccaaatcgttctactcaccgtgtcggaggccgagagcgatgagagtacagggaagtgaggaagagggggtggccgccaggctcctccgcttccctgggtccaccgcggatccctcccgcttgtcaggaggcggccagcgggtaagccgactggcggaaatgcgagagaggagaagggaaaggtggagggctaaaggggcaaactgagaggaggcggatcccgcaaccgacactgggatcgtttcccctcgcaaagcgaacccaaaatggcggcggcagcggcggcagcagagtggccgcggcagctcctccagagggagggagctaagggcgcctagcgacacccccaacctcccactcctccctcctcgcgttcttccccacggtcccccgcttcgcccgactccggccatgtagcgcgcacgtcagcccgcacgcgtacgagtgtctacgggctcgtcgctggctgctcccaccaaccaccaccttcggccgtcctgcgagccagccatcccgtacgcgctcacccacgggaacctcctcgcccagttctccactccccctcagaccctgtcaagccggctccagcgcaggccctcacgcgtaccttcagcggcgcgagcccaagccttctccacctcctcttctctcctccccctccctccccgcccgcacggccaccaaccgccgccaaagcagccgccgccagcacccccaccctac

SEQ ID NO: 709 - DNA, 29336 bp, Homo sapiens
tcaatgaaacaatgaagcaataaaagcacagatttattgaagcaaaagtatattccacagagtgggagcaggctaaagcaagctgctcaagagccccagttgcaaaatctggggtttaagtaccctttaggggtttcctattggttacaccctatgcgccaccaatcggaggccgaagtgaaggctcccagtctccagactcttattctcctagctcaaagaaatccactgatttcctctgtagcatcttcaggttccatcttgacaacttcctctaaatccccaggggaagagttgtttagagactcctggatgccctgagggagcggctccagagcttgccttccctcctctgttttcacaacggtccagcgataggcactgttctctgacaatccttcttggcactgtttatcgactggtggaggccctgggctatgttccactttggggaaaacagtagcagagagaggagatagttcctggggctctaatttgggttctaggccctgaaaggcattttccccatcagccacagcacaagcaatgtccacattcatgtgggccttatcttcaggggtggatggtataggaagattcacagaattgccagaaacaattaagggtgagacagaggaggccacaaggggctggttcaatggacaggggaaggaagtagggttaaccaagagggtggcgatgggaatagtctggggactctgggccacagccgcattgacaggctggatcatgttacagccaccgccaaggctcacaatcttcacagtggtagcaggaacagtgaagataacagatgcagggtggataacaggggcaggtttgatacagcgaaaggccctggctccccttctttttgagggtctccgtctcacatatggctttcgaaacatggaagaggcaggggagggcatcattaccttgggcacaggggcagaagagagcaaagtctgggactcagacagagggaagcttgtcctggcctcagggggcatagcaggcagtgctgcaggagactcaaaactctcacctccactgacccccagtggagggacacctggaactgtctgtaaaacagtggctggctgtattgggtgaggaatccggagcaccattttgctcggaggggcttctgaatgagttgattgggctggtgttttcccagggttgaagctgggctggagagaggggctgggttggataaggaggggtttcaggactgatgaacgcttctgtctccaagccttcttggggaaacggtcggcaactggcttcagtttcaggactacacccttaggcaatagcagtgggtaccgagtttcactccccaactctgagttgtctttttctaggccttgatctgagttgatctcagtggttccagtcatatttcctacctctctagcaccatcagccatgtgccgcagttcttcctggatggatggcagactggcctattggaaatgagaacactctgatccagcacatgtcagaatttgggaaaaagaataggactttctaagtttagggacctgagacaagctcaaggcatctttccaagggactctgcatatgaaatttctacaaagaccacagtccaattatacactttagaaactcttctctgaatttcctttagcaaattaccattttacccattattttgaaaatgttgtagaatcacccggagaagggcagaaaagtaagggaagaaaggtgaatcaggaagattcctgaagtcctagttctacaactaaagcattagacgattaaggaagtccttgatattctctcagaactttcagtgaccttctgcctcctacagacttcgaggaagagggctgtacctttaaccagaatgggagccggtgttcttctctctctataggtggcttccactgatgtggctggatctcttcacagcattttcctaggactggcagctgtttggtcttcttataaaacttaacatgaaaaaaatgcgcatgaattacattccttctggaaacactgtcttctgtcaggctggtgaatggggtggtggtggatcaagagaaacacacacacacacacacacacacacacacacacaagaccacatacacaaacatccatgaacacacatatacgaatagcatatgctgaatacttgtacatttcaaattaaactaatctctatttaaagattttatagttattcagtattttctttttgagacggagtcttgctctgtcgcccaggatggagtgcaatggcgcgatctccgctcactgcaagctccacctcccaggttcacgccattctcctgcctcagcctccggagtagctgggactacaggtgcccgccaccacacccggctgatttttttgtatttttagtagagacagggtttcactgtgttagccaggatggtctcgatctcctgacctcgtgatccacccgcctcggcctcccaaagtgctaggattacaggcgtcagccaccgcgcccagccctattcaatattttctaactgatgatctccattctggttgccaggaaggggagagtttaggtcacagagagaaaaggaagcagatgctaagagcaatcttatgtaagatttgttcctgctcaacagctgcaaagacagcatcgtaatctataaaatggacacatcaaagactttaagcaaatgatggtgtgaagggcatcagaagggaaggaaaaaaaaaaagaccgaggcagttcagttttaagagtaaataggctggccttggtggctcacatctgtaaacccagcactttgtgaggctgaggcgggcagatcacttgagattgagagtttgagaccagcctggccaacatggtgaaactccatctctactaaaaatacaaaaattagctgggtgtggtggtgggtgcctgtaatcccagttacttgggaggctggggcaaaagaatcgcttgaacctggcagtgggggtggtagggtggagattgcagtgagccaagatcatgccactgcactccagcgttggtaacagggtgagactccatctcaaaaaaaaaaaaagaagataagaactgaacttaaaccatgacaataagcatctgttcatccaacatgatgaacataagatgttttctatatcctaggcactgtgctaaaagctaagcacacacataagggaagcaattcctgctctcatggagcttacagactagtgggagagtcaagtggacaaatggcatcctacattaaaaaatgtacaaagggctgggcatggtggctcatgcctgtaatgccagcactttgggagaacgaggaggatggatcactggaggtcaggagttcatgaccagcctggccaacatggcgaaaccctgtctctaataaagtacaaaaaaaaattagctgggtgtggtggtgcacgcctgtgatcctagctacttggcaggctgaggcaggagaatcacttgaactgaggaattaagaggttgcagtgagccaagactgcaccactgcactccagcctgggcaacagagcaagactccaaccccgacaccccgccccatcccccaacaaaagtacaaaggtgtgcacgaaaaatgacacaaaactaaaacttaaacacaaattacttctggccaggcgtggtggcttatgcctgtaatcccagcactttgggaggccgaggcaggcagatcacaaggtcaggagatcaagaccatcctggccaacatggtgaaaccccatctctactaaaaatacaaaaattagctaagtgtggtggcgcgtgcctgtaatctcagctactcgggaggctgaggcacgagaatcacttgaacccaggaggtggagagtgcagtgggccgacatcacgccactgcactccagcctggcaacagagtgagactccatctcaaaaaaaaaaaaaaaaattatttctgcagaagaataaggtttatcacgtgtgccttaaaaccatggatacgccaggcatggtggcccacacctgtaatcccagcactctgggaggctgaggtgggtgggtcacgaggtcaggagtttgagaccagcctgaccaacaaggtgaaaccccgtctctactaaaaatacaaaaattagcagggtgtggtggtgagcgcctgtagtcccagctcctcgggacgctgaaacaggacaattgcttgaacctgggaggcagaggttccagtgagccaagatcacgccattgcactccagcctgggcaatggagcgagactctgtctcaaaacaaacaaacaaacaaaaacaaaaagaaagtactttttaaaaaaccatggataaaaatagacaaatactaaggcatattatcatgcattttcaaaatattgaagccaaaggaaaaatcctgcatgctgtcagaggttgagaaaaacaggtgttacacaaagactcaagagttaaatggggccatggctcatgcctataatcccattactttgggaggccaagacaggacgagcacttgaggccaggagtttgagaccagcctggccaacataacgagaccatgtcttaaaaaaaaaaaaaaaaaaaattagctgggcatagtggtgcacaccgggttggagacaccagtgagccatgatttagccacgctccaaactgggcaacagggtgggaccctgtctcggaaaaaaaaaaaaaaagttaaatggcatgaaatttcttaacaccacactaggagttagaagaaaatgaagtgaggcccttaaaagcttcttaaaaaaattatttcctatctagaattctagatacagtgacagaggagagtattattttttccttttattttgaaataattatattcataggaaattgcaaaaaatagtaccaagaggtcccatgtacccttcaaccagtttctcccaatataatgtttttatgttacatagaaacaagagctatacatataaacaaggtacacagtacaatattactaccaggaaactggccagacatggaggatgtggtggctcatgcctgtaatcccagcactatgggaggccaaggtgggcagatcacttgaggtcaggggttcgagatcacctggccaacatggcaaaaccccatctctactaaaaatacaaaaattagctgggtgtggtggctaatcccagctactcaggaggctgaggcaggagaatcgcttgaacccaggaggcagaggctgcagtgagcaacagtgagactctgtctcaaaaaaagaaaaaaaataaaacaaaaacaaaaacgaggaaactgacatcgatacaatcaaaagaccatgaatggagatttttttttttttttttttaatacggagtctcgctctgtcacccaggctggagtgtagtggcgagatctcggctcactgcaagctccacctcccaggttcacgccattctcctgcctcagcctccagagtacctgggactacagacgcccgccaccacacccggctaatttttttgtacttttagtagagacggggtttcaccacattagccaggatggtctcgatttcccgacctcgtgatccacccgcctcagcctcccaaagtgctgggattacaggcgtgagccactgcgcccggccccggagatggtttaaatgtgaaaattcccttcccaagcactctccctcaggatgctactggaatggggccatgcagggtggctcatgcctataatctcagcactttgggatgctgaagcaggaggatcacttgaacccaggagtctgagaccagcctgggcaaaaaactgagacccccccacctcaattttttaaaattcagaaaaaaattttttttaaaaaaaagctactagaatgtgttccactaaagtaaagaagtaatactcacgcctgtaatcccagcactttgggagaccgaaacgggtggatcaagaggtcaggagatcaaaaccatcctggctaacatggtgaaaccctgtctctactaaaaatacaaaaaattagccaggcgtagtggcatgtgcctataatcccagctactcgggaggctgaggcaggagaattgcttgaacccgggaggcggacgttgcagtgagccaagatcatcgcgcctttggactccagcctgggcaacaaagcgagactcggtctcaaaaaaaagcaaaacaaaacaaaaaacaaggccaggcgtggtgtctcacgcctgtaatccccgcactctgggaggctgaggtgggtggatcccctgaggtcaggagttcaagaccaagaccaaggttgcaggttgcagtgagccgagatccagcctgggggacagagcaagactctgtgtctcaaaaaaaaaaaaaaaaaaaaaaaaagtaatgcaaaagcaaagatgtggaattcaggaaataagaggatctaacacagtatgaggcaaaaggaattcctgggatgatggtgaagaaaaagcccaagaagacatcagtgcagcaacatggagagcaacacgcttaaagtggaataatgtcagagggctcagggagcaatttcttcaagatgaaagtgacagaatatctagaatacctgaacacactgaaagaagatgatctgggaaacaaaatgttcagcaggaaaggcaaggtaacacagtaacatagctgagctgtgaagagcatttatacagtccttaaaatctattttttttttttgagacggagtcttgctctggcaagactggagtgcagtggcgcgatctcggctcactgcaagctccacctcccgggttcacaccattctcctgcctcagcctcccgagtagctgggactacaggcgcccgccaccacgcccagccagttttttgtatttttagtagagctggggtttcaccatgttagccaggatggtctcgatttcctgacctcgttatccacctgccttggcctcccaaagtgctgggattacaggcgtgagccaccgcgcccagccaacagtccttaaaatcttacaatgtaaaccctgaatacaatctaaccaaaattctaccataactactagtgaggagtttggagagcagaaaatgtgcatgtttgtggtgggagtaagggagtgaggagagaggtaaatcttcggcttccgtggtttatggttaataagtaaggcctaaatccaatacaccaggcagtaccaattagaggctgagacaggagaattgcctaaggccaaaaattgaagaccagcctgggcaatatagggacaccccatccctaaaaaaaaaaagttttttgccaggcacagaggctcacgcctataattccagcactttgggaggccgaggtgggcagatcacctgagatcaggagttcaagatcagactgaccaacatggtgaaattatgtttctactaaaaatataaaaattagccaggtgtggtggcgcatgcctgtagtcccagctacttaggaggctaaggcatgaaaattgcttgaacccggtaggtggaggttgcagtgagctaaaattgtgccactgcactccagcctgggtgacagagacagattctgtctcaaaaaaataaaataaaataaataaataaataaatttaatggccaagcacagtggctaatgcatataatcccagctccttgggaggctgacgttggaagaatgcttgagcctaggagttcaaggctgcagtgagctatgactataccactgtactccagcctaggcaggagagtaagaccttgtctcaagaaaaatacaaaaacacaatgaaaccaaaggctgggcatcatggctcacgcctgtaatcccaacactctgggaggccgagctgaggcaagaggactgcttgaggtcaggacttcaagaccagcctgggaaacaaaatgacaccctgtcttcacacaaaataaaataatcggctagccttggtggcatgcacctgtagtccaagctacttggaaggctgaagtggaaggatcacccaggaatttgaggttgcagtgacctatgattgtgcccatgcactccagccaggatgacagagtgagaacctgtctctaaaaaaaaaaaaaaacataaataaatatctaaataaaaaagaaggctgggggcaatggctcacatttgtaatcccagcacttagggaggccgaggcagatggatcacctgaggtcaggagttcgagaccagcctggccaacatggtgaaaccccgactctactaaatacaaaaatcagctgggcatggtggcaggggcctgtaatcccagctacaagggaggctgaggcaggagaatcacttgaacccaggaggcagaggttgcagtcagccaagatcgcaccattgcactccagcctgggggtcaagagcgagactccatctcaatcaatcaatcaataagtaaaaagagttgagaaaaagtatataggctgggcctgggcgacaagagcgaaactccatctcaatacatacatacatacatacatacatacatacagacacagacacacacaaacacacacacacacacacacacacatacatgcatacatacaaacacaaaattgagaaaaagtatataggctgggcacggtggcttatgcctgcaatcctagcctctgggaagccaaaactggtggatcacttgaggtcagaagttcaagaccagcctggccaacatggtgaaacccgtatctactaaaaatacaaaaaattagctgagcgtggtgggcacgcctgtaatctcagctatttgggaggctgaggcaggagaatcacttgaacccgggaggcggaagctgcagtgagccaagatcatgccactatactcctgcactccagcctgggtgacagtgcaagattatgtctgaccaaaaaaacaaaacaaaacaaaaacccaaagcatgtaagtggaatactgcatatcatttctagaaagttcaagaaagagaattattacagggaaacatggatttgtggaatcttttaagaggatgaagatactccagaggaacgtaatgaatgaatcaatgtccctgaaaaggcaacaggggaattaatctagtatataagtaggagaaattagctttagataaaagaaggttcttcttttctttgagaataacaagagaaaagaacagatatgtgttggtgaggtgcctggatagtgcatgcaggaaacactcactttaatgatgttgtcaggagctctgttcatgttgaggttcttgattctcactgtcagttggcgggcagtcttgcaggttagaaggtacttgctgattagagggttaagaaactcagtcccttcaaaatgcttcagtcctaaagctaacaaactgagaaaggagcaataacactaaatctcacttcacagtccttccttctaaagggcctccccagactaacacattttacaatctactttttcttacttgttcttaaaacaaggtctcactctgtcacctgggctggagtgcagtggcgtgatcgcagcccactgcagctgctacttcctaagctgaagcgattctccagtctcagcctcccaaagtgctgagattacaggcatgagcccatggcgtgtggcccaatctactttttcatttttttcagacagggttttgctctgttgtccaggctggagagcagtggcatgattacagtgcactgcagtcttgaatgcctgggttcaatcgattcccgcacttcagcctcctgagtatctgtggctataaacgtttgctaccatgcctaactaatgttttatttcattatttgtagagaccagttctcactttgttgcctaggctgatcttgaacttctggcctcaagtgatcctcctgcctcggcctcccaaagtgtcgtcattacaggtgtgagccaccatggctggccaatctactttttctacaactaattcttgtagtgactactacaagttggtgactactcagtagaaaatttcaggtatttagtgagtagtgattaagtactatgaataagaatcaaatagttcacaattaagtaggagcaagagaaactagtcataaatcatcaataaatgtcagatcatgatgagctgtatattaacaacacaaaggaagttcaaagagaatacatgggaaggagaatgattctaataaaacaaatataaaatgaataataggtaccccgtcagacaaattaaactggcaccaatactaccctctaacataacatatataatcatggttacatatatacatatttgctgttaacagtgtggcaatacacacaaagggccataaaaatgttcataatctagctgggtgtggtggcttatgcctatagtcccagcactttgggaggccaggagtgggaggatcatttgaggtcaggaattcaagagcagcctgggcaacacagagataccctcacctgtacaaaaaaaatcagccatgtatggtggcacacgcttgtggtcccagctactccatggaggctgaggcaggaggatcacttgatcccaggagttcaaggctgcagtgagctgtgattgcaacactgtactccagcctgggtgacagagtaagatcctgtctctaaataaataataacattagaaaagccaacctcctgccttggcctttcaaagtgctgggattacaggtgggagccgccatgtccagtctaaaacattttaaaaatgtgtgtaacatccccccaaaaagcagtatttggcactgctagaacaagcacgttctagaggactctgctcatctatactgcttttccttttgtgtccatgtcttattatacaagtcttacttcccctaaactcctcaaaggaactacatcttctccttgggatatttgatcccccagagtaaacacttacttgtcctcagccttggtgaagaggatcttatcctggggattctttgccttcagggaacacactggaagtaactctggatacatgaaaaccttgcttgtggccaggatccaagccacttgctttggcaaacagggaaattcattggctataagaaaataaatctctgataaatcaacttctaggaaaaaagagggcttcaaaaagcctgtgaatgcatttttgcatttaggtagagctgtccttatctaacttgattccctcccatctgcctaccactccccaaagagtttccacagtctttcctcaactaacattaggtctaaagggagtcccattcactggcaataaaagttgactttttttttttttttttttagacggagtctggctctgtcgcccagactggagtgcgtggcgcaatcttggctcactgcaagctccgcctcccgggttcaggccattctcctgcctcagcctcctgagtagctgggactacaggcgcctgccaccacgcctggctgattttttgtatttttagtagagacggggtttcactgtagacaggatggtcttgatctcctgaccttgtcatccgacagcctcggcctcctaaagtgttggattacaggcgtaagccacggcgcccggcctctcttactctttcttacgtgtaacactttattcacaaagtaaaacaaacacttaaaaagtacctagtaatacctgtcacatagtgtatgctcaaaaatgttttacctcctttcccctttaaatctctgaaggataacagaccttcaacaatgcttttttcttccaggataagattccaggccaggcgtgctggctcacgcctgtaatcccagcactttgggaggccgaggcaggtggatcacctgaggtcaggagttcaagaccagcctggccaacatagtgaaaccccatctctaccaaaaatgtaaaaattagccaggcatggtggcacgcacctgtaattccagctacttgggaggctgaggcaggagaattgtttgaacctgggaggcggaggttgcagtgagccgagatcaccccactgcactccagcctaggtgacagagcgagactccatcttaaaaaaaaaaaaaagaaaaaagattccaacttctttaatctccctcacaaacctggtattccaaattttacttttatttcattctttcttaactttcattaagttctcccagattcctcctgaggttgggaacaaaagaaccataaaaggaatgagacaattcagtctcattcatttctgtctccctctctcagcctctcaattttaggcacctctgcatttctagagacaaaactactatatccatatttctccttccataagtgtcatttttatatctccagaagaaaaacacaggacactagatgtgtaagataatactataatttggtattaaatcacgttttcattaccatttcatataatatagctattaaagtagtttgggatctgtgtctatgatatagtacacttaaattcaactacattcaatgtaatgataagacttagggatttaaaatagaatccaaagacaaacccaaatccagaacaaaccacaactaatttgctaagtcagcaaacaaatcagaagtaaatatttggcttaagtaaatagcaaatattttctcaaaaaatactaaaccaatgcaaggtagaatctaaaccggcaaatttctttaaaatactgaacacggcaaatgtacaatctctaatttacgcctaacttgcaagtcaacatttcattcagaatggagatatcacctatgctacaatcattatggtaaataaagttagttgatcttaatgaagagaataaaaagctaaacatgaccgaactttaccacctgactttcatctttaccaggccccagtttatcttgatctgattcctaatacttacccctcatattgctgtagtccaattcttagcactgagcctcagatctctacctcccatattcctatactgtccactgcctccatgccttacccaggcccggagattatcatgtaattctagaacttggataatgagtacaaagggaggataaaagagagaaggaagaaattacaaatgtcctgtgtcctccattcctaggcaagtatcctaggaagttatctatgggataagattcccaccacctctcaccgcaagtaaaaacttaaagctgacacatctgtctcctaccagtcttcttgacagttttatgagggctgcagtcaatgctgacatgtgtgctgaagtcttcaatcagctgcatagctcccatcaagttacagggttggaacagggtctgaaacttggggttgtactgatggtgaagggcgatggagctttgagcaaaggttcccagctctttctgggaaaacacgacacaaggaagatctaagacaattccagacaattaataccaatagccttcagaatctaaatgagaagctgaccttcctactacaggataaaaacaggtaaaaataatcataaagtctttcacaataaactactgttaagattatgcctgagttctcagatattcagggattatattcttgttttatttttaaactgtttctcactaaggaatacatggtctagctcccgagctagaattaagagtctcaagaatggggactattactttaatttaattaattaatttattttgagacatggtctcactctgccgctcaggctggactgcagtggcatgatctcagctcactgcaaactccccctcccaggctcaagccatcctcccactgcctcctgagaagctgggactataggcatacacctccaaacctagctgatttttgtattttttgcagagacagcgttttcccatcttggccaggctgatctcgaactcctgggctcacaatccgcctgcctcggcctctcatagtgctgggattacagggatgagtcacctcacccgaccaggaccattacttttaaaattgttttgtcttttggtctcagaataatgcctacaaccaagtactcctcatcctcctctgaatacagtaagagatgaagacatcctgttgatcaccaaggaagttttagaatactagcaaatgtactcttcaaaatccaaagaagacttactgaagaagctgagagtattatcattacctgtccaaaagtttgaggcaatttttatgaggtaaagtatggttttgtttttgtgagacaggttctcactctgtcacccaggctggagtgatatataagcacggctccctacagtctcaacgtcccaggctcaagtgatcctcctacctcagtctcccaagttgctgggactacaggcactcggcaccatccccagctaatttttttattttttatttttttggtagggatggggtcttactatgttgcccaggctggtctcaaactcctgggctcaagcaatcctcccaccttgacctaccaaagtgctgggactacaggcatgagccaccatacctggccaaatttcaaatttaaaatctcaaaataggccgggcgcggtggctcacgcctgtaatcccagcactttgggaggccgaggtgggcggatcacgaggtcaggagatcgagaccatcccggctaaaacggtgaaaccccgtctctactaaaaatacaaaaaattagccgggcatagtggcgggtgcctgtagtcccagctacttgggaggctgaggcaagagaatggcgtgaacccgggaggcggagcttgcagtgagccgagatcccgccactgcactccagcctgggcgacagagcgagactccgtctcaaaaaaaaaaaaaaaaaaaaaaaaagctcaaaatacctcaaaacgtcatgagcaaaactagctctacacataaaacactaatattgagcttcatgaatggataatgaattcaacatctacatgtatatttacttcattatttaaattaaaacaaaacaaaacaaaaaaaacacagaccgggtcttactatgttgcccaggctgttcttgaccactgggctcaagtgatcctatcacctcagcctcccaaagtgctggaattacaggtgtgagccactatgcccagcctcaacatctatgaaatgaatagcggtaccaaaaacctaagaagtcagggtgaatctaaagatgaggaggaggacccaataaaaatatcagaaggacaggccaggcgcagtggctcatggctgtaatcccagtactttgggaggtagaggtgggcagatcacttgaagtcaggaattcgagaccagcctggccaacatggcaaaaccctgtctctactaaaaatacaaaaaaaattacccgtggtggtgcccgcctgtagtcccagctacttgggaggctgaggcaggagaatcacttgaacccgggaggcaggggttgcagtgaactgaaattgttccaccgcactccatcctgggtgaaagagcaagaccctgtctcaaaaaagaaaagaaaaaattgaatacactctttgtcctttcatgtgaatcagtggcttatgttcactcagcaaacataggaagccacagcaatcaaaaatacctgagagaataactgtgagaaataacctgccaagctaattttatattctagtctatagaattacggcaatttggaaacttacaagacatatcctggtgctactggcctccggattgagattggggttgcaggtggcaagaaggtggatttgtgtcaagagctgaacatgctggggagagaaagaaaataatgcagtgatatgttatgacactgccatttcaggagcccagagatatttttttttccccctggagacagggtcttgctctgtcacacagcttggagtgcagtggtgcaaccatgactcaatgccctctcaaccacctgtgctcaagcaatcttcccacctcagcctcccaagtagctgtgaccacaatgcctggctaatttattttattattattattattattatttttagacagagtctcgcactgacttttgggctggagtgcaatggcgtgatctcggctcactgtaacctctgcctcccaggttcaagtgattctcttgcctcaacctcccgagtagctgggattacaggtgcccgccgccacacccagctaattttttgttttcgtagagacggggtttcaccatgttggccaggcttgcctcaaactcctgacctcatgattcacccgccttggcctcccaaagtgctgggattacaggtgtgagccactgtgcccagccttatttttattttttgtagagacagagtctcactatgttgtccaggctgcttttgaactcccctgctcaagcaatcctcccacctcagcctcccaaagtgctgggattacatgtgtgagccactgcacccagccaccagagagtcattaactaagatgtttgcaactttatgacacaaattttgctttctgcaaagagtgtgagaacaacgtaggatcttggcataaatttctcagacatgttcccttgaacaaaatgacagaaccagaggaagtttaacctctaaacagaggaggaactgagattagaaaaggaaaaggccgggcgcagtgactcacgcgtgtaatcccagcactctgggaggccgaggcgggtggatcacgaggttaggagatcgagaccatcctggctaacacagtgaaccctgtctctactaaaaatacaaaaaattagctgggtgtggtggcgagtccctgtagtcacagctactcgggaggctgaggcaggagaatggcgtgaacccgggaggcagagcttgcagtgagctgagattgagccactgcactccagcctgggtgacagagcgagactacgtctcaaaaaaaaaagaaaaaagaaaagggaaaagggaaaaaaaactacttgtcacagtgaaggttaaatttcagaatagattactgaggactctttgaaatctgtaattccgaataccattagggtccttatgtgctgtcttccctgagccacaggacatgaacatgatgacttctcaagctcctaactgatgtgaagatactacggttttaatacgtagtaaggtaactatctctgacatttacaaagctgctaattttagattataccaaagcctcagagttaggccttggtataattcaatattaatatgaccaaggaaagtgttacctgctgcatctgctgctggagtctcttcctttgtgctgggtccagaatcagggtctgatgaacttccttacactggggtttaaccttctctacctccttctgctgtttggctgaaggtttcttcatcttcagctgttcaaatagttccttcgctatctgatgttgttcatttagtaggttggccagtagttcctcaaacctatcccaaacggggatgactgaatttgagtgttttcctaggtccacaacacatccaattctttgcaatgatgagcaaagagcctgaacaattttcattccctactaatccccccttttcactttagccaacagtcaaactcccagccttacacaaatcttttcccaaagtagttagcatgcatcaaatgattctgtattacaccccatcccattcctctacaattcctcttccaaataatatacaaatgaagaaaaaattaaacaaaaaactagggacagagaaatatatgggtaagaaagcagccaaggagctggtgggaactcatcattctcatttcttctctcattacttgttactccctgggatgttactcccatcccaggtccagcttgtcccattatcctatctactcaggctgcactgccctgctttcttaacaagtcaaagactttctagcatgaagcaggaaaaggatataccaaaataactgaagtacatggtagttcaaatgaacagaacggagaagttagttaaaatattatccatgaaggctatcttcttttagccctttaaattcctcttccaaggttcctaaccctaacttcccatccataccctcctgaaagattgtttgcagggctgaagcaaaaattccaatacctagcatgtcagttctatgtatgattactataccttttctatgtttacatagaaagaaataaagggagaataatatacctaaatgattaagcatatgctgataccctatgcaacaggataagatctgctgaagtagctataacaagcaggttatcatatttcaaggaaccccctatattacagcaatagttaaatggtaacgtttttcaatagtttttgcagataaagattacgtttgaataagttttcttttatagtatttactgtaggtttgggtagcacagagtaaaaacctgaagaccgtgggactgtctatacaatctttactgagaactgaaaatttgaacatccgcgctaccaccactgaaggaacagaagagaagaagcataaaaaagtagaaaatggaaacatagcctgcacttagttttaacaaggattatttaggtaattgataagggaagccccagagtttttgttttgactgtctttttctcctctctcttccttattgtgttttaagatgtgcttactctctatggacttacagagggatttttatttagtcaaagattaaaacaaaaacaggtttgtatttgcaatcgaaagagaagcagaagctgcccaagtacagtcatgcgccacagaatgtttcagtcaataacgaaccacatagtcagaggtggctccataagattactgtaccttttctatgtttacatacatatgtacttaccattgtgttacaactgcctacagtattcagtacagtacagtaacacactgtacaggttttgtagcctgggagcaataggtatgcagtaggctaaaccatttaggtttatgtaagtacattctacgatgtttacacaatgatgaatcgtttaatgatagatttcacagagggtatgaccatgagatgatatatgactatattccattgaataccagaaggtaactggattctaacaggaattttaaattagttctatattttccaaattttaagaagttataaagagttgatcagcaaaaccaaaatatttattaatcagatcctattatacgttcccaggatgaatggttccattctgctataccagaattttgttctatgaactataaattaaaataatgggtcaaatactgacttagcaatcttgagatttttgatgtagttgtattgtgatatttgttgtaatggagaatgactagtagttctagtttttaagacattggttggcctatcttatcttttttcactaaattggaaaatccctaaaggtctagctttcagatggaacccaagctctctgcttagtagtgctgttaagttcaaacacaggactaattacagggactattctctttgctttgttccacttatggcacaaactgcatcctgacctctcgccatcgacctaatgattatatgctgctacaacagaataaagtgcagatgcaaatccaccacaaaatgaggaaaaaattaaagcctctactttctggatgctgtaacacaagtgccaactttaggcaaaaaggtcagcacgtatgtttcagactccttactgcaggtgcttcagggtttgctccactaatgcctaggtgactaacaaattttcagtcacatttagcagatattaatggcacataaaaagaacaaaagggacagactggatattacaatatagggtagtttgtgtggctggccacattgagtcctacatacctctccagcaccactcacccggagaagtggatatggatgccagctactgttttttctcccttcccaaacagatacagcttggcctacagctgcactgccccataacaaggagacttcacttgacacctaactcctgacaggactctgcatccttacatcagtaacagaagctggctggggatgaaaaattgttaactgcaacttctgaaaaccttttcagaaataaactcttcctctattccaaatctcaaggtcttcaactagcctaccgtagagcttgaggggtgttaaagttagcttgaggctcagccacacgctcctcctcttctgggccatcatcttccatgttggagaatcccatctcatcttggaactgtgggcaaaggaaagggagggttttcctggggaatgggcttttgaatgttgctccagtgttgggaaggaaaagtgaaaactataaacaatactttaataatgctggcacccagaaagagcctacatcagaacctttctcacttcaggactcctacaaacccacatatggaatgactattatgccaggaaagaagttgctcaaccagtcaacttgtatcagtaagcacagagctaggataactcaaaatgatcaatttcttaaacagaaatatctttttagacaaatttatggaaaaggtaattatttgtgtgcaaaatactttaaaactagttggcaatctttaaggacacaccaaatgacagtaggggaagccatcaaaagttttcaaggggcaagatgtgctggctcacacctgtaattccagcactttgggaggttgaggcaggaagattacttgagcctatgagttccagaacatggcaagaccctgtctctacaaaaaaataaaataattagccgggcctgtaggtgtgtgcctgtagtcccagctactcaggaggcttagatgagagaattgttttgagccctggaggtcgaggctgctgtgagctgagatttcaccactgtattctccagagcctgggtgacagagcaagactttgcctcaaaaaaaaaaaaaaaaagcttcaaggaaaattttagtaagaataacctacatgtggataatcaagagtctagcagttagcaaatttcttttgtcattatattctttcccaggtagactaaaaggagaattggttcagtccctcttctagaaggagcatcacagagatcaaaggacacattttgttggagaaccaacttacaatcccatgttctcacttgaggatcattactcacagtttcaaacagatcttccatcagctcatttgcttccttttctgcaaaaaagccaaacgttgttggtataaattagattcattttacaatatggaggaattccatgtagacaatgtatgatgttttcaacaaggcatctgacgaattcttcatatctatccttattcctgagacagggtctcactctgtcacccgggctggagggcagtggcttgatctcggctcactgcaatctctgcttcccaggctcaagcgatcctcccacttcagccctccaagtagctggggcaacaggagtgtgctgtcatgcccggctaattcttccatattttgtagagatgggttttccccatgttgcccaagctggtcttgaactcctgagctccagtgatccacccaccttggcttcccaaagtgctggggttacaggcatgagccaccacgcccagctatccttcattcatttattcaaaaacatttattgagtacttactatgtttcaatccctgttttagatgcttgggatatatgagagaatgagagagagagagagttctaatctcattgaacttaaattctaataggaagaagacaaggagaaaatgtgagctagatgatttttttttttttttgagacggagtttcgctcttgttgcccaggctggagtgcgatgacacgattttggctcactgcaacctccgcctcccaggttcaagctattctcctgcctcagcctcccaagtagctgggattacaggcatgcaccaccacgcccagctaattttgtgtttttagtagagatggggtttctccatattggtcaggctggtctcaaactcctgacctcaggtgatccgcccacctcagcctcccaaagtgctgggattacaggcatgagccaccatgaccagcccaatgattttataattagatggcctatccaaacccacacaatactgaatggaatcaagagacaagtctcccaacctgggcaaaatgtcaacatatctctaaaaaaaaatttatctgggcttggtcgcacatgcatatagtcccatatacttgagaggctgaggtgagagaatctctttgagtccaagaagcagaggctgtagtgagctgagaccgtcccactgcattccagcctgaacgacagagcaagacactgtctccaaaaaaaaaagagacagacagagacaagtttccaacagtgtttcataggactctatctttggacccgacctattcaaaaactccatcagtgaattagaagaccaagagaacatacttaacaaatctgtagatgatgtaaagctgtaaagctgaaagggactgccaatccaattgatggaaaattcagaatcatattttctcaaatcaactggatgtaacacgtaaggataaatttaaagttctacattgaggatttttttttttttttttttttaaatagagccagggacttgctatgttgcccaggctggtcttgaactcctgggctccagcgatcctcccacctcatcctcccaaagtgctgggattacagacatgagccaccccacctggcaagatcttatatgtgtattcaagatattacacaactcactaagtctccagatgaaaaccagaatctctaaatatagtttgacagtttgacaatgcccaatgacagactaaatgagaaattaggaggcagcttgatttttttttatttcctcagagatctttgttctgagttctgactcttgttctacaaatattcaaagtcgaaatgattatcatgttaatgggtaaagagcttcaaatctttggctatctcatttttttttaatttttattcatttgttttaccttatgtgttcctctacaatggttatctaggaagttaacaaccattctagctatctagcattctggttcttgatatcatgtaaaatgagcgttctgatctctgacacacaaagctatttagaagataaaaaatagacatttttttcaacaatcattttacttttttctctacatctacatactctacatgtcagagtttttgtttctgttttttcgagagtagctgggattacaggcacctgccacaacacctggataattttttgtatttttagtagagatggggtttcatcatgttggccaggttggtctccaactcctgacctcaggtgatccacctgcctcagcctcccaaagtgcagggattacaggcatgagccactgcacccagccaagtactttgattcttaatggaggatttaatccactgacatcccaaaggacaaactatccaatggaattcctggataaaacacaggcacacagtgtctcttcctcagaggaaagaaatttttgtcaacagaagaattttgctcttctgggcgtggtggctcctgcctgtaatcctagcactttgggaggctgagcctggaggatcacctgaggtcaggagttcgagaccagcctggccaacctggtgaaaccctgtctctactaaaaatacaaaaattagcctagcgtggtggctaatgcctgtaatcccagctacttgggaggctgaggcaggagaatcgcttgaacccgggagtcggaggttgcagtgagccgagattgcgccattgcactccagcctgggcgacaagagcgaaactccatctcaaaaaaaaaacaaaaaacaaaattgatttgctctagcagaaaaataattatatttcaggaattccttcaggaatcctataccagtactaaaagatcctatattggaaaatgaaaatgcccaaattaataagtcctgagatagaggagaagggatcttgttttgtccatcactgtatcttagtacctggaatagtgcttggcacataataagcattaaatacatacatggcagtcttgtttctgaaccaaaatgaggtggtttaatgaaagagatgggtttggctaggcgtggtggctcacacctgtaatcccagcactttgggaggctgaggcaggtggatcacttgaggtcaggagtatgagaacagcttggctactggctaacatggtgaaaccctgtctctactaacaatacaaaaattagccaggtgtagtggtgcgtgcctgtaaacccagctgctcaggacattgaggcaggagaatcacttgaatccgggtggcagaggctacagtgagtcaaaatcctgccactgcattccaaactgggctacagagcaagactccatctcaaaaaaaacaaaacaaaacaaaaaaaacaacaacaagtgaaatactgaaatactgatcagctttaaaaagagaactgtcataaccaccccaatttagttccaagacttaggcttccccaccaaggcaaaattaacacagtaagaaggctattccagttcattttggagaaaatcttggatttggtaagcaggtaaaaagagctgggcatgctggctcacatctgtaatcccagcaaactgggaggccaagacaggaggatggcttgaggccaggagttcaagaccagattgatctacatagcaagacctgggccaggtgcagtggctcactcctataatcccagcactttggaaggccgagacggctggagaacttgaggttaggagttcgtgaccagcctggccaacgtggggaaaccctgtctcaactaaaaatacaaaaatcagcagggcgtgttggcacgcgcctgtaatcccagctatttgggaagctgaggaaagagaatcacttgaacctgggaggcagaggttgcagtgaggcaagattgtgccattgtactccagcctgggcgaggagagcgaaactctctctcaaaaacaaaaacaaaaacaaaaaaccatagcgagacctaatctcaattaaaaaaataaagaaattgtatacacatacatgcacatatatgcacactacacacacatatcacatgtacgttttgagaaaaataacaccatgaacctactacccgttaaaaattagagaaaatattaaacttttcacaaatttacatagcattcttatacaggggccatgtcaatagaaagaaaggactatcagacaatttttcctaaaacttctccattatctcactgaatcctataatctgtcctattaaaacacctttttacatttcttgcttttttttttttttttgtgagacagagtgttgctctgatgccgaggctagagtgcagtggcatgatttcagctcactgcaacttccccctcccagttcaagcaattcttggttcaagcaattctcgtgcctcagcttcccgagtagctgggactacaggtgcactccaacacatgcagctaattttttgtattttagtagagacggggtttcaccgtgttgcccaggctggtctcgatcttctgagctctgacaatccatccgcctcgtcctcccaaagtgctaggattacaggcgtgagccaccccacctgaccaatttcttgttcttttaaaagtacagtaattatttttaagttccagtaataaattaatgggtagtctgtcaaatagctactggattttatatcaggagggctttctacatgtatgtatacccaaaaatgacattaagacctttttacataaactcactgtagagatacatcccaaaacaaggtaaggaatataaatgatgtttaccttcttttcaaaccaacagttcctttatacaaaaacaccagatgatacaaaacatatttttttaaagtacaaagttccatacagaataaaataaacactttatggttattcctaagaataagtagtgacaaaaagtctttgcaattgggtaataaaatttcagcttctaggaatatgtttccctcttccttgtccttttgagagctgccactatcacacaattcacagcatctcttcaaccacagaaaattagcgtctcttcaagcacagagaccatatattaattatctttgtgtctcctgcataggattaactcagtgtttgttataactaagttaaactccaagacaggagcttcaaatcacctcaggcccaatccaaaactgaaaaaaagacgcttctcagagtttgagaacaaaaagatactgacaaagaacaaagccatagatacttgtgcgacattagcttccctttttaccaaatacagagtcatttactaatactgcagaaatgtttgcagacgataaaaagaataaattaaaaatatggatcctgtcaacatgttcaaatactaacatagactccttcaccttaaactcatactaacatccacacacccgaacaatgaaaatgaaaggttttcaaatgagatctaaatataaattggctctatttcattacagtttaagttcctaaaatcatatatataaatcatgtgattgcgcttatgctcatcttctaacttgagggcccagtgtctttcatccgattctctgaaggataagtgaccccaaaaaacttttaagaaccactaatctagcctatcaagaaacatcccattttccagaagaatacagctaagttggcttagttcatgcattcttacctcatattcatagagttcatagacgggatccttactacatgaaatcagtcttttttttttttttttttttttttttggagatggagtctcctctgtggcccaggctggagtgcagtggcgcaatctcagctcactgcaagctctgcctcccgggttcacgccattctcctgcctcagcctccccgagtagctgggactacaggcgcccgccaccacgcccggctaattttttgtatttttagtagagacggggtttcatcctgttagccaggatagtctcgatctcctgacctcgtgattcgatctcctgacctcgtgatccgcccacctcggcctcccaaagtgctgggattacaggtgtgagccaccgcgccctgccgaaatcagtctttcaaaggattccttcagcccagccaagaagttccaacatccacaggcacatatattaacaattaccagtacccaaaaacagttctctggttttaattccacactgcctccctcaacttaatacctaccaccgtcaaaacaactcccctcagattgcatccaggctatttacagagacaccttgatgatcctcacctcaaggcatggaccattcattgaatggttatatttgttgaatgagtgaaaaaggatccttcctcccacagatttcaagttaagctgtcagcacccatgcagctgctctggtacaagttaagctgtgaaagccttctccctcacgcatacaaccttaagtgtcagaaatgctctgcttcctccataaatccaaaataatatagccatggatatgcatttcatacaggtcagactcggcaaggacagctacgttccacatacatatctgacacaatcggtctcccccaaatacaagccaaccagtcttatgtgctcctatctttccagcatactcagatttgccgacaaagacttcctgaggcaccatggtatgctgaatatactgctgcagtagtagtgaaaatatgggagttacagttccaactttgtcaccaatttaacatgcggccttggagaagttctctccttatgcctaaatttcctattttgtaaaatggaagaaagcatcctaccattttcacagagattcagtatcacaaagaaactgaaagagctttcttattgtattgtaaactattactataaacccgcgacaacaaataaggccacccattctttacagctttgtagcaatgattctgttaaagatattttggcccttcacatttacacaactcactctaaccaaaggcacaaactattcttaagaccacaactggctatgccaagtttctcccctccctgacctcacagacacatgctgtacagaacactaccattgccgctctttcccaacaagtaactaggggctcccaatccctaaaatacacacacatatcaacctgcaaggaacctcccaacatttattcaagaaataagctaacttataaggggaactccattacacttacacaaataaaggcaaactcttacggaaacacttgccatcctcacatacacacaccaacacagccgctacacaccaacagaccatctgtctgctagaccaaaaacatctctttccatgtacaaactaaccagtgacatttattaaacgtacaacactgagatcatcctgtcgttcccacataccgttcaacgcggcagggacaccacagaccttgtcacacaggtaaaatcccctctcaagatcgtgtcctcgaccactcttatcccttaattaaacacacacaaactggactatgggggaggctccgatcatgcctacaaacacaaactaacctgtcaggggcacagccgactccgcctccactcgcttacttcccagccccctccgggagtctgcctgtcagggacaccccttcaccccgcctggagggacttcccggtaggctcaggatccccctccctgctctcccctcccccatcttcaccactgctctcccagaggtccaggtccgggagatgacagtggctcccagaaagcccaggattcaatcgctgagagagtgcttaggcccgaatgccggcccaaatcgttctactcaccgtgtcggaggccgagagcgatgagagtacagggaagtgaggaagagggggtggccgccaggctcctccgcttccctgggtccaccgcggatccctcccgcttgtcaggaggcggccagcgggtaagccgactggcggaaatgcgagagaggagaagggaaaggtggagggctaaaggggcaaactgagaggaggcggatcccgcaaccgacactgggatcgtttcccctcgcaaagcgaacccaaaatggcggcggcagcggcggcagcagagtggccgcggcagctcctccagagggagggagctaagggcgcctagcgacacccccaacctcccactcctccctcctcgcgttcttccccacggtcccccgcttcgcccgactccggccatgtagcgcgcacgtcagcccgcacgcgtacgagtgtctacgggctcgtcgctggctgctcccaccaaccaccaccttcggccgtcctgcgagccagccatcccgtacgcgctcacccacgggaacctcctcgcccagttctccactccccctcagaccctgtcaagccggctccagcgcaggccctcacgcgtaccttcagcggcgcgagcccaagccttctccacctcctcttctctcctccccctccctccccgcccgcacggccaccaaccgccgccaaagcagccgccgccagcacccccaccctacact

SEQ ID NO: 710 - DNA, 29336 bp, Homo sapiens; identical to SEQ ID NO: 709

SEQ ID NO: 711 - DNA, 29336 bp, Homo sapiens; identical to SEQ ID NO: 709

SEQ ID NO: 712 - DNA, 29532 bp, Homo sapiens
tcaatgaaacaatgaagcaataaaagcacagatttattgaagcaaaagtatattccacagagtgggagcaggctaaagcaagctgctcaagagccccagttgcaaaatctggggtttaagtaccctttaggggtttcctattggttacaccctatgcgccaccaatcggaggccgaagtgaaggctcccagtctccagactcttattctcctagctcaaagaaatccactgatttcctctgtagcatcttcaggttccatcttgacaacttcctctaaatccccaggggaagagttgtttagagactcctggatgccctgagggagcggctccagagcttgccttccctcctctgttttcacaacggtccagcgataggcactgttctctgacaatccttcttggcactgtttatcgactggtggaggccctgggctatgttccactttggggaaaacagtagcagagagaggagatagttcctggggctctaatttgggttctaggccctgaaaggcattttccccatcagccacagcacaagcaatgtccacattcatgtgggccttatcttcaggggtggatggtataggaagattcacagaattgccagaaacaattaagggtgagacagaggaggccacaaggggctggttcaatggacaggggaaggaagtagggttaaccaagagggtggcgatgggaatagtctggggactctgggccacagccgcattgacaggctggatcatgttacagccaccgccaaggctcacaatcttcacagtggtagcaggaacagtgaagataacagatgcagggtggataacaggggcaggtttgatacagcgaaaggccctggctccccttctttttgagggtctccgtctcacatatggctttcgaaacatggaagaggcaggggagggcatcattaccttgggcacaggggcagaagagagcaaagtctgggactcagacagagggaagcttgtcctggcctcagggggcatagcaggcagtgctgcaggagactcaaaactctcacctccactgacccccagtggagggacacctggaactgtctgtaaaacagtggctggctgtattgggtgaggaatccggagcaccattttgctcggaggggcttctgaatgagttgattgggctggtgttttcccagggttgaagctgggctggagagaggggctgggttggataaggaggggtttcaggactgatgaacgcttctgtctccaagccttcttggggaaacggtcggcaactggcttcagtttcaggactacacccttaggcaatagcagtgggtaccgagtttcactccccaactctgagttgtctttttctaggccttgatctgagttgatctcagtggttccagtcatatttcctacctctctagcaccatcagccatgtgccgcagttcttcctggatggatggcagactggcctattggaaatgagaacactctgatccagcacatgtcagaatttgggaaaaagaataggactttctaagtttagggacctgagacaagctcaaggcatctttccaagggactctgcatatgaaatttctacaaagaccacagtccaattatacactttagaaactcttctctgaatttcctttagcaaattaccattttacccattattttgaaaatgttgtagaatcacccggagaagggcagaaaagtaagggaagaaaggtgaatcaggaagattcctgaagtcctagttctacaactaaagcattagacgattaaggaagtccttgatattctctcagaactttcagtgaccttctgcctcctacagacttcgaggaagagggctgtacctttaaccagaatgggagccggtgttcttctctctctataggtggcttccactgatgtggctggatctcttcacagcattttcctaggactggcagctgtttggtcttcttataaaacttaacatgaaaaaaatgcgcatgaattacattccttctggaaacactgtcttctgtcaggctggtgaatggggtggtggtggatcaagagaaacacacacacacacacacacacacacacacacacaagaccacatacacaaacatccatgaacacacatatacgaatagcatatgctgaatacttgtacatttcaaattaaactaatctctatttaaagattttatagttattcagtattttctttttgagacggagtcttgctctgtcgcccaggatggagtgcaatggcgcgatctccgctcactgcaagctccacctcccaggttcacgccattctcctgcctcagcctccggagtagctgggactacaggtgcccgccaccacacccggctgatttttttgtatttttagtagagacagggtttcactgtgttagccaggatggtctcgatctcctgacctcgtgatccacccgcctcggcctcccaaagtgctaggattacaggcgtcagccaccgcgcccagccctattcaatattttctaactgatgatctccattctggttgccaggaaggggagagtttaggtcacagagagaaaaggaagcagatgctaagagcaatcttatgtaagatttgttcctgctcaacagctgcaaagacagcatcgtaatctataaaatggacacatcaaagactttaagcaaatgatggtgtgaagggcatcagaagggaaggaaaaaaaaaaagaccgaggcagttcagttttaagagtaaataggctggccttggtggctcacatctgtaaacccagcactttgtgaggctgaggcgggcagatcacttgagattgagagtttgagaccagcctggccaacatggtgaaactccatctctactaaaaatacaaaaattagctgggtgtggtggtgggtgcctgtaatcccagttacttgggaggctggggcaaaagaatcgcttgaacctggcagtgggggtggtagggtggagattgcagtgagccaagatcatgccactgcactccagcgttggtaacagggtgagactccatctcaaaaaaaaaaaaagaagataagaactgaacttaaaccatgacaataagcatctgttcatccaacatgatgaacataagatgttttctatatcctaggcactgtgctaaaagctaagcacacacataagggaagcaattcctgctctcatggagcttacagactagtgggagagtcaagtggacaaatggcatcctacattaaaaaatgtacaaagggctgggcatggtggctcatgcctgtaatgccagcactttgggagaacgaggaggatggatcactggaggtcaggagttcatgaccagcctggccaacatggcgaaaccctgtctctaataaagtacaaaaaaaaattagctgggtgtggtggtgcacgcctgtgatcctagctacttggcaggctgaggcaggagaatcacttgaactgaggaattaagaggttgcagtgagccaagactgcaccactgcactccagcctgggcaacagagcaagactccaaccccgacaccccgccccatcccccaacaaaagtacaaaggtgtgcacgaaaaatgacacaaaactaaaacttaaacacaaattacttctggccaggcgtggtggcttatgcctgtaatcccagcactttgggaggccgaggcaggcagatcacaaggtcaggagatcaagaccatcctggccaacatggtgaaaccccatctctactaaaaatacaaaaattagctaagtgtggtggcgcgtgcctgtaatctcagctactcgggaggctgaggcacgagaatcacttgaacccaggaggtggagagtgcagtgggccgacatcacgccactgcactccagcctggcaacagagtgagactccatctcaaaaaaaaaaaaaaaaattatttctgcagaagaataaggtttatcacgtgtgccttaaaaccatggatacgccaggcatggtggcccacacctgtaatcccagcactctgggaggctgaggtgggtgggtcacgaggtcaggagtttgagaccagcctgaccaacaaggtgaaaccccgtctctactaaaaatacaaaaattagcagggtgtggtggtgagcgcctgtagtcccagctcctcgggacgctgaaacaggacaattgcttgaacctgggaggcagaggttccagtgagccaagatcacgccattgcactccagcctgggcaatggagcgagactctgtctcaaaacaaacaaacaaacaaaaacaaaaagaaagtactttttaaaaaaccatggataaaaatagacaaatactaaggcatattatcatgcattttcaaaatattgaagccaaaggaaaaatcctgcatgctgtcagaggttgagaaaaacaggtgttacacaaagactcaagagttaaatggggccatggctcatgcctataatcccattactttgggaggccaagacaggacgagcacttgaggccaggagtttgagaccagcctggccaacataacgagaccatgtcttaaaaaaaaaaaaaaaaaaaattagctgggcatagtggtgcacaccgggttggagacaccagtgagccatgatttagccacgctccaaactgggcaacagggtgggaccctgtctcggaaaaaaaaaaaaaaagttaaatggcatgaaatttcttaacaccacactaggagttagaagaaaatgaagtgaggcccttaaaagcttcttaaaaaaattatttcctatctagaattctagatacagtgacagaggagagtattattttttccttttattttgaaataattatattcataggaaattgcaaaaaatagtaccaagaggtcccatgtacccttcaaccagtttctcccaatataatgtttttatgttacatagaaacaagagctatacatataaacaaggtacacagtacaatattactaccaggaaactggccagacatggaggatgtggtggctcatgcctgtaatcccagcactatgggaggccaaggtgggcagatcacttgaggtcaggggttcgagatcacctggccaacatggcaaaaccccatctctactaaaaatacaaaaattagctgggtgtggtggctaatcccagctactcaggaggctgaggcaggagaatcgcttgaacccaggaggcagaggctgcagtgagcaacagtgagactctgtctcaaaaaaagaaaaaaaataaaacaaaaacaaaaacgaggaaactgacatcgatacaatcaaaagaccatgaatggagatttttttttttttttttttaatacggagtctcgctctgtcacccaggctggagtgtagtggcgagatctcggctcactgcaagctccacctcccaggttcacgccattctcctgcctcagcctccagagtacctgggactacagacgcccgccaccacacccggctaatttttttgtacttttagtagagacggggtttcaccacattagccaggatggtctcgatttcccgacctcgtgatccacccgcctcagcctcccaaagtgctgggattacaggcgtgagccactgcgcccggccccggagatggtttaaatgtgaaaattcccttcccaagcactctccctcaggatgctactggaatggggccatgcagggtggctcatgcctataatctcagcactttgggatgctgaagcaggaggatcacttgaacccaggagtctgagaccagcctgggcaaaaaactgagacccccccacctcaattttttaaaattcagaaaaaaattttttttaaaaaaaagctactagaatgtgttccactaaagtaaagaagtaatactcacgcctgtaatcccagcactttgggagaccgaaacgggtggatcaagaggtcaggagatcaaaaccatcctggctaacatggtgaaaccctgtctctactaaaaatacaaaaaattagccaggcgtagtggcatgtgcctataatcccagctactcgggaggctgaggcaggagaattgcttgaacccgggaggcggacgttgcagtgagccaagatcatcgcgcctttggactccagcctgggcaacaaagcgagactcggtctcaaaaaaaagcaaaacaaaacaaaaaacaaggccaggcgtggtgtctcacgcctgtaatccccgcactctgggaggctgaggtgggtggatcccctgaggtcaggagttcaagaccaagaccaaggttgcaggttgcagtgagccgagatccagcctgggggacagagcaagactctgtgtctcaaaaaaaaaaaaaaaaaaaaaaaaagtaatgcaaaagcaaagatgtggaattcaggaaataagaggatctaacacagtatgaggcaaaaggaattcctgggatgatggtgaagaaaaagcccaagaagacatcagtgcagcaacatggagagcaacacgcttaaagtggaataatgtcagagggctcagggagcaatttcttcaagatgaaagtgacagaatatctagaatacctgaacacactgaaagaagatgatctgggaaacaaaatgttcagcaggaaaggcaaggtaacacagtaacatagctgagctgtgaagagcatttatacagtccttaaaatctattttttttttttgagacggagtcttgctctggcaagactggagtgcagtggcgcgatctcggctcactgcaagctccacctcccgggttcacaccattctcctgcctcagcctcccgagtagctgggactacaggcgcccgccaccacgcccagccagttttttgtatttttagtagagctggggtttcaccatgttagccaggatggtctcgatttcctgacctcgttatccacctgccttggcctcccaaagtgctgggattacaggcgtgagccaccgcgcccagccaacagtccttaaaatcttacaatgtaaaccctgaatacaatctaaccaaaattctaccataactactagtgaggagtttggagagcagaaaatgtgcatgtttgtggtgggagtaagggagtgaggagagaggtaaatcttcggcttccgtggtttatggttaataagtaaggcctaaatccaatacaccaggcagtaccaattagaggctgagacaggagaattgcctaaggccaaaaattgaagaccagcctgggcaatatagggacaccccatccctaaaaaaaaaaagttttttgccaggcacagaggctcacgcctataattccagcactttgggaggccgaggtgggcagatcacctgagatcaggagttcaagatcagactgaccaacatggtgaaattatgtttctactaaaaatataaaaattagccaggtgtggtggcgcatgcctgtagtcccagctacttaggaggctaaggcatgaaaattgcttgaacccggtaggtggaggttgcagtgagctaaaattgtgccactgcactccagcctgggtgacagagacagattctgtctcaaaaaaataaaataaaataaataaataaataaatttaatggccaagcacagtggctaatgcatataatcccagctccttgggaggctgacgttggaagaatgcttgagcctaggagttcaaggctgcagtgagctatgactataccactgtactccagcctaggcaggagagtaagaccttgtctcaagaaaaatacaaaaacacaatgaaaccaaaggctgggcatcatggctcacgcctgtaatcccaacactctgggaggccgagctgaggcaagaggactgcttgaggtcaggacttcaagaccagcctgggaaacaaaatgacaccctgtcttcacacaaaataaaataatcggctagccttggtggcatgcacctgtagtccaagctacttggaaggctgaagtggaaggatcacccaggaatttgaggttgcagtgacctatgattgtgcccatgcactccagccaggatgacagagtgagaacctgtctctaaaaaaaaaaaaaaacataaataaatatctaaataaaaaagaaggctgggggcaatggctcacatttgtaatcccagcacttagggaggccgaggcagatggatcacctgaggtcaggagttcgagaccagcctggccaacatggtgaaaccccgactctactaaatacaaaaatcagctgggcatggtggcaggggcctgtaatcccagctacaagggaggctgaggcaggagaatcacttgaacccaggaggcagaggttgcagtcagccaagatcgcaccattgcactccagcctgggggtcaagagcgagactccatctcaatcaatcaatcaataagtaaaaagagttgagaaaaagtatataggctgggcctgggcgacaagagcgaaactccatctcaatacatacatacatacatacatacatacatacagacacagacacacacaaacacacacacacacacacacacacatacatgcatacatacaaacacaaaattgagaaaaagtatataggctgggcacggtggcttatgcctgcaatcctagcctctgggaagccaaaactggtggatcacttgaggtcagaagttcaagaccagcctggccaacatggtgaaacccgtatctactaaaaatacaaaaaattagctgagcgtggtgggcacgcctgtaatctcagctatttgggaggctgaggcaggagaatcacttgaacccgggaggcggaagctgcagtgagccaagatcatgccactatactcctgcactccagcctgggtgacagtgcaagattatgtctgaccaaaaaaacaaaacaaaacaaaaacccaaagcatgtaagtggaatactgcatatcatttctagaaagttcaagaaagagaattattacagggaaacatggatttgtggaatcttttaagaggatgaagatactccagaggaacgtaatgaatgaatcaatgtccctgaaaaggcaacaggggaattaatctagtatataagtaggagaaattagctttagataaaagaaggttcttcttttctttgagaataacaagagaaaagaacagatatgtgttggtgaggtgcctggatagtgcatgcaggaaacactcactttaatgatgttgtcaggagctctgttcatgttgaggttcttgattctcactgtcagttggcgggcagtcttgcaggttagaaggtacttgctgattagagggttaagaaactcagtcccttcaaaatgcttcagtcctaaagctaacaaactgagaaaggagcaataacactaaatctcacttcacagtccttccttctaaagggcctccccagactaacacattttacaatctactttttcttacttgttcttaaaacaaggtctcactctgtcacctgggctggagtgcagtggcgtgatcgcagcccactgcagctgctacttcctaagctgaagcgattctccagtctcagcctcccaaagtgctgagattacaggcatgagcccatggcgtgtggcccaatctactttttcatttttttcagacagggttttgctctgttgtccaggctggagagcagtggcatgattacagtgcactgcagtcttgaatgcctgggttcaatcgattcccgcacttcagcctcctgagtatctgtggctataaacgtttgctaccatgcctaactaatgttttatttcattatttgtagagaccagttctcactttgttgcctaggctgatcttgaacttctggcctcaagtgatcctcctgcctcggcctcccaaagtgtcgtcattacaggtgtgagccaccatggctggccaatctactttttctacaactaattcttgtagtgactactacaagttggtgactactcagtagaaaatttcaggtatttagtgagtagtgattaagtactatgaataagaatcaaatagttcacaattaagtaggagcaagagaaactagtcataaatcatcaataaatgtcagatcatgatgagctgtatattaacaacacaaaggaagttcaaagagaatacatgggaaggagaatgattctaataaaacaaatataaaatgaataataggtaccccgtcagacaaattaaactggcaccaatactaccctctaacataacatatataatcatggttacatatatacatatttgctgttaacagtgtggcaatacacacaaagggccataaaaatgttcataatctagctgggtgtggtggcttatgcctatagtcccagcactttgggaggccaggagtgggaggatcatttgaggtcaggaattcaagagcagcctgggcaacacagagataccctcacctgtacaaaaaaaatcagccatgtatggtggcacacgcttgtggtcccagctactccatggaggctgaggcaggaggatcacttgatcccaggagttcaaggctgcagtgagctgtgattgcaacactgtactccagcctgggtgacagagtaagatcctgtctctaaataaataataacattagaaaagccaacctcctgccttggcctttcaaagtgctgggattacaggtgggagccgccatgtccagtctaaaacattttaaaaatgtgtgtaacatccccccaaaaagcagtatttggcactgctagaacaagcacgttctagaggactctgctcatctatactgcttttccttttgtgtccatgtcttattatacaagtcttacttcccctaaactcctcaaaggaactacatcttctccttgggatatttgatcccccagagtaaacacttacttgtcctcagccttggtgaagaggatcttatcctggggattctttgccttcagggaacacactggaagtaactctggatacatgaaaaccttgcttgtggccaggatccaagccacttgctttggcaaacagggaaattcattggctataagaaaataaatctctgataaatcaacttctaggaaaaaagagggcttcaaaaagcctgtgaatgcatttttgcatttaggtagagctgtccttatctaacttgattccctcccatctgcctaccactccccaaagagtttccacagtctttcctcaactaacattaggtctaaagggagtcccattcactggcaataaaagttgactttttttttttttttttttagacggagtctggctctgtcgcccagactggagtgcgtggcgcaatcttggctcactgcaagctccgcctcccgggttcaggccattctcctgcctcagcctcctgagtagctgggactacaggcgcctgccaccacgcctggctgattttttgtatttttagtagagacggggtttcactgtagacaggatggtcttgatctcctgaccttgtcatccgacagcctcggcctcctaaagtgttggattacaggcgtaagccacggcgcccggcctctcttactctttcttacgtgtaacactttattcacaaagtaaaacaaacacttaaaaagtacctagtaatacctgtcacatagtgtatgctcaaaaatgttttacctcctttcccctttaaatctctgaaggataacagaccttcaacaatgcttttttcttccaggataagattccaggccaggcgtgctggctcacgcctgtaatcccagcactttgggaggccgaggcaggtggatcacctgaggtcaggagttcaagaccagcctggccaacatagtgaaaccccatctctaccaaaaatgtaaaaattagccaggcatggtggcacgcacctgtaattccagctacttgggaggctgaggcaggagaattgtttgaacctgggaggcggaggttgcagtgagccgagatcaccccactgcactccagcctaggtgacagagcgagactccatcttaaaaaaaaaaaaaagaaaaaagattccaacttctttaatctccctcacaaacctggtattccaaattttacttttatttcattctttcttaactttcattaagttctcccagattcctcctgaggttgggaacaaaagaaccataaaaggaatgagacaattcagtctcattcatttctgtctccctctctcagcctctcaattttaggcacctctgcatttctagagacaaaactactatatccatatttctccttccataagtgtcatttttatatctccagaagaaaaacacaggacactagatgtgtaagataatactataatttggtattaaatcacgttttcattaccatttcatataatatagctattaaagtagtttgggatctgtgtctatgatatagtacacttaaattcaactacattcaatgtaatgataagacttagggatttaaaatagaatccaaagacaaacccaaatccagaacaaaccacaactaatttgctaagtcagcaaacaaatcagaagtaaatatttggcttaagtaaatagcaaatattttctcaaaaaatactaaaccaatgcaaggtagaatctaaaccggcaaatttctttaaaatactgaacacggcaaatgtacaatctctaatttacgcctaacttgcaagtcaacatttcattcagaatggagatatcacctatgctacaatcattatggtaaataaagttagttgatcttaatgaagagaataaaaagctaaacatgaccgaactttaccacctgactttcatctttaccaggccccagtttatcttgatctgattcctaatacttacccctcatattgctgtagtccaattcttagcactgagcctcagatctctacctcccatattcctatactgtccactgcctccatgccttacccaggcccggagattatcatgtaattctagaacttggataatgagtacaaagggaggataaaagagagaaggaagaaattacaaatgtcctgtgtcctccattcctaggcaagtatcctaggaagttatctatgggataagattcccaccacctctcaccgcaagtaaaaacttaaagctgacacatctgtctcctaccagtcttcttgacagttttatgagggctgcagtcaatgctgacatgtgtgctgaagtcttcaatcagctgcatagctcccatcaagttacagggttggaacagggtctgaaacttggggttgtactgatggtgaagggcgatggagctttgagcaaaggttcccagctctttctgggaaaacacgacacaaggaagatctaagacaattccagacaattaataccaatagccttcagaatctaaatgagaagctgaccttcctactacaggataaaaacaggtaaaaataatcataaagtctttcacaataaactactgttaagattatgcctgagttctcagatattcagggattatattcttgttttatttttaaactgtttctcactaaggaatacatggtctagctcccgagctagaattaagagtctcaagaatggggactattactttaatttaattaattaatttattttgagacatggtctcactctgccgctcaggctggactgcagtggcatgatctcagctcactgcaaactccccctcccaggctcaagccatcctcccactgcctcctgagaagctgggactataggcatacacctccaaacctagctgatttttgtattttttgcagagacagcgttttcccatcttggccaggctgatctcgaactcctgggctcacaatccgcctgcctcggcctctcatagtgctgggattacagggatgagtcacctcacccgaccaggaccattacttttaaaattgttttgtcttttggtctcagaataatgcctacaaccaagtactcctcatcctcctctgaatacagtaagagatgaagacatcctgttgatcaccaaggaagttttagaatactagcaaatgtactcttcaaaatccaaagaagacttactgaagaagctgagagtattatcattacctgtccaaaagtttgaggcaatttttatgaggtaaagtatggttttgtttttgtgagacaggttctcactctgtcacccaggctggagtgatatataagcacggctccctacagtctcaacgtcccaggctcaagtgatcctcctacctcagtctcccaagttgctgggactacaggcactcggcaccatccccagctaatttttttattttttatttttttggtagggatggggtcttactatgttgcccaggctggtctcaaactcctgggctcaagcaatcctcccaccttgacctaccaaagtgctgggactacaggcatgagccaccatacctggccaaatttcaaatttaaaatctcaaaataggccgggcgcggtggctcacgcctgtaatcccagcactttgggaggccgaggtgggcggatcacgaggtcaggagatcgagaccatcccggctaaaacggtgaaaccccgtctctactaaaaatacaaaaaattagccgggcatagtggcgggtgcctgtagtcccagctacttgggaggctgaggcaagagaatggcgtgaacccgggaggcggagcttgcagtgagccgagatcccgccactgcactccagcctgggcgacagagcgagactccgtctcaaaaaaaaaaaaaaaaaaaaaaaaagctcaaaatacctcaaaacgtcatgagcaaaactagctctacacataaaacactaatattgagcttcatgaatggataatgaattcaacatctacatgtatatttacttcattatttaaattaaaacaaaacaaaacaaaaaaaacacagaccgggtcttactatgttgcccaggctgttcttgaccactgggctcaagtgatcctatcacctcagcctcccaaagtgctggaattacaggtgtgagccactatgcccagcctcaacatctatgaaatgaatagcggtaccaaaaacctaagaagtcagggtgaatctaaagatgaggaggaggacccaataaaaatatcagaaggacaggccaggcgcagtggctcatggctgtaatcccagtactttgggaggtagaggtgggcagatcacttgaagtcaggaattcgagaccagcctggccaacatggcaaaaccctgtctctactaaaaatacaaaaaaaattacccgtggtggtgcccgcctgtagtcccagctacttgggaggctgaggcaggagaatcacttgaacccgggaggcaggggttgcagtgaactgaaattgttccaccgcactccatcctgggtgaaagagcaagaccctgtctcaaaaaagaaaagaaaaaattgaatacactctttgtcctttcatgtgaatcagtggcttatgttcactcagcaaacataggaagccacagcaatcaaaaatacctgagagaataactgtgagaaataacctgccaagctaattttatattctagtctatagaattacggcaatttggaaacttacaagacatatcctggtgctactggcctccggattgagattggggttgcaggtggcaagaaggtggatttgtgtcaagagctgaacatgctggggagagaaagaaaataatgcagtgatatgttatgacactgccatttcaggagcccagagatatttttttttccccctggagacagggtcttgctctgtcacacagcttggagtgcagtggtgcaaccatgactcaatgccctctcaaccacctgtgctcaagcaatcttcccacctcagcctcccaagtagctgtgaccacaatgcctggctaatttattttattattattattattattatttttagacagagtctcgcactgacttttgggctggagtgcaatggcgtgatctcggctcactgtaacctctgcctcccaggttcaagtgattctcttgcctcaacctcccgagtagctgggattacaggtgcccgccgccacacccagctaattttttgttttcgtagagacggggtttcaccatgttggccaggcttgcctcaaactcctgacctcatgattcacccgccttggcctcccaaagtgctgggattacaggtgtgagccactgtgcccagccttatttttattttttgtagagacagagtctcactatgttgtccaggctgcttttgaactcccctgctcaagcaatcctcccacctcagcctcccaaagtgctgggattacatgtgtgagccactgcacccagccaccagagagtcattaactaagatgtttgcaactttatgacacaaattttgctttctgcaaagagtgtgagaacaacgtaggatcttggcataaatttctcagacatgttcccttgaacaaaatgacagaaccagaggaagtttaacctctaaacagaggaggaactgagattagaaaaggaaaaggccgggcgcagtgactcacgcgtgtaatcccagcactctgggaggccgaggcgggtggatcacgaggttaggagatcgagaccatcctggctaacacagtgaaccctgtctctactaaaaatacaaaaaattagctgggtgtggtggcgagtccctgtagtcacagctactcgggaggctgaggcaggagaatggcgtgaacccgggaggcagagcttgcagtgagctgagattgagccactgcactccagcctgggtgacagagcgagactacgtctcaaaaaaaaaagaaaaaagaaaagggaaaagggaaaaaaaactacttgtcacagtgaaggttaaatttcagaatagattactgaggactctttgaaatctgtaattccgaataccattagggtccttatgtgctgtcttccctgagccacaggacatgaacatgatgacttctcaagctcctaactgatgtgaagatactacggttttaatacgtagtaaggtaactatctctgacatttacaaagctgctaattttagattataccaaagcctcagagttaggccttggtataattcaatattaatatgaccaaggaaagtgttacctgctgcatctgctgctggagtctcttcctttgtgctgggtccagaatcagggtctgatgaacttccttacactggggtttaaccttctctacctccttctgctgtttggctgaaggtttcttcatcttcagctgttcaaatagttccttcgctatctgatgttgttcatttagtaggttggccagtagttcctcaaacctatcccaaacggggatgactgaatttgagtgttttcctaggtccacaacacatccaattctttgcaatgatgagcaaagagcctgaacaattttcattccctactaatccccccttttcactttagccaacagtcaaactcccagccttacacaaatcttttcccaaagtagttagcatgcatcaaatgattctgtattacaccccatcccattcctctacaattcctcttccaaataatatacaaatgaagaaaaaattaaacaaaaaactagggacagagaaatatatgggtaagaaagcagccaaggagctggtgggaactcatcattctcatttcttctctcattacttgttactccctgggatgttactcccatcccaggtccagcttgtcccattatcctatctactcaggctgcactgccctgctttcttaacaagtcaaagactttctagcatgaagcaggaaaaggatataccaaaataactgaagtacatggtagttcaaatgaacagaacggagaagttagttaaaatattatccatgaaggctatcttcttttagccctttaaattcctcttccaaggttcctaaccctaacttcccatccataccctcctgaaagattgtttgcagggctgaagcaaaaattccaatacctagcatgtcagttctatgtatgattactataccttttctatgtttacatagaaagaaataaagggagaataatatacctaaatgattaagcatatgctgataccctatgcaacaggataagatctgctgaagtagctataacaagcaggttatcatatttcaaggaaccccctatattacagcaatagttaaatggtaacgtttttcaatagtttttgcagataaagattacgtttgaataagttttcttttatagtatttactgtaggtttgggtagcacagagtaaaaacctgaagaccgtgggactgtctatacaatctttactgagaactgaaaatttgaacatccgcgctaccaccactgaaggaacagaagagaagaagcataaaaaagtagaaaatggaaacatagcctgcacttagttttaacaaggattatttaggtaattgataagggaagccccagagtttttgttttgactgtctttttctcctctctcttccttattgtgttttaagatgtgcttactctctatggacttacagagggatttttatttagtcaaagattaaaacaaaaacaggtttgtatttgcaatcgaaagagaagcagaagctgcccaagtacagtcatgcgccacagaatgtttcagtcaataacgaaccacatagtcagaggtggctccataagattactgtaccttttctatgtttacatacatatgtacttaccattgtgttacaactgcctacagtattcagtacagtacagtaacacactgtacaggttttgtagcctgggagcaataggtatgcagtaggctaaaccatttaggtttatgtaagtacattctacgatgtttacacaatgatgaatcgtttaatgatagatttcacagagggtatgaccatgagatgatatatgactatattccattgaataccagaaggtaactggattctaacaggaattttaaattagttctatattttccaaattttaagaagttataaagagttgatcagcaaaaccaaaatatttattaatcagatcctattatacgttcccaggatgaatggttccattctgctataccagaattttgttctatgaactataaattaaaataatgggtcaaatactgacttagcaatcttgagatttttgatgtagttgtattgtgatatttgttgtaatggagaatgactagtagttctagtttttaagacattggttggcctatcttatcttttttcactaaattggaaaatccctaaaggtctagctttcagatggaacccaagctctctgcttagtagtgctgttaagttcaaacacaggactaattacagggactattctctttgctttgttccacttatggcacaaactgcatcctgacctctcgccatcgacctaatgattatatgctgctacaacagaataaagtgcagatgcaaatccaccacaaaatgaggaaaaaattaaagcctctactttctggatgctgtaacacaagtgccaactttaggcaaaaaggtcagcacgtatgtttcagactccttactgcaggtgcttcagggtttgctccactaatgcctaggtgactaacaaattttcagtcacatttagcagatattaatggcacataaaaagaacaaaagggacagactggatattacaatatagggtagtttgtgtggctggccacattgagtcctacatacctctccagcaccactcacccggagaagtggatatggatgccagctactgttttttctcccttcccaaacagatacagcttggcctacagctgcactgccccataacaaggagacttcacttgacacctaactcctgacaggactctgcatccttacatcagtaacagaagctggctggggatgaaaaattgttaactgcaacttctgaaaaccttttcagaaataaactcttcctctattccaaatctcaaggtcttcaactagcctaccgtagagcttgaggggtgttaaagttagcttgaggctcagccacacgctcctcctcttctgggccatcatcttccatgttggagaatcccatctcatcttggaactgtgggcaaaggaaagggagggttttcctggggaatgggcttttgaatgttgctccagtgttgggaaggaaaagtgaaaactataaacaatactttaataatgctggcacccagaaagagcctacatcagaacctttctcacttcaggactcctacaaacccacatatggaatgactattatgccaggaaagaagttgctcaaccagtcaacttgtatcagtaagcacagagctaggataactcaaaatgatcaatttcttaaacagaaatatctttttagacaaatttatggaaaaggtaattatttgtgtgcaaaatactttaaaactagttggcaatctttaaggacacaccaaatgacagtaggggaagccatcaaaagttttcaaggggcaagatgtgctggctcacacctgtaattccagcactttgggaggttgaggcaggaagattacttgagcctatgagttccagaacatggcaagaccctgtctctacaaaaaaataaaataattagccgggcctgtaggtgtgtgcctgtagtcccagctactcaggaggcttagatgagagaattgttttgagccctggaggtcgaggctgctgtgagctgagatttcaccactgtattctccagagcctgggtgacagagcaagactttgcctcaaaaaaaaaaaaaaaaagcttcaaggaaaattttagtaagaataacctacatgtggataatcaagagtctagcagttagcaaatttcttttgtcattatattctttcccaggtagactaaaaggagaattggttcagtccctcttctagaaggagcatcacagagatcaaaggacacattttgttggagaaccaacttacaatcccatgttctcacttgaggatcattactcacagtttcaaacagatcttccatcagctcatttgcttccttttctgcaaaaaagccaaacgttgttggtataaattagattcattttacaatatggaggaattccatgtagacaatgtatgatgttttcaacaaggcatctgacgaattcttcatatctatccttattcctgagacagggtctcactctgtcacccgggctggagggcagtggcttgatctcggctcactgcaatctctgcttcccaggctcaagcgatcctcccacttcagccctccaagtagctggggcaacaggagtgtgctgtcatgcccggctaattcttccatattttgtagagatgggttttccccatgttgcccaagctggtcttgaactcctgagctccagtgatccacccaccttggcttcccaaagtgctggggttacaggcatgagccaccacgcccagctatccttcattcatttattcaaaaacatttattgagtacttactatgtttcaatccctgttttagatgcttgggatatatgagagaatgagagagagagagagttctaatctcattgaacttaaattctaataggaagaagacaaggagaaaatgtgagctagatgatttttttttttttttgagacggagtttcgctcttgttgcccaggctggagtgcgatgacacgattttggctcactgcaacctccgcctcccaggttcaagctattctcctgcctcagcctcccaagtagctgggattacaggcatgcaccaccacgcccagctaattttgtgtttttagtagagatggggtttctccatattggtcaggctggtctcaaactcctgacctcaggtgatccgcccacctcagcctcccaaagtgctgggattacaggcatgagccaccatgaccagcccaatgattttataattagatggcctatccaaacccacacaatactgaatggaatcaagagacaagtctcccaacctgggcaaaatgtcaacatatctctaaaaaaaaatttatctgggcttggtcgcacatgcatatagtcccatatacttgagaggctgaggtgagagaatctctttgagtccaagaagcagaggctgtagtgagctgagaccgtcccactgcattccagcctgaacgacagagcaagacactgtctccaaaaaaaaaagagacagacagagacaagtttccaacagtgtttcataggactctatctttggacccgacctattcaaaaactccatcagtgaattagaagaccaagagaacatacttaacaaatctgtagatgatgtaaagctgtaaagctgaaagggactgccaatccaattgatggaaaattcagaatcatattttctcaaatcaactggatgtaacacgtaaggataaatttaaagttctacattgaggatttttttttttttttttttttaaatagagccagggacttgctatgttgcccaggctggtcttgaactcctgggctccagcgatcctcccacctcatcctcccaaagtgctgggattacagacatgagccaccccacctggcaagatcttatatgtgtattcaagatattacacaactcactaagtctccagatgaaaaccagaatctctaaatatagtttgacagtttgacaatgcccaatgacagactaaatgagaaattaggaggcagcttgatttttttttatttcctcagagatctttgttctgagttctgactcttgttctacaaatattcaaagtcgaaatgattatcatgttaatgggtaaagagcttcaaatctttggctatctcatttttttttaatttttattcatttgttttaccttatgtgttcctctacaatggttatctaggaagttaacaaccattctagctatctagcattctggttcttgatatcatgtaaaatgagcgttctgatctctgacacacaaagctatttagaagataaaaaatagacatttttttcaacaatcattttacttttttctctacatctacatactctacatgtcagagtttttgtttctgttttttcgagagtagctgggattacaggcacctgccacaacacctggataattttttgtatttttagtagagatggggtttcatcatgttggccaggttggtctccaactcctgacctcaggtgatccacctgcctcagcctcccaaagtgcagggattacaggcatgagccactgcacccagccaagtactttgattcttaatggaggatttaatccactgacatcccaaaggacaaactatccaatggaattcctggataaaacacaggcacacagtgtctcttcctcagaggaaagaaatttttgtcaacagaagaattttgctcttctgggcgtggtggctcctgcctgtaatcctagcactttgggaggctgagcctggaggatcacctgaggtcaggagttcgagaccagcctggccaacctggtgaaaccctgtctctactaaaaatacaaaaattagcctagcgtggtggctaatgcctgtaatcccagctacttgggaggctgaggcaggagaatcgcttgaacccgggagtcggaggttgcagtgagccgagattgcgccattgcactccagcctgggcgacaagagcgaaactccatctcaaaaaaaaaacaaaaaacaaaattgatttgctctagcagaaaaataattatatttcaggaattccttcaggaatcctataccagtactaaaagatcctatattggaaaatgaaaatgcccaaattaataagtcctgagatagaggagaagggatcttgttttgtccatcactgtatcttagtacctggaatagtgcttggcacataataagcattaaatacatacatggcagtcttgtttctgaaccaaaatgaggtggtttaatgaaagagatgggtttggctaggcgtggtggctcacacctgtaatcccagcactttgggaggctgaggcaggtggatcacttgaggtcaggagtatgagaacagcttggctactggctaacatggtgaaaccctgtctctactaacaatacaaaaattagccaggtgtagtggtgcgtgcctgtaaacccagctgctcaggacattgaggcaggagaatcacttgaatccgggtggcagaggctacagtgagtcaaaatcctgccactgcattccaaactgggctacagagcaagactccatctcaaaaaaaacaaaacaaaacaaaaaaaacaacaacaagtgaaatactgaaatactgatcagctttaaaaagagaactgtcataaccaccccaatttagttccaagacttaggcttccccaccaaggcaaaattaacacagtaagaaggctattccagttcattttggagaaaatcttggatttggtaagcaggtaaaaagagctgggcatgctggctcacatctgtaatcccagcaaactgggaggccaagacaggaggatggcttgaggccaggagttcaagaccagattgatctacatagcaagacctgggccaggtgcagtggctcactcctataatcccagcactttggaaggccgagacggctggagaacttgaggttaggagttcgtgaccagcctggccaacgtggggaaaccctgtctcaactaaaaatacaaaaatcagcagggcgtgttggcacgcgcctgtaatcccagctatttgggaagctgaggaaagagaatcacttgaacctgggaggcagaggttgcagtgaggcaagattgtgccattgtactccagcctgggcgaggagagcgaaactctctctcaaaaacaaaaacaaaaacaaaaaaccatagcgagacctaatctcaattaaaaaaataaagaaattgtatacacatacatgcacatatatgcacactacacacacatatcacatgtacgttttgagaaaaataacaccatgaacctactacccgttaaaaattagagaaaatattaaacttttcacaaatttacatagcattcttatacaggggccatgtcaatagaaagaaaggactatcagacaatttttcctaaaacttctccattatctcactgaatcctataatctgtcctattaaaacacctttttacatttcttgcttttttttttttttttgtgagacagagtgttgctctgatgccgaggctagagtgcagtggcatgatttcagctcactgcaacttccccctcccagttcaagcaattcttggttcaagcaattctcgtgcctcagcttcccgagtagctgggactacaggtgcactccaacacatgcagctaattttttgtattttagtagagacggggtttcaccgtgttgcccaggctggtctcgatcttctgagctctgacaatccatccgcctcgtcctcccaaagtgctaggattacaggcgtgagccaccccacctgaccaatttcttgttcttttaaaagtacagtaattatttttaagttccagtaataaattaatgggtagtctgtcaaatagctactggattttatatcaggagggctttctacatgtatgtatacccaaaaatgacattaagacctttttacataaactcactgtagagatacatcccaaaacaaggtaaggaatataaatgatgtttaccttcttttcaaaccaacagttcctttatacaaaaacaccagatgatacaaaacatatttttttaaagtacaaagttccatacagaataaaataaacactttatggttattcctaagaataagtagtgacaaaaagtctttgcaattgggtaataaaatttcagcttctaggaatatgtttccctcttccttgtccttttgagagctgccactatcacacaattcacagcatctcttcaaccacagaaaattagcgtctcttcaagcacagagaccatatattaattatctttgtgtctcctgcataggattaactcagtgtttgttataactaagttaaactccaagacaggagcttcaaatcacctcaggcccaatccaaaactgaaaaaaagacgcttctcagagtttgagaacaaaaagatactgacaaagaacaaagccatagatacttgtgcgacattagcttccctttttaccaaatacagagtcatttactaatactgcagaaatgtttgcagacgataaaaagaataaattaaaaatatggatcctgtcaacatgttcaaatactaacatagactccttcaccttaaactcatactaacatccacacacccgaacaatgaaaatgaaaggttttcaaatgagatctaaatataaattggctctatttcattacagtttaagttcctaaaatcatatatataaatcatgtgattgcgcttatgctcatcttctaacttgagggcccagtgtctttcatccgattctctgaaggataagtgaccccaaaaaacttttaagaaccactaatctagcctatcaagaaacatcccattttccagaagaatacagctaagttggcttagttcatgcattcttacctcatattcatagagttcatagacgggatccttactacatgaaatcagtcttttttttttttttttttttttttttggagatggagtctcctctgtggcccaggctggagtgcagtggcgcaatctcagctcactgcaagctctgcctcccgggttcacgccattctcctgcctcagcctccccgagtagctgggactacaggcgcccgccaccacgcccggctaattttttgtatttttagtagagacggggtttcatcctgttagccaggatagtctcgatctcctgacctcgtgattcgatctcctgacctcgtgatccgcccacctcggcctcccaaagtgctgggattacaggtgtgagccaccgcgccctgccgaaatcagtctttcaaaggattccttcagcccagccaagaagttccaacatccacaggcacatatattaacaattaccagtacccaaaaacagttctctggttttaattccacactgcctccctcaacttaatacctaccaccgtcaaaacaactcccctcagattgcatccaggctatttacagagacaccttgatgatcctcacctcaaggcatggaccattcattgaatggttatatttgttgaatgagtgaaaaaggatccttcctcccacagatttcaagttaagctgtcagcacccatgcagctgctctggtacaagttaagctgtgaaagccttctccctcacgcatacaaccttaagtgtcagaaatgctctgcttcctccataaatccaaaataatatagccatggatatgcatttcatacaggtcagactcggcaaggacagctacgttccacatacatatctgacacaatcggtctcccccaaatacaagccaaccagtcttatgtgctcctatctttccagcatactcagatttgccgacaaagacttcctgaggcaccatggtatgctgaatatactgctgcagtagtagtgaaaatatgggagttacagttccaactttgtcaccaatttaacatgcggccttggagaagttctctccttatgcctaaatttcctattttgtaaaatggaagaaagcatcctaccattttcacagagattcagtatcacaaagaaactgaaagagctttcttattgtattgtaaactattactataaacccgcgacaacaaataaggccacccattctttacagctttgtagcaatgattctgttaaagatattttggcccttcacatttacacaactcactctaaccaaaggcacaaactattcttaagaccacaactggctatgccaagtttctcccctccctgacctcacagacacatgctgtacagaacactaccattgccgctctttcccaacaagtaactaggggctcccaatccctaaaatacacacacatatcaacctgcaaggaacctcccaacatttattcaagaaataagctaacttataaggggaactccattacacttacacaaataaaggcaaactcttacggaaacacttgccatcctcacatacacacaccaacacagccgctacacaccaacagaccatctgtctgctagaccaaaaacatctctttccatgtacaaactaaccagtgacatttattaaacgtacaacactgagatcatcctgtcgttcccacataccgttcaacgcggcagggacaccacagaccttgtcacacaggtaaaatcccctctcaagatcgtgtcctcgaccactcttatcccttaattaaacacacacaaactggactatgggggaggctccgatcatgcctacaaacacaaactaacctgtcaggggcacagccgactccgcctccactcgcttacttcccagccccctccgggagtctgcctgtcagggacaccccttcaccccgcctggagggacttcccggtaggctcaggatccccctccctgctctcccctcccccatcttcaccactgctctcccagaggtccaggtccgggagatgacagtggctcccagaaagcccaggattcaatcgctgagagagtgcttaggcccgaatgccggcccaaatcgttctactcaccgtgtcggaggccgagagcgatgagagtacagggaagtgaggaagagggggtggccgccaggctcctccgcttccctgggtccaccgcggatccctcccgcttgtcaggaggcggccagcgggtaagccgactggcggaaatgcgagagaggagaagggaaaggtggagggctaaaggggcaaactgagaggaggcggatcccgcaaccgacactgggatcgtttcccctcgcaaagcgaacccaaaatggcggcggcagcggcggcagcagagtggccgcggcagctcctccagagggagggagctaagggcgcctagcgacacccccaacctcccactcctccctcctcgcgttcttccccacggtcccccgcttcgcccgactccggccatgtagcgcgcacgtcagcccgcacgcgtacgagtgtctacgggctcgtcgctggctgctcccaccaaccaccaccttcggccgtcctgcgagccagccatcccgtacgcgctcacccacgggaacctcctcgcccagttctccactccccctcagaccctgtcaagccggctccagcgcaggccctcacgcgtaccttcagcggcgcgagcccaagccttctccacctcctcttctctcctccccctccctccccgcccgcacggccaccaaccgccgccaaagcagccgccgccagcacccccaccctacactcctcgcgcgtgcgcctcccacagtccccaccgcgggactgttccattcctggcggctgcaggggcaggagaggaagggaccggcaaagcgagtctggcttgccgtttgactggaattgccagggtggccggccgagtcccatgacaacctacctccctgggttcgtcgccgcggcgctgcggctcgcctcctcctc

SEQ ID NO: 713 - DNA, 29587 bp, Homo sapiens
tcaatgaaacaatgaagcaataaaagcacagatttattgaagcaaaagtatattccacagagtgggagcaggctaaagcaagctgctcaagagccccagttgcaaaatctggggtttaagtaccctttaggggtttcctattggttacaccctatgcgccaccaatcggaggccgaagtgaaggctcccagtctccagactcttattctcctagctcaaagaaatccactgatttcctctgtagcatcttcaggttccatcttgacaacttcctctaaatccccaggggaagagttgtttagagactcctggatgccctgagggagcggctccagagcttgccttccctcctctgttttcacaacggtccagcgataggcactgttctctgacaatccttcttggcactgtttatcgactggtggaggccctgggctatgttccactttggggaaaacagtagcagagagaggagatagttcctggggctctaatttgggttctaggccctgaaaggcattttccccatcagccacagcacaagcaatgtccacattcatgtgggccttatcttcaggggtggatggtataggaagattcacagaattgccagaaacaattaagggtgagacagaggaggccacaaggggctggttcaatggacaggggaaggaagtagggttaaccaagagggtggcgatgggaatagtctggggactctgggccacagccgcattgacaggctggatcatgttacagccaccgccaaggctcacaatcttcacagtggtagcaggaacagtgaagataacagatgcagggtggataacaggggcaggtttgatacagcgaaaggccctggctccccttctttttgagggtctccgtctcacatatggctttcgaaacatggaagaggcaggggagggcatcattaccttgggcacaggggcagaagagagcaaagtctgggactcagacagagggaagcttgtcctggcctcagggggcatagcaggcagtgctgcaggagactcaaaactctcacctccactgacccccagtggagggacacctggaactgtctgtaaaacagtggctggctgtattgggtgaggaatccggagcaccattttgctcggaggggcttctgaatgagttgattgggctggtgttttcccagggttgaagctgggctggagagaggggctgggttggataaggaggggtttcaggactgatgaacgcttctgtctccaagccttcttggggaaacggtcggcaactggcttcagtttcaggactacacccttaggcaatagcagtgggtaccgagtttcactccccaactctgagttgtctttttctaggccttgatctgagttgatctcagtggttccagtcatatttcctacctctctagcaccatcagccatgtgccgcagttcttcctggatggatggcagactggcctattggaaatgagaacactctgatccagcacatgtcagaatttgggaaaaagaataggactttctaagtttagggacctgagacaagctcaaggcatctttccaagggactctgcatatgaaatttctacaaagaccacagtccaattatacactttagaaactcttctctgaatttcctttagcaaattaccattttacccattattttgaaaatgttgtagaatcacccggagaagggcagaaaagtaagggaagaaaggtgaatcaggaagattcctgaagtcctagttctacaactaaagcattagacgattaaggaagtccttgatattctctcagaactttcagtgaccttctgcctcctacagacttcgaggaagagggctgtacctttaaccagaatgggagccggtgttcttctctctctataggtggcttccactgatgtggctggatctcttcacagcattttcctaggactggcagctgtttggtcttcttataaaacttaacatgaaaaaaatgcgcatgaattacattccttctggaaacactgtcttctgtcaggctggtgaatggggtggtggtggatcaagagaaacacacacacacacacacacacacacacacacacaagaccacatacacaaacatccatgaacacacatatacgaatagcatatgctgaatacttgtacatttcaaattaaactaatctctatttaaagattttatagttattcagtattttctttttgagacggagtcttgctctgtcgcccaggatggagtgcaatggcgcgatctccgctcactgcaagctccacctcccaggttcacgccattctcctgcctcagcctccggagtagctgggactacaggtgcccgccaccacacccggctgatttttttgtatttttagtagagacagggtttcactgtgttagccaggatggtctcgatctcctgacctcgtgatccacccgcctcggcctcccaaagtgctaggattacaggcgtcagccaccgcgcccagccctattcaatattttctaactgatgatctccattctggttgccaggaaggggagagtttaggtcacagagagaaaaggaagcagatgctaagagcaatcttatgtaagatttgttcctgctcaacagctgcaaagacagcatcgtaatctataaaatggacacatcaaagactttaagcaaatgatggtgtgaagggcatcagaagggaaggaaaaaaaaaaagaccgaggcagttcagttttaagagtaaataggctggccttggtggctcacatctgtaaacccagcactttgtgaggctgaggcgggcagatcacttgagattgagagtttgagaccagcctggccaacatggtgaaactccatctctactaaaaatacaaaaattagctgggtgtggtggtgggtgcctgtaatcccagttacttgggaggctggggcaaaagaatcgcttgaacctggcagtgggggtggtagggtggagattgcagtgagccaagatcatgccactgcactccagcgttggtaacagggtgagactccatctcaaaaaaaaaaaaagaagataagaactgaacttaaaccatgacaataagcatctgttcatccaacatgatgaacataagatgttttctatatcctaggcactgtgctaaaagctaagcacacacataagggaagcaattcctgctctcatggagcttacagactagtgggagagtcaagtggacaaatggcatcctacattaaaaaatgtacaaagggctgggcatggtggctcatgcctgtaatgccagcactttgggagaacgaggaggatggatcactggaggtcaggagttcatgaccagcctggccaacatggcgaaaccctgtctctaataaagtacaaaaaaaaattagctgggtgtggtggtgcacgcctgtgatcctagctacttggcaggctgaggcaggagaatcacttgaactgaggaattaagaggttgcagtgagccaagactgcaccactgcactccagcctgggcaacagagcaagactccaaccccgacaccccgccccatcccccaacaaaagtacaaaggtgtgcacgaaaaatgacacaaaactaaaacttaaacacaaattacttctggccaggcgtggtggcttatgcctgtaatcccagcactttgggaggccgaggcaggcagatcacaaggtcaggagatcaagaccatcctggccaacatggtgaaaccccatctctactaaaaatacaaaaattagctaagtgtggtggcgcgtgcctgtaatctcagctactcgggaggctgaggcacgagaatcacttgaacccaggaggtggagagtgcagtgggccgacatcacgccactgcactccagcctggcaacagagtgagactccatctcaaaaaaaaaaaaaaaaattatttctgcagaagaataaggtttatcacgtgtgccttaaaaccatggatacgccaggcatggtggcccacacctgtaatcccagcactctgggaggctgaggtgggtgggtcacgaggtcaggagtttgagaccagcctgaccaacaaggtgaaaccccgtctctactaaaaatacaaaaattagcagggtgtggtggtgagcgcctgtagtcccagctcctcgggacgctgaaacaggacaattgcttgaacctgggaggcagaggttccagtgagccaagatcacgccattgcactccagcctgggcaatggagcgagactctgtctcaaaacaaacaaacaaacaaaaacaaaaagaaagtactttttaaaaaaccatggataaaaatagacaaatactaaggcatattatcatgcattttcaaaatattgaagccaaaggaaaaatcctgcatgctgtcagaggttgagaaaaacaggtgttacacaaagactcaagagttaaatggggccatggctcatgcctataatcccattactttgggaggccaagacaggacgagcacttgaggccaggagtttgagaccagcctggccaacataacgagaccatgtcttaaaaaaaaaaaaaaaaaaaattagctgggcatagtggtgcacaccgggttggagacaccagtgagccatgatttagccacgctccaaactgggcaacagggtgggaccctgtctcggaaaaaaaaaaaaaaagttaaatggcatgaaatttcttaacaccacactaggagttagaagaaaatgaagtgaggcccttaaaagcttcttaaaaaaattatttcctatctagaattctagatacagtgacagaggagagtattattttttccttttattttgaaataattatattcataggaaattgcaaaaaatagtaccaagaggtcccatgtacccttcaaccagtttctcccaatataatgtttttatgttacatagaaacaagagctatacatataaacaaggtacacagtacaatattactaccaggaaactggccagacatggaggatgtggtggctcatgcctgtaatcccagcactatgggaggccaaggtgggcagatcacttgaggtcaggggttcgagatcacctggccaacatggcaaaaccccatctctactaaaaatacaaaaattagctgggtgtggtggctaatcccagctactcaggaggctgaggcaggagaatcgcttgaacccaggaggcagaggctgcagtgagcaacagtgagactctgtctcaaaaaaagaaaaaaaataaaacaaaaacaaaaacgaggaaactgacatcgatacaatcaaaagaccatgaatggagatttttttttttttttttttaatacggagtctcgctctgtcacccaggctggagtgtagtggcgagatctcggctcactgcaagctccacctcccaggttcacgccattctcctgcctcagcctccagagtacctgggactacagacgcccgccaccacacccggctaatttttttgtacttttagtagagacggggtttcaccacattagccaggatggtctcgatttcccgacctcgtgatccacccgcctcagcctcccaaagtgctgggattacaggcgtgagccactgcgcccggccccggagatggtttaaatgtgaaaattcccttcccaagcactctccctcaggatgctactggaatggggccatgcagggtggctcatgcctataatctcagcactttgggatgctgaagcaggaggatcacttgaacccaggagtctgagaccagcctgggcaaaaaactgagacccccccacctcaattttttaaaattcagaaaaaaattttttttaaaaaaaagctactagaatgtgttccactaaagtaaagaagtaatactcacgcctgtaatcccagcactttgggagaccgaaacgggtggatcaagaggtcaggagatcaaaaccatcctggctaacatggtgaaaccctgtctctactaaaaatacaaaaaattagccaggcgtagtggcatgtgcctataatcccagctactcgggaggctgaggcaggagaattgcttgaacccgggaggcggacgttgcagtgagccaagatcatcgcgcctttggactccagcctgggcaacaaagcgagactcggtctcaaaaaaaagcaaaacaaaacaaaaaacaaggccaggcgtggtgtctcacgcctgtaatccccgcactctgggaggctgaggtgggtggatcccctgaggtcaggagttcaagaccaagaccaaggttgcaggttgcagtgagccgagatccagcctgggggacagagcaagactctgtgtctcaaaaaaaaaaaaaaaaaaaaaaaaagtaatgcaaaagcaaagatgtggaattcaggaaataagaggatctaacacagtatgaggcaaaaggaattcctgggatgatggtgaagaaaaagcccaagaagacatcagtgcagcaacatggagagcaacacgcttaaagtggaataatgtcagagggctcagggagcaatttcttcaagatgaaagtgacagaatatctagaatacctgaacacactgaaagaagatgatctgggaaacaaaatgttcagcaggaaaggcaaggtaacacagtaacatagctgagctgtgaagagcatttatacagtccttaaaatctattttttttttttgagacggagtcttgctctggcaagactggagtgcagtggcgcgatctcggctcactgcaagctccacctcccgggttcacaccattctcctgcctcagcctcccgagtagctgggactacaggcgcccgccaccacgcccagccagttttttgtatttttagtagagctggggtttcaccatgttagccaggatggtctcgatttcctgacctcgttatccacctgccttggcctcccaaagtgctgggattacaggcgtgagccaccgcgcccagccaacagtccttaaaatcttacaatgtaaaccctgaatacaatctaaccaaaattctaccataactactagtgaggagtttggagagcagaaaatgtgcatgtttgtggtgggagtaagggagtgaggagagaggtaaatcttcggcttccgtggtttatggttaataagtaaggcctaaatccaatacaccaggcagtaccaattagaggctgagacaggagaattgcctaaggccaaaaattgaagaccagcctgggcaatatagggacaccccatccctaaaaaaaaaaagttttttgccaggcacagaggctcacgcctataattccagcactttgggaggccgaggtgggcagatcacctgagatcaggagttcaagatcagactgaccaacatggtgaaattatgtttctactaaaaatataaaaattagccaggtgtggtggcgcatgcctgtagtcccagctacttaggaggctaaggcatgaaaattgcttgaacccggtaggtggaggttgcagtgagctaaaattgtgccactgcactccagcctgggtgacagagacagattctgtctcaaaaaaataaaataaaataaataaataaataaatttaatggccaagcacagtggctaatgcatataatcccagctccttgggaggctgacgttggaagaatgcttgagcctaggagttcaaggctgcagtgagctatgactataccactgtactccagcctaggcaggagagtaagaccttgtctcaagaaaaatacaaaaacacaatgaaaccaaaggctgggcatcatggctcacgcctgtaatcccaacactctgggaggccgagctgaggcaagaggactgcttgaggtcaggacttcaagaccagcctgggaaacaaaatgacaccctgtcttcacacaaaataaaataatcggctagccttggtggcatgcacctgtagtccaagctacttggaaggctgaagtggaaggatcacccaggaatttgaggttgcagtgacctatgattgtgcccatgcactccagccaggatgacagagtgagaacctgtctctaaaaaaaaaaaaaaacataaataaatatctaaataaaaaagaaggctgggggcaatggctcacatttgtaatcccagcacttagggaggccgaggcagatggatcacctgaggtcaggagttcgagaccagcctggccaacatggtgaaaccccgactctactaaatacaaaaatcagctgggcatggtggcaggggcctgtaatcccagctacaagggaggctgaggcaggagaatcacttgaacccaggaggcagaggttgcagtcagccaagatcgcaccattgcactccagcctgggggtcaagagcgagactccatctcaatcaatcaatcaataagtaaaaagagttgagaaaaagtatataggctgggcctgggcgacaagagcgaaactccatctcaatacatacatacatacatacatacatacatacagacacagacacacacaaacacacacacacacacacacacacatacatgcatacatacaaacacaaaattgagaaaaagtatataggctgggcacggtggcttatgcctgcaatcctagcctctgggaagccaaaactggtggatcacttgaggtcagaagttcaagaccagcctggccaacatggtgaaacccgtatctactaaaaatacaaaaaattagctgagcgtggtgggcacgcctgtaatctcagctatttgggaggctgaggcaggagaatcacttgaacccgggaggcggaagctgcagtgagccaagatcatgccactatactcctgcactccagcctgggtgacagtgcaagattatgtctgaccaaaaaaacaaaacaaaacaaaaacccaaagcatgtaagtggaatactgcatatcatttctagaaagttcaagaaagagaattattacagggaaacatggatttgtggaatcttttaagaggatgaagatactccagaggaacgtaatgaatgaatcaatgtccctgaaaaggcaacaggggaattaatctagtatataagtaggagaaattagctttagataaaagaaggttcttcttttctttgagaataacaagagaaaagaacagatatgtgttggtgaggtgcctggatagtgcatgcaggaaacactcactttaatgatgttgtcaggagctctgttcatgttgaggttcttgattctcactgtcagttggcgggcagtcttgcaggttagaaggtacttgctgattagagggttaagaaactcagtcccttcaaaatgcttcagtcctaaagctaacaaactgagaaaggagcaataacactaaatctcacttcacagtccttccttctaaagggcctccccagactaacacattttacaatctactttttcttacttgttcttaaaacaaggtctcactctgtcacctgggctggagtgcagtggcgtgatcgcagcccactgcagctgctacttcctaagctgaagcgattctccagtctcagcctcccaaagtgctgagattacaggcatgagcccatggcgtgtggcccaatctactttttcatttttttcagacagggttttgctctgttgtccaggctggagagcagtggcatgattacagtgcactgcagtcttgaatgcctgggttcaatcgattcccgcacttcagcctcctgagtatctgtggctataaacgtttgctaccatgcctaactaatgttttatttcattatttgtagagaccagttctcactttgttgcctaggctgatcttgaacttctggcctcaagtgatcctcctgcctcggcctcccaaagtgtcgtcattacaggtgtgagccaccatggctggccaatctactttttctacaactaattcttgtagtgactactacaagttggtgactactcagtagaaaatttcaggtatttagtgagtagtgattaagtactatgaataagaatcaaatagttcacaattaagtaggagcaagagaaactagtcataaatcatcaataaatgtcagatcatgatgagctgtatattaacaacacaaaggaagttcaaagagaatacatgggaaggagaatgattctaataaaacaaatataaaatgaataataggtaccccgtcagacaaattaaactggcaccaatactaccctctaacataacatatataatcatggttacatatatacatatttgctgttaacagtgtggcaatacacacaaagggccataaaaatgttcataatctagctgggtgtggtggcttatgcctatagtcccagcactttgggaggccaggagtgggaggatcatttgaggtcaggaattcaagagcagcctgggcaacacagagataccctcacctgtacaaaaaaaatcagccatgtatggtggcacacgcttgtggtcccagctactccatggaggctgaggcaggaggatcacttgatcccaggagttcaaggctgcagtgagctgtgattgcaacactgtactccagcctgggtgacagagtaagatcctgtctctaaataaataataacattagaaaagccaacctcctgccttggcctttcaaagtgctgggattacaggtgggagccgccatgtccagtctaaaacattttaaaaatgtgtgtaacatccccccaaaaagcagtatttggcactgctagaacaagcacgttctagaggactctgctcatctatactgcttttccttttgtgtccatgtcttattatacaagtcttacttcccctaaactcctcaaaggaactacatcttctccttgggatatttgatcccccagagtaaacacttacttgtcctcagccttggtgaagaggatcttatcctggggattctttgccttcagggaacacactggaagtaactctggatacatgaaaaccttgcttgtggccaggatccaagccacttgctttggcaaacagggaaattcattggctataagaaaataaatctctgataaatcaacttctaggaaaaaagagggcttcaaaaagcctgtgaatgcatttttgcatttaggtagagctgtccttatctaacttgattccctcccatctgcctaccactccccaaagagtttccacagtctttcctcaactaacattaggtctaaagggagtcccattcactggcaataaaagttgactttttttttttttttttttagacggagtctggctctgtcgcccagactggagtgcgtggcgcaatcttggctcactgcaagctccgcctcccgggttcaggccattctcctgcctcagcctcctgagtagctgggactacaggcgcctgccaccacgcctggctgattttttgtatttttagtagagacggggtttcactgtagacaggatggtcttgatctcctgaccttgtcatccgacagcctcggcctcctaaagtgttggattacaggcgtaagccacggcgcccggcctctcttactctttcttacgtgtaacactttattcacaaagtaaaacaaacacttaaaaagtacctagtaatacctgtcacatagtgtatgctcaaaaatgttttacctcctttcccctttaaatctctgaaggataacagaccttcaacaatgcttttttcttccaggataagattccaggccaggcgtgctggctcacgcctgtaatcccagcactttgggaggccgaggcaggtggatcacctgaggtcaggagttcaagaccagcctggccaacatagtgaaaccccatctctaccaaaaatgtaaaaattagccaggcatggtggcacgcacctgtaattccagctacttgggaggctgaggcaggagaattgtttgaacctgggaggcggaggttgcagtgagccgagatcaccccactgcactccagcctaggtgacagagcgagactccatcttaaaaaaaaaaaaaagaaaaaagattccaacttctttaatctccctcacaaacctggtattccaaattttacttttatttcattctttcttaactttcattaagttctcccagattcctcctgaggttgggaacaaaagaaccataaaaggaatgagacaattcagtctcattcatttctgtctccctctctcagcctctcaattttaggcacctctgcatttctagagacaaaactactatatccatatttctccttccataagtgtcatttttatatctccagaagaaaaacacaggacactagatgtgtaagataatactataatttggtattaaatcacgttttcattaccatttcatataatatagctattaaagtagtttgggatctgtgtctatgatatagtacacttaaattcaactacattcaatgtaatgataagacttagggatttaaaatagaatccaaagacaaacccaaatccagaacaaaccacaactaatttgctaagtcagcaaacaaatcagaagtaaatatttggcttaagtaaatagcaaatattttctcaaaaaatactaaaccaatgcaaggtagaatctaaaccggcaaatttctttaaaatactgaacacggcaaatgtacaatctctaatttacgcctaacttgcaagtcaacatttcattcagaatggagatatcacctatgctacaatcattatggtaaataaagttagttgatcttaatgaagagaataaaaagctaaacatgaccgaactttaccacctgactttcatctttaccaggccccagtttatcttgatctgattcctaatacttacccctcatattgctgtagtccaattcttagcactgagcctcagatctctacctcccatattcctatactgtccactgcctccatgccttacccaggcccggagattatcatgtaattctagaacttggataatgagtacaaagggaggataaaagagagaaggaagaaattacaaatgtcctgtgtcctccattcctaggcaagtatcctaggaagttatctatgggataagattcccaccacctctcaccgcaagtaaaaacttaaagctgacacatctgtctcctaccagtcttcttgacagttttatgagggctgcagtcaatgctgacatgtgtgctgaagtcttcaatcagctgcatagctcccatcaagttacagggttggaacagggtctgaaacttggggttgtactgatggtgaagggcgatggagctttgagcaaaggttcccagctctttctgggaaaacacgacacaaggaagatctaagacaattccagacaattaataccaatagccttcagaatctaaatgagaagctgaccttcctactacaggataaaaacaggtaaaaataatcataaagtctttcacaataaactactgttaagattatgcctgagttctcagatattcagggattatattcttgttttatttttaaactgtttctcactaaggaatacatggtctagctcccgagctagaattaagagtctcaagaatggggactattactttaatttaattaattaatttattttgagacatggtctcactctgccgctcaggctggactgcagtggcatgatctcagctcactgcaaactccccctcccaggctcaagccatcctcccactgcctcctgagaagctgggactataggcatacacctccaaacctagctgatttttgtattttttgcagagacagcgttttcccatcttggccaggctgatctcgaactcctgggctcacaatccgcctgcctcggcctctcatagtgctgggattacagggatgagtcacctcacccgaccaggaccattacttttaaaattgttttgtcttttggtctcagaataatgcctacaaccaagtactcctcatcctcctctgaatacagtaagagatgaagacatcctgttgatcaccaaggaagttttagaatactagcaaatgtactcttcaaaatccaaagaagacttactgaagaagctgagagtattatcattacctgtccaaaagtttgaggcaatttttatgaggtaaagtatggttttgtttttgtgagacaggttctcactctgtcacccaggctggagtgatatataagcacggctccctacagtctcaacgtcccaggctcaagtgatcctcctacctcagtctcccaagttgctgggactacaggcactcggcaccatccccagctaatttttttattttttatttttttggtagggatggggtcttactatgttgcccaggctggtctcaaactcctgggctcaagcaatcctcccaccttgacctaccaaagtgctgggactacaggcatgagccaccatacctggccaaatttcaaatttaaaatctcaaaataggccgggcgcggtggctcacgcctgtaatcccagcactttgggaggccgaggtgggcggatcacgaggtcaggagatcgagaccatcccggctaaaacggtgaaaccccgtctctactaaaaatacaaaaaattagccgggcatagtggcgggtgcctgtagtcccagctacttgggaggctgaggcaagagaatggcgtgaacccgggaggcggagcttgcagtgagccgagatcccgccactgcactccagcctgggcgacagagcgagactccgtctcaaaaaaaaaaaaaaaaaaaaaaaaagctcaaaatacctcaaaacgtcatgagcaaaactagctctacacataaaacactaatattgagcttcatgaatggataatgaattcaacatctacatgtatatttacttcattatttaaattaaaacaaaacaaaacaaaaaaaacacagaccgggtcttactatgttgcccaggctgttcttgaccactgggctcaagtgatcctatcacctcagcctcccaaagtgctggaattacaggtgtgagccactatgcccagcctcaacatctatgaaatgaatagcggtaccaaaaacctaagaagtcagggtgaatctaaagatgaggaggaggacccaataaaaatatcagaaggacaggccaggcgcagtggctcatggctgtaatcccagtactttgggaggtagaggtgggcagatcacttgaagtcaggaattcgagaccagcctggccaacatggcaaaaccctgtctctactaaaaatacaaaaaaaattacccgtggtggtgcccgcctgtagtcccagctacttgggaggctgaggcaggagaatcacttgaacccgggaggcaggggttgcagtgaactgaaattgttccaccgcactccatcctgggtgaaagagcaagaccctgtctcaaaaaagaaaagaaaaaattgaatacactctttgtcctttcatgtgaatcagtggcttatgttcactcagcaaacataggaagccacagcaatcaaaaatacctgagagaataactgtgagaaataacctgccaagctaattttatattctagtctatagaattacggcaatttggaaacttacaagacatatcctggtgctactggcctccggattgagattggggttgcaggtggcaagaaggtggatttgtgtcaagagctgaacatgctggggagagaaagaaaataatgcagtgatatgttatgacactgccatttcaggagcccagagatatttttttttccccctggagacagggtcttgctctgtcacacagcttggagtgcagtggtgcaaccatgactcaatgccctctcaaccacctgtgctcaagcaatcttcccacctcagcctcccaagtagctgtgaccacaatgcctggctaatttattttattattattattattattatttttagacagagtctcgcactgacttttgggctggagtgcaatggcgtgatctcggctcactgtaacctctgcctcccaggttcaagtgattctcttgcctcaacctcccgagtagctgggattacaggtgcccgccgccacacccagctaattttttgttttcgtagagacggggtttcaccatgttggccaggcttgcctcaaactcctgacctcatgattcacccgccttggcctcccaaagtgctgggattacaggtgtgagccactgtgcccagccttatttttattttttgtagagacagagtctcactatgttgtccaggctgcttttgaactcccctgctcaagcaatcctcccacctcagcctcccaaagtgctgggattacatgtgtgagccactgcacccagccaccagagagtcattaactaagatgtttgcaactttatgacacaaattttgctttctgcaaagagtgtgagaacaacgtaggatcttggcataaatttctcagacatgttcccttgaacaaaatgacagaaccagaggaagtttaacctctaaacagaggaggaactgagattagaaaaggaaaaggccgggcgcagtgactcacgcgtgtaatcccagcactctgggaggccgaggcgggtggatcacgaggttaggagatcgagaccatcctggctaacacagtgaaccctgtctctactaaaaatacaaaaaattagctgggtgtggtggcgagtccctgtagtcacagctactcgggaggctgaggcaggagaatggcgtgaacccgggaggcagagcttgcagtgagctgagattgagccactgcactccagcctgggtgacagagcgagactacgtctcaaaaaaaaaagaaaaaagaaaagggaaaagggaaaaaaaactacttgtcacagtgaaggttaaatttcagaatagattactgaggactctttgaaatctgtaattccgaataccattagggtccttatgtgctgtcttccctgagccacaggacatgaacatgatgacttctcaagctcctaactgatgtgaagatactacggttttaatacgtagtaaggtaactatctctgacatttacaaagctgctaattttagattataccaaagcctcagagttaggccttggtataattcaatattaatatgaccaaggaaagtgttacctgctgcatctgctgctggagtctcttcctttgtgctgggtccagaatcagggtctgatgaacttccttacactggggtttaaccttctctacctccttctgctgtttggctgaaggtttcttcatcttcagctgttcaaatagttccttcgctatctgatgttgttcatttagtaggttggccagtagttcctcaaacctatcccaaacggggatgactgaatttgagtgttttcctaggtccacaacacatccaattctttgcaatgatgagcaaagagcctgaacaattttcattccctactaatccccccttttcactttagccaacagtcaaactcccagccttacacaaatcttttcccaaagtagttagcatgcatcaaatgattctgtattacaccccatcccattcctctacaattcctcttccaaataatatacaaatgaagaaaaaattaaacaaaaaactagggacagagaaatatatgggtaagaaagcagccaaggagctggtgggaactcatcattctcatttcttctctcattacttgttactccctgggatgttactcccatcccaggtccagcttgtcccattatcctatctactcaggctgcactgccctgctttcttaacaagtcaaagactttctagcatgaagcaggaaaaggatataccaaaataactgaagtacatggtagttcaaatgaacagaacggagaagttagttaaaatattatccatgaaggctatcttcttttagccctttaaattcctcttccaaggttcctaaccctaacttcccatccataccctcctgaaagattgtttgcagggctgaagcaaaaattccaatacctagcatgtcagttctatgtatgattactataccttttctatgtttacatagaaagaaataaagggagaataatatacctaaatgattaagcatatgctgataccctatgcaacaggataagatctgctgaagtagctataacaagcaggttatcatatttcaaggaaccccctatattacagcaatagttaaatggtaacgtttttcaatagtttttgcagataaagattacgtttgaataagttttcttttatagtatttactgtaggtttgggtagcacagagtaaaaacctgaagaccgtgggactgtctatacaatctttactgagaactgaaaatttgaacatccgcgctaccaccactgaaggaacagaagagaagaagcataaaaaagtagaaaatggaaacatagcctgcacttagttttaacaaggattatttaggtaattgataagggaagccccagagtttttgttttgactgtctttttctcctctctcttccttattgtgttttaagatgtgcttactctctatggacttacagagggatttttatttagtcaaagattaaaacaaaaacaggtttgtatttgcaatcgaaagagaagcagaagctgcccaagtacagtcatgcgccacagaatgtttcagtcaataacgaaccacatagtcagaggtggctccataagattactgtaccttttctatgtttacatacatatgtacttaccattgtgttacaactgcctacagtattcagtacagtacagtaacacactgtacaggttttgtagcctgggagcaataggtatgcagtaggctaaaccatttaggtttatgtaagtacattctacgatgtttacacaatgatgaatcgtttaatgatagatttcacagagggtatgaccatgagatgatatatgactatattccattgaataccagaaggtaactggattctaacaggaattttaaattagttctatattttccaaattttaagaagttataaagagttgatcagcaaaaccaaaatatttattaatcagatcctattatacgttcccaggatgaatggttccattctgctataccagaattttgttctatgaactataaattaaaataatgggtcaaatactgacttagcaatcttgagatttttgatgtagttgtattgtgatatttgttgtaatggagaatgactagtagttctagtttttaagacattggttggcctatcttatcttttttcactaaattggaaaatccctaaaggtctagctttcagatggaacccaagctctctgcttagtagtgctgttaagttcaaacacaggactaattacagggactattctctttgctttgttccacttatggcacaaactgcatcctgacctctcgccatcgacctaatgattatatgctgctacaacagaataaagtgcagatgcaaatccaccacaaaatgaggaaaaaattaaagcctctactttctggatgctgtaacacaagtgccaactttaggcaaaaaggtcagcacgtatgtttcagactccttactgcaggtgcttcagggtttgctccactaatgcctaggtgactaacaaattttcagtcacatttagcagatattaatggcacataaaaagaacaaaagggacagactggatattacaatatagggtagtttgtgtggctggccacattgagtcctacatacctctccagcaccactcacccggagaagtggatatggatgccagctactgttttttctcccttcccaaacagatacagcttggcctacagctgcactgccccataacaaggagacttcacttgacacctaactcctgacaggactctgcatccttacatcagtaacagaagctggctggggatgaaaaattgttaactgcaacttctgaaaaccttttcagaaataaactcttcctctattccaaatctcaaggtcttcaactagcctaccgtagagcttgaggggtgttaaagttagcttgaggctcagccacacgctcctcctcttctgggccatcatcttccatgttggagaatcccatctcatcttggaactgtgggcaaaggaaagggagggttttcctggggaatgggcttttgaatgttgctccagtgttgggaaggaaaagtgaaaactataaacaatactttaataatgctggcacccagaaagagcctacatcagaacctttctcacttcaggactcctacaaacccacatatggaatgactattatgccaggaaagaagttgctcaaccagtcaacttgtatcagtaagcacagagctaggataactcaaaatgatcaatttcttaaacagaaatatctttttagacaaatttatggaaaaggtaattatttgtgtgcaaaatactttaaaactagttggcaatctttaaggacacaccaaatgacagtaggggaagccatcaaaagttttcaaggggcaagatgtgctggctcacacctgtaattccagcactttgggaggttgaggcaggaagattacttgagcctatgagttccagaacatggcaagaccctgtctctacaaaaaaataaaataattagccgggcctgtaggtgtgtgcctgtagtcccagctactcaggaggcttagatgagagaattgttttgagccctggaggtcgaggctgctgtgagctgagatttcaccactgtattctccagagcctgggtgacagagcaagactttgcctcaaaaaaaaaaaaaaaaagcttcaaggaaaattttagtaagaataacctacatgtggataatcaagagtctagcagttagcaaatttcttttgtcattatattctttcccaggtagactaaaaggagaattggttcagtccctcttctagaaggagcatcacagagatcaaaggacacattttgttggagaaccaacttacaatcccatgttctcacttgaggatcattactcacagtttcaaacagatcttccatcagctcatttgcttccttttctgcaaaaaagccaaacgttgttggtataaattagattcattttacaatatggaggaattccatgtagacaatgtatgatgttttcaacaaggcatctgacgaattcttcatatctatccttattcctgagacagggtctcactctgtcacccgggctggagggcagtggcttgatctcggctcactgcaatctctgcttcccaggctcaagcgatcctcccacttcagccctccaagtagctggggcaacaggagtgtgctgtcatgcccggctaattcttccatattttgtagagatgggttttccccatgttgcccaagctggtcttgaactcctgagctccagtgatccacccaccttggcttcccaaagtgctggggttacaggcatgagccaccacgcccagctatccttcattcatttattcaaaaacatttattgagtacttactatgtttcaatccctgttttagatgcttgggatatatgagagaatgagagagagagagagttctaatctcattgaacttaaattctaataggaagaagacaaggagaaaatgtgagctagatgatttttttttttttttgagacggagtttcgctcttgttgcccaggctggagtgcgatgacacgattttggctcactgcaacctccgcctcccaggttcaagctattctcctgcctcagcctcccaagtagctgggattacaggcatgcaccaccacgcccagctaattttgtgtttttagtagagatggggtttctccatattggtcaggctggtctcaaactcctgacctcaggtgatccgcccacctcagcctcccaaagtgctgggattacaggcatgagccaccatgaccagcccaatgattttataattagatggcctatccaaacccacacaatactgaatggaatcaagagacaagtctcccaacctgggcaaaatgtcaacatatctctaaaaaaaaatttatctgggcttggtcgcacatgcatatagtcccatatacttgagaggctgaggtgagagaatctctttgagtccaagaagcagaggctgtagtgagctgagaccgtcccactgcattccagcctgaacgacagagcaagacactgtctccaaaaaaaaaagagacagacagagacaagtttccaacagtgtttcataggactctatctttggacccgacctattcaaaaactccatcagtgaattagaagaccaagagaacatacttaacaaatctgtagatgatgtaaagctgtaaagctgaaagggactgccaatccaattgatggaaaattcagaatcatattttctcaaatcaactggatgtaacacgtaaggataaatttaaagttctacattgaggatttttttttttttttttttttaaatagagccagggacttgctatgttgcccaggctggtcttgaactcctgggctccagcgatcctcccacctcatcctcccaaagtgctgggattacagacatgagccaccccacctggcaagatcttatatgtgtattcaagatattacacaactcactaagtctccagatgaaaaccagaatctctaaatatagtttgacagtttgacaatgcccaatgacagactaaatgagaaattaggaggcagcttgatttttttttatttcctcagagatctttgttctgagttctgactcttgttctacaaatattcaaagtcgaaatgattatcatgttaatgggtaaagagcttcaaatctttggctatctcatttttttttaatttttattcatttgttttaccttatgtgttcctctacaatggttatctaggaagttaacaaccattctagctatctagcattctggttcttgatatcatgtaaaatgagcgttctgatctctgacacacaaagctatttagaagataaaaaatagacatttttttcaacaatcattttacttttttctctacatctacatactctacatgtcagagtttttgtttctgttttttcgagagtagctgggattacaggcacctgccacaacacctggataattttttgtatttttagtagagatggggtttcatcatgttggccaggttggtctccaactcctgacctcaggtgatccacctgcctcagcctcccaaagtgcagggattacaggcatgagccactgcacccagccaagtactttgattcttaatggaggatttaatccactgacatcccaaaggacaaactatccaatggaattcctggataaaacacaggcacacagtgtctcttcctcagaggaaagaaatttttgtcaacagaagaattttgctcttctgggcgtggtggctcctgcctgtaatcctagcactttgggaggctgagcctggaggatcacctgaggtcaggagttcgagaccagcctggccaacctggtgaaaccctgtctctactaaaaatacaaaaattagcctagcgtggtggctaatgcctgtaatcccagctacttgggaggctgaggcaggagaatcgcttgaacccgggagtcggaggttgcagtgagccgagattgcgccattgcactccagcctgggcgacaagagcgaaactccatctcaaaaaaaaaacaaaaaacaaaattgatttgctctagcagaaaaataattatatttcaggaattccttcaggaatcctataccagtactaaaagatcctatattggaaaatgaaaatgcccaaattaataagtcctgagatagaggagaagggatcttgttttgtccatcactgtatcttagtacctggaatagtgcttggcacataataagcattaaatacatacatggcagtcttgtttctgaaccaaaatgaggtggtttaatgaaagagatgggtttggctaggcgtggtggctcacacctgtaatcccagcactttgggaggctgaggcaggtggatcacttgaggtcaggagtatgagaacagcttggctactggctaacatggtgaaaccctgtctctactaacaatacaaaaattagccaggtgtagtggtgcgtgcctgtaaacccagctgctcaggacattgaggcaggagaatcacttgaatccgggtggcagaggctacagtgagtcaaaatcctgccactgcattccaaactgggctacagagcaagactccatctcaaaaaaaacaaaacaaaacaaaaaaaacaacaacaagtgaaatactgaaatactgatcagctttaaaaagagaactgtcataaccaccccaatttagttccaagacttaggcttccccaccaaggcaaaattaacacagtaagaaggctattccagttcattttggagaaaatcttggatttggtaagcaggtaaaaagagctgggcatgctggctcacatctgtaatcccagcaaactgggaggccaagacaggaggatggcttgaggccaggagttcaagaccagattgatctacatagcaagacctgggccaggtgcagtggctcactcctataatcccagcactttggaaggccgagacggctggagaacttgaggttaggagttcgtgaccagcctggccaacgtggggaaaccctgtctcaactaaaaatacaaaaatcagcagggcgtgttggcacgcgcctgtaatcccagctatttgggaagctgaggaaagagaatcacttgaacctgggaggcagaggttgcagtgaggcaagattgtgccattgtactccagcctgggcgaggagagcgaaactctctctcaaaaacaaaaacaaaaacaaaaaaccatagcgagacctaatctcaattaaaaaaataaagaaattgtatacacatacatgcacatatatgcacactacacacacatatcacatgtacgttttgagaaaaataacaccatgaacctactacccgttaaaaattagagaaaatattaaacttttcacaaatttacatagcattcttatacaggggccatgtcaatagaaagaaaggactatcagacaatttttcctaaaacttctccattatctcactgaatcctataatctgtcctattaaaacacctttttacatttcttgcttttttttttttttttgtgagacagagtgttgctctgatgccgaggctagagtgcagtggcatgatttcagctcactgcaacttccccctcccagttcaagcaattcttggttcaagcaattctcgtgcctcagcttcccgagtagctgggactacaggtgcactccaacacatgcagctaattttttgtattttagtagagacggggtttcaccgtgttgcccaggctggtctcgatcttctgagctctgacaatccatccgcctcgtcctcccaaagtgctaggattacaggcgtgagccaccccacctgaccaatttcttgttcttttaaaagtacagtaattatttttaagttccagtaataaattaatgggtagtctgtcaaatagctactggattttatatcaggagggctttctacatgtatgtatacccaaaaatgacattaagacctttttacataaactcactgtagagatacatcccaaaacaaggtaaggaatataaatgatgtttaccttcttttcaaaccaacagttcctttatacaaaaacaccagatgatacaaaacatatttttttaaagtacaaagttccatacagaataaaataaacactttatggttattcctaagaataagtagtgacaaaaagtctttgcaattgggtaataaaatttcagcttctaggaatatgtttccctcttccttgtccttttgagagctgccactatcacacaattcacagcatctcttcaaccacagaaaattagcgtctcttcaagcacagagaccatatattaattatctttgtgtctcctgcataggattaactcagtgtttgttataactaagttaaactccaagacaggagcttcaaatcacctcaggcccaatccaaaactgaaaaaaagacgcttctcagagtttgagaacaaaaagatactgacaaagaacaaagccatagatacttgtgcgacattagcttccctttttaccaaatacagagtcatttactaatactgcagaaatgtttgcagacgataaaaagaataaattaaaaatatggatcctgtcaacatgttcaaatactaacatagactccttcaccttaaactcatactaacatccacacacccgaacaatgaaaatgaaaggttttcaaatgagatctaaatataaattggctctatttcattacagtttaagttcctaaaatcatatatataaatcatgtgattgcgcttatgctcatcttctaacttgagggcccagtgtctttcatccgattctctgaaggataagtgaccccaaaaaacttttaagaaccactaatctagcctatcaagaaacatcccattttccagaagaatacagctaagttggcttagttcatgcattcttacctcatattcatagagttcatagacgggatccttactacatgaaatcagtcttttttttttttttttttttttttttggagatggagtctcctctgtggcccaggctggagtgcagtggcgcaatctcagctcactgcaagctctgcctcccgggttcacgccattctcctgcctcagcctccccgagtagctgggactacaggcgcccgccaccacgcccggctaattttttgtatttttagtagagacggggtttcatcctgttagccaggatagtctcgatctcctgacctcgtgattcgatctcctgacctcgtgatccgcccacctcggcctcccaaagtgctgggattacaggtgtgagccaccgcgccctgccgaaatcagtctttcaaaggattccttcagcccagccaagaagttccaacatccacaggcacatatattaacaattaccagtacccaaaaacagttctctggttttaattccacactgcctccctcaacttaatacctaccaccgtcaaaacaactcccctcagattgcatccaggctatttacagagacaccttgatgatcctcacctcaaggcatggaccattcattgaatggttatatttgttgaatgagtgaaaaaggatccttcctcccacagatttcaagttaagctgtcagcacccatgcagctgctctggtacaagttaagctgtgaaagccttctccctcacgcatacaaccttaagtgtcagaaatgctctgcttcctccataaatccaaaataatatagccatggatatgcatttcatacaggtcagactcggcaaggacagctacgttccacatacatatctgacacaatcggtctcccccaaatacaagccaaccagtcttatgtgctcctatctttccagcatactcagatttgccgacaaagacttcctgaggcaccatggtatgctgaatatactgctgcagtagtagtgaaaatatgggagttacagttccaactttgtcaccaatttaacatgcggccttggagaagttctctccttatgcctaaatttcctattttgtaaaatggaagaaagcatcctaccattttcacagagattcagtatcacaaagaaactgaaagagctttcttattgtattgtaaactattactataaacccgcgacaacaaataaggccacccattctttacagctttgtagcaatgattctgttaaagatattttggcccttcacatttacacaactcactctaaccaaaggcacaaactattcttaagaccacaactggctatgccaagtttctcccctccctgacctcacagacacatgctgtacagaacactaccattgccgctctttcccaacaagtaactaggggctcccaatccctaaaatacacacacatatcaacctgcaaggaacctcccaacatttattcaagaaataagctaacttataaggggaactccattacacttacacaaataaaggcaaactcttacggaaacacttgccatcctcacatacacacaccaacacagccgctacacaccaacagaccatctgtctgctagaccaaaaacatctctttccatgtacaaactaaccagtgacatttattaaacgtacaacactgagatcatcctgtcgttcccacataccgttcaacgcggcagggacaccacagaccttgtcacacaggtaaaatcccctctcaagatcgtgtcctcgaccactcttatcccttaattaaacacacacaaactggactatgggggaggctccgatcatgcctacaaacacaaactaacctgtcaggggcacagccgactccgcctccactcgcttacttcccagccccctccgggagtctgcctgtcagggacaccccttcaccccgcctggagggacttcccggtaggctcaggatccccctccctgctctcccctcccccatcttcaccactgctctcccagaggtccaggtccgggagatgacagtggctcccagaaagcccaggattcaatcgctgagagagtgcttaggcccgaatgccggcccaaatcgttctactcaccgtgtcggaggccgagagcgatgagagtacagggaagtgaggaagagggggtggccgccaggctcctccgcttccctgggtccaccgcggatccctcccgcttgtcaggaggcggccagcgggtaagccgactggcggaaatgcgagagaggagaagggaaaggtggagggctaaaggggcaaactgagaggaggcggatcccgcaaccgacactgggatcgtttcccctcgcaaagcgaacccaaaatggcggcggcagcggcggcagcagagtggccgcggcagctcctccagagggagggagctaagggcgcctagcgacacccccaacctcccactcctccctcctcgcgttcttccccacggtcccccgcttcgcccgactccggccatgtagcgcgcacgtcagcccgcacgcgtacgagtgtctacgggctcgtcgctggctgctcccaccaaccaccaccttcggccgtcctgcgagccagccatcccgtacgcgctcacccacgggaacctcctcgcccagttctccactccccctcagaccctgtcaagccggctccagcgcaggccctcacgcgtaccttcagcggcgcgagcccaagccttctccacctcctcttctctcctccccctccctccccgcccgcacggccaccaaccgccgccaaagcagccgccgccagcacccccaccctacactcctcgcgcgtgcgcctcccacagtccccaccgcgggactgttccattcctggcggctgcaggggcaggagaggaagggaccggcaaagcgagtctggcttgccgtttgactggaattgccagggtggccggccgagtcccatgacaacctacctccctgggttcgtcgccgcggcgctgcggctcgcctcctcctccatgggaccgcggcgaggggatcgagggcggcctagcgcccctctgccggccggt

SEQ ID NO: 714 - DNA, 29591 bp, Homo sapiens
tcaatgaaacaatgaagcaataaaagcacagatttattgaagcaaaagtatattccacagagtgggagcaggctaaagcaagctgctcaagagccccagttgcaaaatctggggtttaagtaccctttaggggtttcctattggttacaccctatgcgccaccaatcggaggccgaagtgaaggctcccagtctccagactcttattctcctagctcaaagaaatccactgatttcctctgtagcatcttcaggttccatcttgacaacttcctctaaatccccaggggaagagttgtttagagactcctggatgccctgagggagcggctccagagcttgccttccctcctctgttttcacaacggtccagcgataggcactgttctctgacaatccttcttggcactgtttatcgactggtggaggccctgggctatgttccactttggggaaaacagtagcagagagaggagatagttcctggggctctaatttgggttctaggccctgaaaggcattttccccatcagccacagcacaagcaatgtccacattcatgtgggccttatcttcaggggtggatggtataggaagattcacagaattgccagaaacaattaagggtgagacagaggaggccacaaggggctggttcaatggacaggggaaggaagtagggttaaccaagagggtggcgatgggaatagtctggggactctgggccacagccgcattgacaggctggatcatgttacagccaccgccaaggctcacaatcttcacagtggtagcaggaacagtgaagataacagatgcagggtggataacaggggcaggtttgatacagcgaaaggccctggctccccttctttttgagggtctccgtctcacatatggctttcgaaacatggaagaggcaggggagggcatcattaccttgggcacaggggcagaagagagcaaagtctgggactcagacagagggaagcttgtcctggcctcagggggcatagcaggcagtgctgcaggagactcaaaactctcacctccactgacccccagtggagggacacctggaactgtctgtaaaacagtggctggctgtattgggtgaggaatccggagcaccattttgctcggaggggcttctgaatgagttgattgggctggtgttttcccagggttgaagctgggctggagagaggggctgggttggataaggaggggtttcaggactgatgaacgcttctgtctccaagccttcttggggaaacggtcggcaactggcttcagtttcaggactacacccttaggcaatagcagtgggtaccgagtttcactccccaactctgagttgtctttttctaggccttgatctgagttgatctcagtggttccagtcatatttcctacctctctagcaccatcagccatgtgccgcagttcttcctggatggatggcagactggcctattggaaatgagaacactctgatccagcacatgtcagaatttgggaaaaagaataggactttctaagtttagggacctgagacaagctcaaggcatctttccaagggactctgcatatgaaatttctacaaagaccacagtccaattatacactttagaaactcttctctgaatttcctttagcaaattaccattttacccattattttgaaaatgttgtagaatcacccggagaagggcagaaaagtaagggaagaaaggtgaatcaggaagattcctgaagtcctagttctacaactaaagcattagacgattaaggaagtccttgatattctctcagaactttcagtgaccttctgcctcctacagacttcgaggaagagggctgtacctttaaccagaatgggagccggtgttcttctctctctataggtggcttccactgatgtggctggatctcttcacagcattttcctaggactggcagctgtttggtcttcttataaaacttaacatgaaaaaaatgcgcatgaattacattccttctggaaacactgtcttctgtcaggctggtgaatggggtggtggtggatcaagagaaacacacacacacacacacacacacacacacacacaagaccacatacacaaacatccatgaacacacatatacgaatagcatatgctgaatacttgtacatttcaaattaaactaatctctatttaaagattttatagttattcagtattttctttttgagacggagtcttgctctgtcgcccaggatggagtgcaatggcgcgatctccgctcactgcaagctccacctcccaggttcacgccattctcctgcctcagcctccggagtagctgggactacaggtgcccgccaccacacccggctgatttttttgtatttttagtagagacagggtttcactgtgttagccaggatggtctcgatctcctgacctcgtgatccacccgcctcggcctcccaaagtgctaggattacaggcgtcagccaccgcgcccagccctattcaatattttctaactgatgatctccattctggttgccaggaaggggagagtttaggtcacagagagaaaaggaagcagatgctaagagcaatcttatgtaagatttgttcctgctcaacagctgcaaagacagcatcgtaatctataaaatggacacatcaaagactttaagcaaatgatggtgtgaagggcatcagaagggaaggaaaaaaaaaaagaccgaggcagttcagttttaagagtaaataggctggccttggtggctcacatctgtaaacccagcactttgtgaggctgaggcgggcagatcacttgagattgagagtttgagaccagcctggccaacatggtgaaactccatctctactaaaaatacaaaaattagctgggtgtggtggtgggtgcctgtaatcccagttacttgggaggctggggcaaaagaatcgcttgaacctggcagtgggggtggtagggtggagattgcagtgagccaagatcatgccactgcactccagcgttggtaacagggtgagactccatctcaaaaaaaaaaaaagaagataagaactgaacttaaaccatgacaataagcatctgttcatccaacatgatgaacataagatgttttctatatcctaggcactgtgctaaaagctaagcacacacataagggaagcaattcctgctctcatggagcttacagactagtgggagagtcaagtggacaaatggcatcctacattaaaaaatgtacaaagggctgggcatggtggctcatgcctgtaatgccagcactttgggagaacgaggaggatggatcactggaggtcaggagttcatgaccagcctggccaacatggcgaaaccctgtctctaataaagtacaaaaaaaaattagctgggtgtggtggtgcacgcctgtgatcctagctacttggcaggctgaggcaggagaatcacttgaactgaggaattaagaggttgcagtgagccaagactgcaccactgcactccagcctgggcaacagagcaagactccaaccccgacaccccgccccatcccccaacaaaagtacaaaggtgtgcacgaaaaatgacacaaaactaaaacttaaacacaaattacttctggccaggcgtggtggcttatgcctgtaatcccagcactttgggaggccgaggcaggcagatcacaaggtcaggagatcaagaccatcctggccaacatggtgaaaccccatctctactaaaaatacaaaaattagctaagtgtggtggcgcgtgcctgtaatctcagctactcgggaggctgaggcacgagaatcacttgaacccaggaggtggagagtgcagtgggccgacatcacgccactgcactccagcctggcaacagagtgagactccatctcaaaaaaaaaaaaaaaaattatttctgcagaagaataaggtttatcacgtgtgccttaaaaccatggatacgccaggcatggtggcccacacctgtaatcccagcactctgggaggctgaggtgggtgggtcacgaggtcaggagtttgagaccagcctgaccaacaaggtgaaaccccgtctctactaaaaatacaaaaattagcagggtgtggtggtgagcgcctgtagtcccagctcctcgggacgctgaaacaggacaattgcttgaacctgggaggcagaggttccagtgagccaagatcacgccattgcactccagcctgggcaatggagcgagactctgtctcaaaacaaacaaacaaacaaaaacaaaaagaaagtactttttaaaaaaccatggataaaaatagacaaatactaaggcatattatcatgcattttcaaaatattgaagccaaaggaaaaatcctgcatgctgtcagaggttgagaaaaacaggtgttacacaaagactcaagagttaaatggggccatggctcatgcctataatcccattactttgggaggccaagacaggacgagcacttgaggccaggagtttgagaccagcctggccaacataacgagaccatgtcttaaaaaaaaaaaaaaaaaaaattagctgggcatagtggtgcacaccgggttggagacaccagtgagccatgatttagccacgctccaaactgggcaacagggtgggaccctgtctcggaaaaaaaaaaaaaaagttaaatggcatgaaatttcttaacaccacactaggagttagaagaaaatgaagtgaggcccttaaaagcttcttaaaaaaattatttcctatctagaattctagatacagtgacagaggagagtattattttttccttttattttgaaataattatattcataggaaattgcaaaaaatagtaccaagaggtcccatgtacccttcaaccagtttctcccaatataatgtttttatgttacatagaaacaagagctatacatataaacaaggtacacagtacaatattactaccaggaaactggccagacatggaggatgtggtggctcatgcctgtaatcccagcactatgggaggccaaggtgggcagatcacttgaggtcaggggttcgagatcacctggccaacatggcaaaaccccatctctactaaaaatacaaaaattagctgggtgtggtggctaatcccagctactcaggaggctgaggcaggagaatcgcttgaacccaggaggcagaggctgcagtgagcaacagtgagactctgtctcaaaaaaagaaaaaaaataaaacaaaaacaaaaacgaggaaactgacatcgatacaatcaaaagaccatgaatggagatttttttttttttttttttaatacggagtctcgctctgtcacccaggctggagtgtagtggcgagatctcggctcactgcaagctccacctcccaggttcacgccattctcctgcctcagcctccagagtacctgggactacagacgcccgccaccacacccggctaatttttttgtacttttagtagagacggggtttcaccacattagccaggatggtctcgatttcccgacctcgtgatccacccgcctcagcctcccaaagtgctgggattacaggcgtgagccactgcgcccggccccggagatggtttaaatgtgaaaattcccttcccaagcactctccctcaggatgctactggaatggggccatgcagggtggctcatgcctataatctcagcactttgggatgctgaagcaggaggatcacttgaacccaggagtctgagaccagcctgggcaaaaaactgagacccccccacctcaattttttaaaattcagaaaaaaattttttttaaaaaaaagctactagaatgtgttccactaaagtaaagaagtaatactcacgcctgtaatcccagcactttgggagaccgaaacgggtggatcaagaggtcaggagatcaaaaccatcctggctaacatggtgaaaccctgtctctactaaaaatacaaaaaattagccaggcgtagtggcatgtgcctataatcccagctactcgggaggctgaggcaggagaattgcttgaacccgggaggcggacgttgcagtgagccaagatcatcgcgcctttggactccagcctgggcaacaaagcgagactcggtctcaaaaaaaagcaaaacaaaacaaaaaacaaggccaggcgtggtgtctcacgcctgtaatccccgcactctgggaggctgaggtgggtggatcccctgaggtcaggagttcaagaccaagaccaaggttgcaggttgcagtgagccgagatccagcctgggggacagagcaagactctgtgtctcaaaaaaaaaaaaaaaaaaaaaaaaagtaatgcaaaagcaaagatgtggaattcaggaaataagaggatctaacacagtatgaggcaaaaggaattcctgggatgatggtgaagaaaaagcccaagaagacatcagtgcagcaacatggagagcaacacgcttaaagtggaataatgtcagagggctcagggagcaatttcttcaagatgaaagtgacagaatatctagaatacctgaacacactgaaagaagatgatctgggaaacaaaatgttcagcaggaaaggcaaggtaacacagtaacatagctgagctgtgaagagcatttatacagtccttaaaatctattttttttttttgagacggagtcttgctctggcaagactggagtgcagtggcgcgatctcggctcactgcaagctccacctcccgggttcacaccattctcctgcctcagcctcccgagtagctgggactacaggcgcccgccaccacgcccagccagttttttgtatttttagtagagctggggtttcaccatgttagccaggatggtctcgatttcctgacctcgttatccacctgccttggcctcccaaagtgctgggattacaggcgtgagccaccgcgcccagccaacagtccttaaaatcttacaatgtaaaccctgaatacaatctaaccaaaattctaccataactactagtgaggagtttggagagcagaaaatgtgcatgtttgtggtgggagtaagggagtgaggagagaggtaaatcttcggcttccgtggtttatggttaataagtaaggcctaaatccaatacaccaggcagtaccaattagaggctgagacaggagaattgcctaaggccaaaaattgaagaccagcctgggcaatatagggacaccccatccctaaaaaaaaaaagttttttgccaggcacagaggctcacgcctataattccagcactttgggaggccgaggtgggcagatcacctgagatcaggagttcaagatcagactgaccaacatggtgaaattatgtttctactaaaaatataaaaattagccaggtgtggtggcgcatgcctgtagtcccagctacttaggaggctaaggcatgaaaattgcttgaacccggtaggtggaggttgcagtgagctaaaattgtgccactgcactccagcctgggtgacagagacagattctgtctcaaaaaaataaaataaaataaataaataaataaatttaatggccaagcacagtggctaatgcatataatcccagctccttgggaggctgacgttggaagaatgcttgagcctaggagttcaaggctgcagtgagctatgactataccactgtactccagcctaggcaggagagtaagaccttgtctcaagaaaaatacaaaaacacaatgaaaccaaaggctgggcatcatggctcacgcctgtaatcccaacactctgggaggccgagctgaggcaagaggactgcttgaggtcaggacttcaagaccagcctgggaaacaaaatgacaccctgtcttcacacaaaataaaataatcggctagccttggtggcatgcacctgtagtccaagctacttggaaggctgaagtggaaggatcacccaggaatttgaggttgcagtgacctatgattgtgcccatgcactccagccaggatgacagagtgagaacctgtctctaaaaaaaaaaaaaaacataaataaatatctaaataaaaaagaaggctgggggcaatggctcacatttgtaatcccagcacttagggaggccgaggcagatggatcacctgaggtcaggagttcgagaccagcctggccaacatggtgaaaccccgactctactaaatacaaaaatcagctgggcatggtggcaggggcctgtaatcccagctacaagggaggctgaggcaggagaatcacttgaacccaggaggcagaggttgcagtcagccaagatcgcaccattgcactccagcctgggggtcaagagcgagactccatctcaatcaatcaatcaataagtaaaaagagttgagaaaaagtatataggctgggcctgggcgacaagagcgaaactccatctcaatacatacatacatacatacatacatacatacagacacagacacacacaaacacacacacacacacacacacacatacatgcatacatacaaacacaaaattgagaaaaagtatataggctgggcacggtggcttatgcctgcaatcctagcctctgggaagccaaaactggtggatcacttgaggtcagaagttcaagaccagcctggccaacatggtgaaacccgtatctactaaaaatacaaaaaattagctgagcgtggtgggcacgcctgtaatctcagctatttgggaggctgaggcaggagaatcacttgaacccgggaggcggaagctgcagtgagccaagatcatgccactatactcctgcactccagcctgggtgacagtgcaagattatgtctgaccaaaaaaacaaaacaaaacaaaaacccaaagcatgtaagtggaatactgcatatcatttctagaaagttcaagaaagagaattattacagggaaacatggatttgtggaatcttttaagaggatgaagatactccagaggaacgtaatgaatgaatcaatgtccctgaaaaggcaacaggggaattaatctagtatataagtaggagaaattagctttagataaaagaaggttcttcttttctttgagaataacaagagaaaagaacagatatgtgttggtgaggtgcctggatagtgcatgcaggaaacactcactttaatgatgttgtcaggagctctgttcatgttgaggttcttgattctcactgtcagttggcgggcagtcttgcaggttagaaggtacttgctgattagagggttaagaaactcagtcccttcaaaatgcttcagtcctaaagctaacaaactgagaaaggagcaataacactaaatctcacttcacagtccttccttctaaagggcctccccagactaacacattttacaatctactttttcttacttgttcttaaaacaaggtctcactctgtcacctgggctggagtgcagtggcgtgatcgcagcccactgcagctgctacttcctaagctgaagcgattctccagtctcagcctcccaaagtgctgagattacaggcatgagcccatggcgtgtggcccaatctactttttcatttttttcagacagggttttgctctgttgtccaggctggagagcagtggcatgattacagtgcactgcagtcttgaatgcctgggttcaatcgattcccgcacttcagcctcctgagtatctgtggctataaacgtttgctaccatgcctaactaatgttttatttcattatttgtagagaccagttctcactttgttgcctaggctgatcttgaacttctggcctcaagtgatcctcctgcctcggcctcccaaagtgtcgtcattacaggtgtgagccaccatggctggccaatctactttttctacaactaattcttgtagtgactactacaagttggtgactactcagtagaaaatttcaggtatttagtgagtagtgattaagtactatgaataagaatcaaatagttcacaattaagtaggagcaagagaaactagtcataaatcatcaataaatgtcagatcatgatgagctgtatattaacaacacaaaggaagttcaaagagaatacatgggaaggagaatgattctaataaaacaaatataaaatgaataataggtaccccgtcagacaaattaaactggcaccaatactaccctctaacataacatatataatcatggttacatatatacatatttgctgttaacagtgtggcaatacacacaaagggccataaaaatgttcataatctagctgggtgtggtggcttatgcctatagtcccagcactttgggaggccaggagtgggaggatcatttgaggtcaggaattcaagagcagcctgggcaacacagagataccctcacctgtacaaaaaaaatcagccatgtatggtggcacacgcttgtggtcccagctactccatggaggctgaggcaggaggatcacttgatcccaggagttcaaggctgcagtgagctgtgattgcaacactgtactccagcctgggtgacagagtaagatcctgtctctaaataaataataacattagaaaagccaacctcctgccttggcctttcaaagtgctgggattacaggtgggagccgccatgtccagtctaaaacattttaaaaatgtgtgtaacatccccccaaaaagcagtatttggcactgctagaacaagcacgttctagaggactctgctcatctatactgcttttccttttgtgtccatgtcttattatacaagtcttacttcccctaaactcctcaaaggaactacatcttctccttgggatatttgatcccccagagtaaacacttacttgtcctcagccttggtgaagaggatcttatcctggggattctttgccttcagggaacacactggaagtaactctggatacatgaaaaccttgcttgtggccaggatccaagccacttgctttggcaaacagggaaattcattggctataagaaaataaatctctgataaatcaacttctaggaaaaaagagggcttcaaaaagcctgtgaatgcatttttgcatttaggtagagctgtccttatctaacttgattccctcccatctgcctaccactccccaaagagtttccacagtctttcctcaactaacattaggtctaaagggagtcccattcactggcaataaaagttgactttttttttttttttttttagacggagtctggctctgtcgcccagactggagtgcgtggcgcaatcttggctcactgcaagctccgcctcccgggttcaggccattctcctgcctcagcctcctgagtagctgggactacaggcgcctgccaccacgcctggctgattttttgtatttttagtagagacggggtttcactgtagacaggatggtcttgatctcctgaccttgtcatccgacagcctcggcctcctaaagtgttggattacaggcgtaagccacggcgcccggcctctcttactctttcttacgtgtaacactttattcacaaagtaaaacaaacacttaaaaagtacctagtaatacctgtcacatagtgtatgctcaaaaatgttttacctcctttcccctttaaatctctgaaggataacagaccttcaacaatgcttttttcttccaggataagattccaggccaggcgtgctggctcacgcctgtaatcccagcactttgggaggccgaggcaggtggatcacctgaggtcaggagttcaagaccagcctggccaacatagtgaaaccccatctctaccaaaaatgtaaaaattagccaggcatggtggcacgcacctgtaattccagctacttgggaggctgaggcaggagaattgtttgaacctgggaggcggaggttgcagtgagccgagatcaccccactgcactccagcctaggtgacagagcgagactccatcttaaaaaaaaaaaaaagaaaaaagattccaacttctttaatctccctcacaaacctggtattccaaattttacttttatttcattctttcttaactttcattaagttctcccagattcctcctgaggttgggaacaaaagaaccataaaaggaatgagacaattcagtctcattcatttctgtctccctctctcagcctctcaattttaggcacctctgcatttctagagacaaaactactatatccatatttctccttccataagtgtcatttttatatctccagaagaaaaacacaggacactagatgtgtaagataatactataatttggtattaaatcacgttttcattaccatttcatataatatagctattaaagtagtttgggatctgtgtctatgatatagtacacttaaattcaactacattcaatgtaatgataagacttagggatttaaaatagaatccaaagacaaacccaaatccagaacaaaccacaactaatttgctaagtcagcaaacaaatcagaagtaaatatttggcttaagtaaatagcaaatattttctcaaaaaatactaaaccaatgcaaggtagaatctaaaccggcaaatttctttaaaatactgaacacggcaaatgtacaatctctaatttacgcctaacttgcaagtcaacatttcattcagaatggagatatcacctatgctacaatcattatggtaaataaagttagttgatcttaatgaagagaataaaaagctaaacatgaccgaactttaccacctgactttcatctttaccaggccccagtttatcttgatctgattcctaatacttacccctcatattgctgtagtccaattcttagcactgagcctcagatctctacctcccatattcctatactgtccactgcctccatgccttacccaggcccggagattatcatgtaattctagaacttggataatgagtacaaagggaggataaaagagagaaggaagaaattacaaatgtcctgtgtcctccattcctaggcaagtatcctaggaagttatctatgggataagattcccaccacctctcaccgcaagtaaaaacttaaagctgacacatctgtctcctaccagtcttcttgacagttttatgagggctgcagtcaatgctgacatgtgtgctgaagtcttcaatcagctgcatagctcccatcaagttacagggttggaacagggtctgaaacttggggttgtactgatggtgaagggcgatggagctttgagcaaaggttcccagctctttctgggaaaacacgacacaaggaagatctaagacaattccagacaattaataccaatagccttcagaatctaaatgagaagctgaccttcctactacaggataaaaacaggtaaaaataatcataaagtctttcacaataaactactgttaagattatgcctgagttctcagatattcagggattatattcttgttttatttttaaactgtttctcactaaggaatacatggtctagctcccgagctagaattaagagtctcaagaatggggactattactttaatttaattaattaatttattttgagacatggtctcactctgccgctcaggctggactgcagtggcatgatctcagctcactgcaaactccccctcccaggctcaagccatcctcccactgcctcctgagaagctgggactataggcatacacctccaaacctagctgatttttgtattttttgcagagacagcgttttcccatcttggccaggctgatctcgaactcctgggctcacaatccgcctgcctcggcctctcatagtgctgggattacagggatgagtcacctcacccgaccaggaccattacttttaaaattgttttgtcttttggtctcagaataatgcctacaaccaagtactcctcatcctcctctgaatacagtaagagatgaagacatcctgttgatcaccaaggaagttttagaatactagcaaatgtactcttcaaaatccaaagaagacttactgaagaagctgagagtattatcattacctgtccaaaagtttgaggcaatttttatgaggtaaagtatggttttgtttttgtgagacaggttctcactctgtcacccaggctggagtgatatataagcacggctccctacagtctcaacgtcccaggctcaagtgatcctcctacctcagtctcccaagttgctgggactacaggcactcggcaccatccccagctaatttttttattttttatttttttggtagggatggggtcttactatgttgcccaggctggtctcaaactcctgggctcaagcaatcctcccaccttgacctaccaaagtgctgggactacaggcatgagccaccatacctggccaaatttcaaatttaaaatctcaaaataggccgggcgcggtggctcacgcctgtaatcccagcactttgggaggccgaggtgggcggatcacgaggtcaggagatcgagaccatcccggctaaaacggtgaaaccccgtctctactaaaaatacaaaaaattagccgggcatagtggcgggtgcctgtagtcccagctacttgggaggctgaggcaagagaatggcgtgaacccgggaggcggagcttgcagtgagccgagatcccgccactgcactccagcctgggcgacagagcgagactccgtctcaaaaaaaaaaaaaaaaaaaaaaaaagctcaaaatacctcaaaacgtcatgagcaaaactagctctacacataaaacactaatattgagcttcatgaatggataatgaattcaacatctacatgtatatttacttcattatttaaattaaaacaaaacaaaacaaaaaaaacacagaccgggtcttactatgttgcccaggctgttcttgaccactgggctcaagtgatcctatcacctcagcctcccaaagtgctggaattacaggtgtgagccactatgcccagcctcaacatctatgaaatgaatagcggtaccaaaaacctaagaagtcagggtgaatctaaagatgaggaggaggacccaataaaaatatcagaaggacaggccaggcgcagtggctcatggctgtaatcccagtactttgggaggtagaggtgggcagatcacttgaagtcaggaattcgagaccagcctggccaacatggcaaaaccctgtctctactaaaaatacaaaaaaaattacccgtggtggtgcccgcctgtagtcccagctacttgggaggctgaggcaggagaatcacttgaacccgggaggcaggggttgcagtgaactgaaattgttccaccgcactccatcctgggtgaaagagcaagaccctgtctcaaaaaagaaaagaaaaaattgaatacactctttgtcctttcatgtgaatcagtggcttatgttcactcagcaaacataggaagccacagcaatcaaaaatacctgagagaataactgtgagaaataacctgccaagctaattttatattctagtctatagaattacggcaatttggaaacttacaagacatatcctggtgctactggcctccggattgagattggggttgcaggtggcaagaaggtggatttgtgtcaagagctgaacatgctggggagagaaagaaaataatgcagtgatatgttatgacactgccatttcaggagcccagagatatttttttttccccctggagacagggtcttgctctgtcacacagcttggagtgcagtggtgcaaccatgactcaatgccctctcaaccacctgtgctcaagcaatcttcccacctcagcctcccaagtagctgtgaccacaatgcctggctaatttattttattattattattattattatttttagacagagtctcgcactgacttttgggctggagtgcaatggcgtgatctcggctcactgtaacctctgcctcccaggttcaagtgattctcttgcctcaacctcccgagtagctgggattacaggtgcccgccgccacacccagctaattttttgttttcgtagagacggggtttcaccatgttggccaggcttgcctcaaactcctgacctcatgattcacccgccttggcctcccaaagtgctgggattacaggtgtgagccactgtgcccagccttatttttattttttgtagagacagagtctcactatgttgtccaggctgcttttgaactcccctgctcaagcaatcctcccacctcagcctcccaaagtgctgggattacatgtgtgagccactgcacccagccaccagagagtcattaactaagatgtttgcaactttatgacacaaattttgctttctgcaaagagtgtgagaacaacgtaggatcttggcataaatttctcagacatgttcccttgaacaaaatgacagaaccagaggaagtttaacctctaaacagaggaggaactgagattagaaaaggaaaaggccgggcgcagtgactcacgcgtgtaatcccagcactctgggaggccgaggcgggtggatcacgaggttaggagatcgagaccatcctggctaacacagtgaaccctgtctctactaaaaatacaaaaaattagctgggtgtggtggcgagtccctgtagtcacagctactcgggaggctgaggcaggagaatggcgtgaacccgggaggcagagcttgcagtgagctgagattgagccactgcactccagcctgggtgacagagcgagactacgtctcaaaaaaaaaagaaaaaagaaaagggaaaagggaaaaaaaactacttgtcacagtgaaggttaaatttcagaatagattactgaggactctttgaaatctgtaattccgaataccattagggtccttatgtgctgtcttccctgagccacaggacatgaacatgatgacttctcaagctcctaactgatgtgaagatactacggttttaatacgtagtaaggtaactatctctgacatttacaaagctgctaattttagattataccaaagcctcagagttaggccttggtataattcaatattaatatgaccaaggaaagtgttacctgctgcatctgctgctggagtctcttcctttgtgctgggtccagaatcagggtctgatgaacttccttacactggggtttaaccttctctacctccttctgctgtttggctgaaggtttcttcatcttcagctgttcaaatagttccttcgctatctgatgttgttcatttagtaggttggccagtagttcctcaaacctatcccaaacggggatgactgaatttgagtgttttcctaggtccacaacacatccaattctttgcaatgatgagcaaagagcctgaacaattttcattccctactaatccccccttttcactttagccaacagtcaaactcccagccttacacaaatcttttcccaaagtagttagcatgcatcaaatgattctgtattacaccccatcccattcctctacaattcctcttccaaataatatacaaatgaagaaaaaattaaacaaaaaactagggacagagaaatatatgggtaagaaagcagccaaggagctggtgggaactcatcattctcatttcttctctcattacttgttactccctgggatgttactcccatcccaggtccagcttgtcccattatcctatctactcaggctgcactgccctgctttcttaacaagtcaaagactttctagcatgaagcaggaaaaggatataccaaaataactgaagtacatggtagttcaaatgaacagaacggagaagttagttaaaatattatccatgaaggctatcttcttttagccctttaaattcctcttccaaggttcctaaccctaacttcccatccataccctcctgaaagattgtttgcagggctgaagcaaaaattccaatacctagcatgtcagttctatgtatgattactataccttttctatgtttacatagaaagaaataaagggagaataatatacctaaatgattaagcatatgctgataccctatgcaacaggataagatctgctgaagtagctataacaagcaggttatcatatttcaaggaaccccctatattacagcaatagttaaatggtaacgtttttcaatagtttttgcagataaagattacgtttgaataagttttcttttatagtatttactgtaggtttgggtagcacagagtaaaaacctgaagaccgtgggactgtctatacaatctttactgagaactgaaaatttgaacatccgcgctaccaccactgaaggaacagaagagaagaagcataaaaaagtagaaaatggaaacatagcctgcacttagttttaacaaggattatttaggtaattgataagggaagccccagagtttttgttttgactgtctttttctcctctctcttccttattgtgttttaagatgtgcttactctctatggacttacagagggatttttatttagtcaaagattaaaacaaaaacaggtttgtatttgcaatcgaaagagaagcagaagctgcccaagtacagtcatgcgccacagaatgtttcagtcaataacgaaccacatagtcagaggtggctccataagattactgtaccttttctatgtttacatacatatgtacttaccattgtgttacaactgcctacagtattcagtacagtacagtaacacactgtacaggttttgtagcctgggagcaataggtatgcagtaggctaaaccatttaggtttatgtaagtacattctacgatgtttacacaatgatgaatcgtttaatgatagatttcacagagggtatgaccatgagatgatatatgactatattccattgaataccagaaggtaactggattctaacaggaattttaaattagttctatattttccaaattttaagaagttataaagagttgatcagcaaaaccaaaatatttattaatcagatcctattatacgttcccaggatgaatggttccattctgctataccagaattttgttctatgaactataaattaaaataatgggtcaaatactgacttagcaatcttgagatttttgatgtagttgtattgtgatatttgttgtaatggagaatgactagtagttctagtttttaagacattggttggcctatcttatcttttttcactaaattggaaaatccctaaaggtctagctttcagatggaacccaagctctctgcttagtagtgctgttaagttcaaacacaggactaattacagggactattctctttgctttgttccacttatggcacaaactgcatcctgacctctcgccatcgacctaatgattatatgctgctacaacagaataaagtgcagatgcaaatccaccacaaaatgaggaaaaaattaaagcctctactttctggatgctgtaacacaagtgccaactttaggcaaaaaggtcagcacgtatgtttcagactccttactgcaggtgcttcagggtttgctccactaatgcctaggtgactaacaaattttcagtcacatttagcagatattaatggcacataaaaagaacaaaagggacagactggatattacaatatagggtagtttgtgtggctggccacattgagtcctacatacctctccagcaccactcacccggagaagtggatatggatgccagctactgttttttctcccttcccaaacagatacagcttggcctacagctgcactgccccataacaaggagacttcacttgacacctaactcctgacaggactctgcatccttacatcagtaacagaagctggctggggatgaaaaattgttaactgcaacttctgaaaaccttttcagaaataaactcttcctctattccaaatctcaaggtcttcaactagcctaccgtagagcttgaggggtgttaaagttagcttgaggctcagccacacgctcctcctcttctgggccatcatcttccatgttggagaatcccatctcatcttggaactgtgggcaaaggaaagggagggttttcctggggaatgggcttttgaatgttgctccagtgttgggaaggaaaagtgaaaactataaacaatactttaataatgctggcacccagaaagagcctacatcagaacctttctcacttcaggactcctacaaacccacatatggaatgactattatgccaggaaagaagttgctcaaccagtcaacttgtatcagtaagcacagagctaggataactcaaaatgatcaatttcttaaacagaaatatctttttagacaaatttatggaaaaggtaattatttgtgtgcaaaatactttaaaactagttggcaatctttaaggacacaccaaatgacagtaggggaagccatcaaaagttttcaaggggcaagatgtgctggctcacacctgtaattccagcactttgggaggttgaggcaggaagattacttgagcctatgagttccagaacatggcaagaccctgtctctacaaaaaaataaaataattagccgggcctgtaggtgtgtgcctgtagtcccagctactcaggaggcttagatgagagaattgttttgagccctggaggtcgaggctgctgtgagctgagatttcaccactgtattctccagagcctgggtgacagagcaagactttgcctcaaaaaaaaaaaaaaaaagcttcaaggaaaattttagtaagaataacctacatgtggataatcaagagtctagcagttagcaaatttcttttgtcattatattctttcccaggtagactaaaaggagaattggttcagtccctcttctagaaggagcatcacagagatcaaaggacacattttgttggagaaccaacttacaatcccatgttctcacttgaggatcattactcacagtttcaaacagatcttccatcagctcatttgcttccttttctgcaaaaaagccaaacgttgttggtataaattagattcattttacaatatggaggaattccatgtagacaatgtatgatgttttcaacaaggcatctgacgaattcttcatatctatccttattcctgagacagggtctcactctgtcacccgggctggagggcagtggcttgatctcggctcactgcaatctctgcttcccaggctcaagcgatcctcccacttcagccctccaagtagctggggcaacaggagtgtgctgtcatgcccggctaattcttccatattttgtagagatgggttttccccatgttgcccaagctggtcttgaactcctgagctccagtgatccacccaccttggcttcccaaagtgctggggttacaggcatgagccaccacgcccagctatccttcattcatttattcaaaaacatttattgagtacttactatgtttcaatccctgttttagatgcttgggatatatgagagaatgagagagagagagagttctaatctcattgaacttaaattctaataggaagaagacaaggagaaaatgtgagctagatgatttttttttttttttgagacggagtttcgctcttgttgcccaggctggagtgcgatgacacgattttggctcactgcaacctccgcctcccaggttcaagctattctcctgcctcagcctcccaagtagctgggattacaggcatgcaccaccacgcccagctaattttgtgtttttagtagagatggggtttctccatattggtcaggctggtctcaaactcctgacctcaggtgatccgcccacctcagcctcccaaagtgctgggattacaggcatgagccaccatgaccagcccaatgattttataattagatggcctatccaaacccacacaatactgaatggaatcaagagacaagtctcccaacctgggcaaaatgtcaacatatctctaaaaaaaaatttatctgggcttggtcgcacatgcatatagtcccatatacttgagaggctgaggtgagagaatctctttgagtccaagaagcagaggctgtagtgagctgagaccgtcccactgcattccagcctgaacgacagagcaagacactgtctccaaaaaaaaaagagacagacagagacaagtttccaacagtgtttcataggactctatctttggacccgacctattcaaaaactccatcagtgaattagaagaccaagagaacatacttaacaaatctgtagatgatgtaaagctgtaaagctgaaagggactgccaatccaattgatggaaaattcagaatcatattttctcaaatcaactggatgtaacacgtaaggataaatttaaagttctacattgaggatttttttttttttttttttttaaatagagccagggacttgctatgttgcccaggctggtcttgaactcctgggctccagcgatcctcccacctcatcctcccaaagtgctgggattacagacatgagccaccccacctggcaagatcttatatgtgtattcaagatattacacaactcactaagtctccagatgaaaaccagaatctctaaatatagtttgacagtttgacaatgcccaatgacagactaaatgagaaattaggaggcagcttgatttttttttatttcctcagagatctttgttctgagttctgactcttgttctacaaatattcaaagtcgaaatgattatcatgttaatgggtaaagagcttcaaatctttggctatctcatttttttttaatttttattcatttgttttaccttatgtgttcctctacaatggttatctaggaagttaacaaccattctagctatctagcattctggttcttgatatcatgtaaaatgagcgttctgatctctgacacacaaagctatttagaagataaaaaatagacatttttttcaacaatcattttacttttttctctacatctacatactctacatgtcagagtttttgtttctgttttttcgagagtagctgggattacaggcacctgccacaacacctggataattttttgtatttttagtagagatggggtttcatcatgttggccaggttggtctccaactcctgacctcaggtgatccacctgcctcagcctcccaaagtgcagggattacaggcatgagccactgcacccagccaagtactttgattcttaatggaggatttaatccactgacatcccaaaggacaaactatccaatggaattcctggataaaacacaggcacacagtgtctcttcctcagaggaaagaaatttttgtcaacagaagaattttgctcttctgggcgtggtggctcctgcctgtaatcctagcactttgggaggctgagcctggaggatcacctgaggtcaggagttcgagaccagcctggccaacctggtgaaaccctgtctctactaaaaatacaaaaattagcctagcgtggtggctaatgcctgtaatcccagctacttgggaggctgaggcaggagaatcgcttgaacccgggagtcggaggttgcagtgagccgagattgcgccattgcactccagcctgggcgacaagagcgaaactccatctcaaaaaaaaaacaaaaaacaaaattgatttgctctagcagaaaaataattatatttcaggaattccttcaggaatcctataccagtactaaaagatcctatattggaaaatgaaaatgcccaaattaataagtcctgagatagaggagaagggatcttgttttgtccatcactgtatcttagtacctggaatagtgcttggcacataataagcattaaatacatacatggcagtcttgtttctgaaccaaaatgaggtggtttaatgaaagagatgggtttggctaggcgtggtggctcacacctgtaatcccagcactttgggaggctgaggcaggtggatcacttgaggtcaggagtatgagaacagcttggctactggctaacatggtgaaaccctgtctctactaacaatacaaaaattagccaggtgtagtggtgcgtgcctgtaaacccagctgctcaggacattgaggcaggagaatcacttgaatccgggtggcagaggctacagtgagtcaaaatcctgccactgcattccaaactgggctacagagcaagactccatctcaaaaaaaacaaaacaaaacaaaaaaaacaacaacaagtgaaatactgaaatactgatcagctttaaaaagagaactgtcataaccaccccaatttagttccaagacttaggcttccccaccaaggcaaaattaacacagtaagaaggctattccagttcattttggagaaaatcttggatttggtaagcaggtaaaaagagctgggcatgctggctcacatctgtaatcccagcaaactgggaggccaagacaggaggatggcttgaggccaggagttcaagaccagattgatctacatagcaagacctgggccaggtgcagtggctcactcctataatcccagcactttggaaggccgagacggctggagaacttgaggttaggagttcgtgaccagcctggccaacgtggggaaaccctgtctcaactaaaaatacaaaaatcagcagggcgtgttggcacgcgcctgtaatcccagctatttgggaagctgaggaaagagaatcacttgaacctgggaggcagaggttgcagtgaggcaagattgtgccattgtactccagcctgggcgaggagagcgaaactctctctcaaaaacaaaaacaaaaacaaaaaaccatagcgagacctaatctcaattaaaaaaataaagaaattgtatacacatacatgcacatatatgcacactacacacacatatcacatgtacgttttgagaaaaataacaccatgaacctactacccgttaaaaattagagaaaatattaaacttttcacaaatttacatagcattcttatacaggggccatgtcaatagaaagaaaggactatcagacaatttttcctaaaacttctccattatctcactgaatcctataatctgtcctattaaaacacctttttacatttcttgcttttttttttttttttgtgagacagagtgttgctctgatgccgaggctagagtgcagtggcatgatttcagctcactgcaacttccccctcccagttcaagcaattcttggttcaagcaattctcgtgcctcagcttcccgagtagctgggactacaggtgcactccaacacatgcagctaattttttgtattttagtagagacggggtttcaccgtgttgcccaggctggtctcgatcttctgagctctgacaatccatccgcctcgtcctcccaaagtgctaggattacaggcgtgagccaccccacctgaccaatttcttgttcttttaaaagtacagtaattatttttaagttccagtaataaattaatgggtagtctgtcaaatagctactggattttatatcaggagggctttctacatgtatgtatacccaaaaatgacattaagacctttttacataaactcactgtagagatacatcccaaaacaaggtaaggaatataaatgatgtttaccttcttttcaaaccaacagttcctttatacaaaaacaccagatgatacaaaacatatttttttaaagtacaaagttccatacagaataaaataaacactttatggttattcctaagaataagtagtgacaaaaagtctttgcaattgggtaataaaatttcagcttctaggaatatgtttccctcttccttgtccttttgagagctgccactatcacacaattcacagcatctcttcaaccacagaaaattagcgtctcttcaagcacagagaccatatattaattatctttgtgtctcctgcataggattaactcagtgtttgttataactaagttaaactccaagacaggagcttcaaatcacctcaggcccaatccaaaactgaaaaaaagacgcttctcagagtttgagaacaaaaagatactgacaaagaacaaagccatagatacttgtgcgacattagcttccctttttaccaaatacagagtcatttactaatactgcagaaatgtttgcagacgataaaaagaataaattaaaaatatggatcctgtcaacatgttcaaatactaacatagactccttcaccttaaactcatactaacatccacacacccgaacaatgaaaatgaaaggttttcaaatgagatctaaatataaattggctctatttcattacagtttaagttcctaaaatcatatatataaatcatgtgattgcgcttatgctcatcttctaacttgagggcccagtgtctttcatccgattctctgaaggataagtgaccccaaaaaacttttaagaaccactaatctagcctatcaagaaacatcccattttccagaagaatacagctaagttggcttagttcatgcattcttacctcatattcatagagttcatagacgggatccttactacatgaaatcagtcttttttttttttttttttttttttttggagatggagtctcctctgtggcccaggctggagtgcagtggcgcaatctcagctcactgcaagctctgcctcccgggttcacgccattctcctgcctcagcctccccgagtagctgggactacaggcgcccgccaccacgcccggctaattttttgtatttttagtagagacggggtttcatcctgttagccaggatagtctcgatctcctgacctcgtgattcgatctcctgacctcgtgatccgcccacctcggcctcccaaagtgctgggattacaggtgtgagccaccgcgccctgccgaaatcagtctttcaaaggattccttcagcccagccaagaagttccaacatccacaggcacatatattaacaattaccagtacccaaaaacagttctctggttttaattccacactgcctccctcaacttaatacctaccaccgtcaaaacaactcccctcagattgcatccaggctatttacagagacaccttgatgatcctcacctcaaggcatggaccattcattgaatggttatatttgttgaatgagtgaaaaaggatccttcctcccacagatttcaagttaagctgtcagcacccatgcagctgctctggtacaagttaagctgtgaaagccttctccctcacgcatacaaccttaagtgtcagaaatgctctgcttcctccataaatccaaaataatatagccatggatatgcatttcatacaggtcagactcggcaaggacagctacgttccacatacatatctgacacaatcggtctcccccaaatacaagccaaccagtcttatgtgctcctatctttccagcatactcagatttgccgacaaagacttcctgaggcaccatggtatgctgaatatactgctgcagtagtagtgaaaatatgggagttacagttccaactttgtcaccaatttaacatgcggccttggagaagttctctccttatgcctaaatttcctattttgtaaaatggaagaaagcatcctaccattttcacagagattcagtatcacaaagaaactgaaagagctttcttattgtattgtaaactattactataaacccgcgacaacaaataaggccacccattctttacagctttgtagcaatgattctgttaaagatattttggcccttcacatttacacaactcactctaaccaaaggcacaaactattcttaagaccacaactggctatgccaagtttctcccctccctgacctcacagacacatgctgtacagaacactaccattgccgctctttcccaacaagtaactaggggctcccaatccctaaaatacacacacatatcaacctgcaaggaacctcccaacatttattcaagaaataagctaacttataaggggaactccattacacttacacaaataaaggcaaactcttacggaaacacttgccatcctcacatacacacaccaacacagccgctacacaccaacagaccatctgtctgctagaccaaaaacatctctttccatgtacaaactaaccagtgacatttattaaacgtacaacactgagatcatcctgtcgttcccacataccgttcaacgcggcagggacaccacagaccttgtcacacaggtaaaatcccctctcaagatcgtgtcctcgaccactcttatcccttaattaaacacacacaaactggactatgggggaggctccgatcatgcctacaaacacaaactaacctgtcaggggcacagccgactccgcctccactcgcttacttcccagccccctccgggagtctgcctgtcagggacaccccttcaccccgcctggagggacttcccggtaggctcaggatccccctccctgctctcccctcccccatcttcaccactgctctcccagaggtccaggtccgggagatgacagtggctcccagaaagcccaggattcaatcgctgagagagtgcttaggcccgaatgccggcccaaatcgttctactcaccgtgtcggaggccgagagcgatgagagtacagggaagtgaggaagagggggtggccgccaggctcctccgcttccctgggtccaccgcggatccctcccgcttgtcaggaggcggccagcgggtaagccgactggcggaaatgcgagagaggagaagggaaaggtggagggctaaaggggcaaactgagaggaggcggatcccgcaaccgacactgggatcgtttcccctcgcaaagcgaacccaaaatggcggcggcagcggcggcagcagagtggccgcggcagctcctccagagggagggagctaagggcgcctagcgacacccccaacctcccactcctccctcctcgcgttcttccccacggtcccccgcttcgcccgactccggccatgtagcgcgcacgtcagcccgcacgcgtacgagtgtctacgggctcgtcgctggctgctcccaccaaccaccaccttcggccgtcctgcgagccagccatcccgtacgcgctcacccacgggaacctcctcgcccagttctccactccccctcagaccctgtcaagccggctccagcgcaggccctcacgcgtaccttcagcggcgcgagcccaagccttctccacctcctcttctctcctccccctccctccccgcccgcacggccaccaaccgccgccaaagcagccgccgccagcacccccaccctacactcctcgcgcgtgcgcctcccacagtccccaccgcgggactgttccattcctggcggctgcaggggcaggagaggaagggaccggcaaagcgagtctggcttgccgtttgactggaattgccagggtggccggccgagtcccatgacaacctacctccctgggttcgtcgccgcggcgctgcggctcgcctcctcctccatgggaccgcggcgaggggatcgagggcggcctagcgcccctctgccggccggtggtt

SEQ ID NO: 715 - DNA, 29591 bp, Homo sapiens; identical to SEQ ID NO: 714

SEQ ID NO: 716 - DNA, 49919 bp, Homo sapiens
gcagtctcaggacgggcgctttggagccggccccaggcagcgtgtgtcggtcgcctagtctggagaactagtcctcgactcacggtgagggaatggaccgacacgggtattgtaccgctgagggaaaggagcgggactccggacctccaggaggtagggagtgaggccggtagaccggcgcgcctccgggggggattcctcccgggcgttgagttgccaacctgggacccgaggaagttcggcgtggtggtgtgctttttgttgttgttaaccctcctcggatttctcgaatttcacaccactgtccatatgcgatgatgtttgtttgcccttgacgcacttactcatggatggtacttcagcctcgttagacagcctggtgatggaggatgaagaaaccatgtgcttctcattcagttctggactcagtttcccttgtcttcagcaagttatttttgttagttccttatcaaaaagtgtacataaaaattaggcaactccaaacatgcctccagggttggtgtgtgaaataataagatagggctgggcgcggtggctcacgcctgtaatcccagcactttgggaggccgaggcaggtggatgacaaggtgaagagatcgagacaatcctggccaacatggtgaaaccccgtctctactaaaaatacaaatattagccggccgtggtggcgggcgcctgtagccccagctactcgggaggctgaggcaggagaattgcttgaacccgggcggcggaagttgcagtgagccgagatcgcgccactgcactccagcctggcgacaaagcgagactccgtcacacacacacacacacacacgaaataataatatatgtaaagtggaattagctcctaggcatagggaaggtgcagagtattgccgtgttgtcatttacagttctgttgatgtcgataacgtttgtgggtgtaatgggtagtgttctgtccctccaagtcgttaataaaacaaagcaggccgggcgtcttgttaaatagttgtatcaatgacttgatttagattaatgaggatatatttttcaaatttatgccttttacaaaatttttaaagagtaggtaatgtcggtgatagatataaagaaaggaaaagatctccagatgtggaatcttctactggatcctgtaacagaaagaagacattaggctgggcgcagtggctcacacctgtaatctcagcactttgggaggcggaggagggcgcattgcttgagcctaggagttcgagaccagcttaggcaacacggtgaaaccccatctctacaaaaagacacaaaaattagacaggtgtggcacacgcttgtagtctgagctacttgggaggctgaagcaggaggattgaggaagaggttgcaaagttagccgagatcacgccatcacactgcagcctaggtgacagagcgagaccctgtctcaaaaaaagaaagaagacattagcagaaaagctgaggaaatgcaaataaagtctgcaatttttaaatagtattgtaccagctttaatttcttaattttgaaaattgtaccatggtcatatgtatgtaacattaaggaaactctaatgaaaattgtaagaaagcactttgtactacctttgcaactcttctgtaaatttacacttttttttgtttgtttgctttgagataggatctatgtcgccaaggctggaaggcagtagtgcagtcctggctcactgcaacctcaagctccttggctcaagggatcctcccacctcagccatctgagcaactaggactacaggcacatgccaccacatccagctaatttattttattttttttttgagacggagtctcgctctgtcacccaggctggagtgcagtggcgcgatctcggctcactgcaagctccgcctcccgggttcgcgccattctcctacctcagcctcctgagtagctgggactacaggcacccgccaccacgtccagctaattttttgtatttttagtagagacggggtttcaccgtgttagccaggctggtctcgatctcctgacctcatgatccacctgcctcagcctcccaaagtgctgggattacaggcgtgagccaccatgcccagcctccactatcgaactttagaacattttttatcacccccaaaagaatcttatcagtaagttgctttccattcctccctcccattgcctctcgcaaccactaaatcagtttatgtaattaataagcaaattatggacatttcatgtaattgaaatcatactatatgcaactgtcttcttttactttgttttgaaggttcatccagttgtgtaatgcatcagaactttgtttcgtattgccaaataatattccattatatggctataccacgttatgtttattcatcaattgatggacatgtgaggtatttccactttttggctcttatgcataatactgctacgaacatttgtgtacaacttttgcatacacttgtttttatttctcttttatacctgagagtggaattgcaggttcatatggtaactccatgttttaccttttgaggaactgccaaacttttccaaagtggcctcaccgcttaaaaaatcctaacagcaacatataagaatcctagtttttccagattctatccaacacatgttattatcagttcttttgaatttcatcattctagtgggtgtgaagtgtatctcattgtggtttttatttgcattttcttaattttgggggaccagtctcagcaccacccgtagggtatccgaagtccggtggcgacaaaggaatgagaagagacaggttaagtgttcataaaggtgggagccagggggccagttgcaaaatggaggctgcaaaaggcccagagttctgatctccacactgtttattgagtacagtcacttagatctaagaagcagatgttcagggcgaaacagtcaaagggaagcagtacgtcatacacataatctgtagcagtggcggtttaagtgaatctcctttgtgcttaaacaacgtatctttagttagctggtgggagtgggcttaactaggagcctgcatatctagccacattccagtgcttcagaggagcgtctttcttcttgagcacagtgtttatagataagagagcaggttgtgctcagagcatgggaacataatggcgataagaaggctttcctcctcagagtcctcttgtggctttccacaacttactgtcccatgtttttatggccagtttatgcaggcaccctgtaagcctttttcccaacatgccccccttttttcttttttaaaactgccattgctattaagacttgttcctggtgtctggtctctctccagaggcatcttccgcatctgcagactaaaagcaaacagcataaacaggtacacattaaagcaaaatttgcgatagttgattctctaacggtcttaatccacttaagaggatttatgtttgaaagtccatcagcagctccagtgagaatgtcagtcccaggcaggagagttaaatgagcctgagatgctttaaaaacctgttcctttaatttggctatattcagtgtaaaatttccatccctttcttccagatgatgtctaactttttcccagtgatgttcagtagcattgtatgaatggggagttatgcagaaatcagaagtattccaatcacattgcatttgcaatcgatgctctaagcttattatacgatctctcatccaaataacagtctgtctaagatcatttatttgatttgccaattgttggtctatccgggtctgataattccacaattttgaggaattcttttgccaattatttacatattctgcagtttgaacagaggagtgtaaagcaattccagcagccacaacagtagctgtgactgcaataaggcccataatgactgctataagggtaaaaataaatctttttgttctggtaaacactccctttaacatttctgtgaggatatgaatggaagaagaggctttccaaggtctattgagggaaaccggtatctaaactcctctagccctcaccagcaacacagatgttttcacatcaaacgtggaatcaatacaggtgaaaaggtgacagttttgacaagtaatagtttgagaattaggtcgaatatcaatatttccgaccatcaacataaaaggaggcttgacacagctctgaatgggcgccattcggttggaagaaaactgatacacaaattgaagtctctcaccttttccctcaaggtaatatttttcttctcaaacctgaatatgagattgggccatcattaccttccataatttgggatgttcagggcctattattggattaatcatttttggatgtgggccggctataccaaaattggttgaaattatgggaaactgggcatgtttttcagtgtaaatagtgtcatctctttgacagtatagttcctgttttagtcctgtcttgtatctatcattctgattggtacaattaactgcaaaggtccccttaggggaccaatcagtgacaattccataggaattattttgaagtaccacagcgtgatcagagatgcaatcctggccgggagtggtggctcacgcctgtaatcccagcactttgggaggccgaggccggcagatcacctgaggtcgggagttcgagaccagtctggccaacatggagaaaccccctctctactaaaaatacaaaattagcagggtgtggtggcacatgcctgtaatcgcagctacttgggaggctgaggcaggagaatcccttgaacttggggggcggaggttgcagtgagctgagattgcgccattgcactccagcctgtgcaacaagagcaaaactccctctcaaaaaaaaagaaagaaaaaaaaagagatacaatcctttcaaatcaatatttctaaatcatttgactgttgttgaggttgttgacacctctcttttctgggcttaaactgttacagttgaactgaactctgtggatgatccgggctccatccagaaaataaatgataggatactggtctttgattatgacctgaaattttaactagccaatgttgtccgtagccttttaggcaaccgacagctggccctatgcaaagaggaggggaactgataacccatggacatatttattaacattccttcctcctctgggtgagagggcccttgagtatctgtaggctcaggcatccaaacactattattaacataagcctcaaccgggggttccaaccatgtgacaggcctaattaaaggtggaaatgggacgtatgcccaataggtataattttggtctgctgtagccacagggagacttaccaccatggtaattaccgcaatcatagctaccatcaggttactcgaggttagtggtttttgttgtgttttcaggttttcttctgcaaggtgggtcagcctcttgatctgtccccaagttggtgggctcgcttgatgggttttgttggtcttcatctggttggctgaaatgttcattcgagccatcaggcgtgctgggagtggagatcttggttccaaaatccttttctcttctttggaaatttgctcatggtagaatttaagatgtcttgtaggtacccaaactggaagctggttttcttctggggaaatacaaacaaaccctcttccccatgttatatctctctttttcccaggtctttgttttaaagtccttccaccacacaggttttccttcatgaacatttaccttctgtcctgttaaatgctcttcagctgctatagtaacctgattgcggaagatgttcaaaaaatttaaggtaacaagagccaattgtaactgcatatgaggggtggaatattccctatctccccctattttctttttatgtaattgcatttttaaggttcagttggctcgctcaacaatcgcttgcctttgagaattataggggataaccgtactgtgttcaatgctctgttgttttaaaaatgtttggaaagatctactacagtagcctggtctgttgtctgtttttaatttttgtggaattcccatgacagtaaaacaggaaagcaagtgtctttttatatgtgttgtagtctggctggtttggcaagtagaccatataaatgagaatatgtatctatggtcacatggacataagaaagtttgccaaatgcaggaatgtgggtgacgtccatttgccagatcatgttaggtgccaaccctcgagggttaacaccagttccttgatacggtagttgcagtacctggcactgaggacgatgttgtacaatgtccttggcctgtttccacataatttgatagttgtttgtaagtcctgttacattaaggtgtgttaatgagtggaaagtctgggcatcagtaagtatgggggaaaccaacaagtcagcttgctcattagcctcagtcaagggtcctggaagattggtatgtgctcggatatgagttatatagaaaggaaaatcccgagcacacacagctgtttgtaaagagttgaacaattgataaagctgtttatcaataatatatttaattaaggcagtttcaatatgctgagtagcttatacaacataagctgaatctgaaacagtattaactggctgattaaaatcttctaatactgcaatcattgcctgtaatttagctctttggactgaggaagagttagtgtggataactttaccacaaggtcccacatatgccgctttcccagtactggagccatcagtaaaaacaatcatggctccttccaaaggggcatcacgagtaattttcggaagaacctatgtagttaattttaagaactggaaaattttatttttaggatgatgattatcaatacattcaataaattctgctaaattaacttgccatgtaactgagttaataaatgcctgcttaatgtgacttttatttattggaactataatcttattgggctcagtgccataaagtttaacaatttgcatatgagcctgtccaattaaaattgtgatctgatctacatagactgtaagtgttttcatggtattatatggcaaaaaagaccattcaaccaaatcattattttgaacaataaccctcattgaggagtgtgaagtagggaacacaatgaattgaaaaggcaagactgagtcaatcctactaacctgggcttgctgaatttttttttttcaattactcttaactcattcatggccttgggtgttaattctcttttatggtgtaagttgcaatctcccctcaatatttagaaaatattagacatagcataagtagaaattcctaaggtgggctgaatccaattaatgtctcctaacaatttttgaaaatcatttaaggtttttaaagaatcttttctgatttgaaccttttgaggcttaatggctctatcttgtacttgtatccccaaatattgaaaaggaagagttgtttgaattttgtcaggtgttataagcaatccagcatttgtaattgccttttgcaaagatgaataacattgaataagttggtctctattttttgttgcacatagtatgtcatccatataatgaatgatgtaacaatctggaaattgatctctaactagctggatagctttgcctacaaaagtttgacaaactgtggaactgtttaacataccttggggtaaaaccttccaatgatatctggctgcaggttctttgttattaatggcagggatagtaaaggcaaatttttcaaaatctgtctctgccaaaggaattgtaaagaagcagtcttttaaatctataataacaagcagccagtctttagggagcatggtgggggatgggagccctggttgtaaagctcccattggttgcattacagcgttgacctcttgcaagtcggtcagcatgcaccatctaccatactttttttaaaattacatatactggggaattccaaggagagaaagtgggtgaaatatatcctttttctagtagttttttaactatttcatggaacgcccccaagtttttctgagggagcggccactgttcgacccagacaggatgctgcagggtgagcctgaattgcttcttcaccatagtgaactgcaggttgggcagtaatgggtgcggcaagctgagtttcaggctccctccccctgcactcactcagctgaggaggaggtggccattccggacatttctctgaagaagctgcgggctgaacaattttctgtgtaggtttagggagaccggggggattggtagaaatcacctccggtatcgggggaaccagcccccaatatttcaacataggttctattttccgtaagtgtgccagtctgagaaataaagagaaagagtgcaaaagagaaattctacagctgggtctccgggggtgacatcacatttcagcaggttccatgatgcccctgagccgcaaaaccagcaagtttttattatggatttcaaaaggggaggggtgtacgaatagggagtgggtcacagaggtcacatgcttcagaggcagtaaaatatcacaaaggcagagaggcagagcgagatcacaaggccagggcgaaactagaattactgatgaaggtccatgtcccgctgggcacattggacgttgatattgataaacatcttaacaggaaacagggttcgagagcagacaaccgatctgactagaattcgccaggctggaatttcctaatcctagcaagcctgagggtgctgcaggagaccagggcatatttcatcccttatctccaactgcataagacagacactcccagagcagcgattttacagatgtctccctgggaatgcattcgttttcccagggttattccttgctgagaaaagaattcagcgatatttctcctattcgctttctgaaagaagagaaatatgactctgttctgcctggccccacaggcagtcagactttatggttatctcccttgttccccgaaaatcgttgttatcctgttcttttcaaggtgcccagatttcacattattcaaacacaaatgctttacaaacaatttgtacaggtaatgcaatcatcacagggtcctcaggcgatatacatccccagcttacgaagatgacgggattaagagattaaagtaaagacaggcataggaaattataagagtattgattggggaggtgataaatgtccatgaaatcttcacaatttatgttcagagattacagtaaagacaggtgtaagaaattataaaagtattaatttagggaactaacaaatgtccatgaaatcttcacaatttatgttcttctgccatggcttcagccggtccctctgtttggggtccctgacttcctgcaacactctggactctccctttttattagtacttggtaggggtggttcagagtcctgatcattaaactcctctctctcctctgactcagcctcatcatctatctgaaaagcctccagtgctgtacacaccaatgaccaaactgaccaaacaggcaaaggaatttcctttccctttctttgtgctcttttaaggtcctttccaattctttcccaatctttcaattccaaagttctctgttccgggaaccaagggcaaaattgttccacagcataaaacaaatccataagattttttgtatcaacttttacaccactacgcttcaagagctgccatagcaagctcaaatacatggcgtacttactttcagtttgtcccatttgtgtccctagctttctccaagtgccccgctcacctgcggagcttaaaactttttcgtctttgggagtcctttgtctgtcggtcctccatttcacacgcttgagcatgccttcactggattctttcgggcctcatgttgggcaccagaatgtaggggaccagcctcaacaccatccgtagggtacctgaagtccggtggcgacaaaggaatgagaagagacaggttaagagttcataaaggtgggagccagggggccagttgcaaaatggaggctgcaaaaggcccagagttctggtctctacactatttattgagtataatcacttagatctaagaagcagatgttcagggcaaaactgtgaaagggaggcagtacgtcatacacgtaatgtgtagcagaggcggtttaagtgaatctcctttgtgctcaagcagcatatctttagttagctggtgggagtgggcttaactaggagcctgcatatctagccacattccaatgcttcagaggagcgtctttcttcttgagcacagtgtttatagataagagagcaggttgtgctcagagcatgggaacataatggtgatcagaagactttcctcctcagagtcctcttgtggctttccacaacttattgtcccatatttttatggccagtttatgcaggcaccccatgagcctttttcccaacgcttaatgactagtaatgttaaacatcttttcaggtgcttatgggccatttgtataactactctggagaaatgcctactcaaatatttttccttttcatttttttaatttgaggcagggtcttactctgttacctgggctggagtgcagtggtgtgatcatagctcactgcagcctcaagctcccaggcccaggtgatcctcccactttagcctcccaagtagctaggaccacaggctcacaccaccacacctggctaattttttaaatttttggtagaggacaaggtctcattatgttgcccaggctggtctcaaactcctggaattaagcagtcctcccgtctcagcctcccgaagtgtgagaattacaggtgtgagccactgcacctgacccttttgcctatttttaaattgagttgcctttcttttttttgagatggagtctcgctctgtcgccaggctggagtgcagtggcatgatcttggctcactgcagcctccacctcctgggttcaagtgattctcctgcctcagcctcccctctagctgggactataggcgtgcaccaccacgcccagttaattttggtatttttggtagagacagggtttcaccatgttggccaggatggtctcaatctcttgacttcatgatctgcccgccttggcctcccaaagtgctgggattacaggcatgagccactgcacccagccttgagttgactttattgttaagttgtaagagttctttatatattatggatataagttaagttctatgtgatttgcaaatattttctcccattctgtgggctgtctttcacttacttgatggtatcccttgaagtacaagtgtctgatttggataaaattcaattctccatttttagtttttttgcttgtgcttttgatgttatagttaagaaaccattgcataacacatgataatgaagatttactttctctgtagaaaattagaaaacttgagggaggtggggggggcggtcagccccccgcccggccagccgccccatccgggagggaggtggggggtcagccccccgcccggccagccgccccgtccgggaggtgaggggcgcctcggcccggccgcccctactgggaagtgaggagcccctcagcccggccagccaccccgtccgggagggagatgggggggtcagccccccaacccggccagccgccccgtccgggagggaggtgggggggtcagccctccgcccagccagccgcgccgtctgggaggtgaggggtgcctctgcccggccgcccctactgggaagtgaggagcccctctgcccggccagccgccctgtccgggagggaggtgggggggtcagccctccgcccggccagccgccccgtcccgtccgggaggtgaggggcgcctctgcccggccgcccctactgggaagtgaggagcccctctgcccggccagccgccccgtccgggagggaggtgggggggtcagccccccgcccggccagccgccccctccgggagggaggtgggggggggtcagcccccctgcctggccagccgccccgtccgggaggtgaggggcgcctctgcccggccgcccctactgggaagtgagtagcccctctgcccggccaccaccccgtctgggaggtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcctctgccttgggatcctgttgatctgtgaccttaccctcaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaaaaaaaagaaaatgatcaaaacaaatgacagggctcagggcaaggggcaaaactgttcccctgccaggctgtttgatagaaaaaggaatggttttcttagttctaaagcttcaaccacactggatccttgtgttttcacaacccttaaggttagagccaactttcaaaaagaataattaaatcgggaaataagtggggtcagcaggtttcgtagtgcttttaaacaggaagtctcagaactcatggagggaagtagctgacagcaaaactgctttcctactcatcaacccaaagaactgcttaattccagaagaagatagaggagcacatctcaccaaagacaagttgaccctaactcttaaatcatctacagccaaaaaactgattctgtacctggttgatcatgcctgtaaaaaaaaaaaaattaaaaattaaaaaaattgattctgcctataaaaaaaaaaaaaaaaaaagaaaattagaaaacttgggccaggccccgtggctcacacctgtaatcccagcactttgggaggccgaggcaggtggatcatgaggtcaggagatcgagatcatcctggctaacacagggaaaccccgtctctactaaaaaaaatacaaaaaaattagctgggcatggtggcgggtgcctgtagtcccagctactcgggaggctgaggcaggagagtggcgtgaacccgggaggcagaggttgccgtgagccaatgagctgagatcacaccagtgcactccagcttgggggacagagcgagactctggctcaaagaaaattagaaaacttgcccctgcaagttttattcttggagctcttatgagtacgtctatgatctattttgagtatgatatgaggtaggggtccattttcattcttttgtgggtgaatttcaggttgtcccaacagcatttgttgaagacactattctttcctcattgaattgtcttggcatccatgttgaaaatcagttgaccaggccgggcacgatggctcacgcctgtaatcccagcattttgggaggctgaggctggtggatcatgaggtcaggaggtgaagaccagcctggccaagatggcgaaactccgtctttactaaaaatacaaaaaattagccaggcgtggtggtgggcacctgtaatcccagctactcaggaggctgaggcagagaattgcttgaacctgggaggcagaggttgcagtgagctgagatggtgccactgcattccagcctgggtgacagagtgagactccgtttcaagaaaaaaagaaaaagaaaaagaaaaatcagttgaccgtgatgtaaatgtatgccaataccacactatcttgattactgtagttttgtagtaagtgttggaatcaggacatatgaggcctccaaatttgttccttttcaagaatacttgggctattctaggtctgttgcatttccaaatgaattttgagattagcctgtatattagtccattttcacgctgctgataaagacacacccaagactgcgtaatttattaagaaaaagaggtttaatggactcacaattccacgtggctacggaggtcttacaatcatggcagaaggcaacaaggagcaagtcatatcttacatggtggcaggcaagagagcatgagagccaagtgaaaggggaaacaccttattaaattattagatcttgtgagatgtattcactgtcacatgaacggtatggggaaaccgcccccatgattcaattatctaccatggggtccctcctacaacacatgggaattatgggagctgaaattcaagatgagatttgggtgaggacacagccaaaccaaatcagcttgacaagttttttcttaagacagggtcttgctctgtcgcccagactggagtgcagtggcatgaacttggctcacggcaacctctgcctcccgggctcaagcaattctcctgcctcagcctcctgagtatctgggactacaggcgcccgccaccacacccagctaattttttgtatttttagtagagatggggtttcaccgtgttagccaggatggtctcgatcttctgacctcgtgatccacccacgttggcatcccagagtgctgggattacaggtgtgagccactgcgcctgacctagacttttttaacttgaaaactagtgagggccaggcatagtggctcgcgcctgcaatctcagcactttgcgaggctagggcaggaagattacttgaggccaggagttagagatcagcccaggcaacatagccagaccccatctctgtaaaaataaaaaattagccaccaggtggttgcacatgcctgtagtcccagttacttaggaggctgagaaaggaggattacttgatcctaggagttaggggctgcagtgagcctagattgtgccactgcactccagcctgggcaacagactgagacccgatctcacaaaataatcaagtagtgaggaaatactgaagaattttaagcaaggcttcagtggagaaaatgtttaagtctggatgctggtagatcatttattttaatttgggttcaagatgatagtgtcctagaacggaagctgattacacgttctgaccgtcatttctcatagtgtctataacataggcaaaataatagctccagtgtccacaggcacgcctatggaaagaagtgcatctggaccatgtcacacactccttcctctccagtacccagcctgcttcctagtccacagctcttccagtagtggttgtgccggggagcattgagaagatctggggagcacagtggggcaggtcaaatactattggagtgacattgcactctagaaaaggagccctgaaatcccacaagtgaaaaggcaggcaggccagtagagaccatcccagtcttattcaccactatagactctgtgtagtgtgggcgtgtggaagcatgtcatatgcttcttgaatgactgagtttaggagtgctttggcgtcttcattaaatagtatggctgggcaggtggcttatgcttgtaatcccaatactttggggggctgaggcgggaggatcacttaaggtcaaaattttgagaacagcctagccaacatggcgaaaccctgtatctactaaaaatacaaaaataagctggcgtggtggcgggcgcctgtagtcccaggtacttgggaggctgaggcaggagaactgtttgaactcgggaagtggatgttgcagtgagccgagatcatgccactgcactccagcctgggcgacagagcaatattccatctcagaaataaacaaacgaatccagtatatttaaggccaagtgcgatggctcatacctgtaatcccagcacttcgagaggctgaggtgggaggatcacttgagtccaggagttcaagaccatcgctggcaacataatgagactctgtctctacaaaataaaaaagccaggcacagtggcacgtgcctgtaattccagctacttgggaggctgaggtgggaagatcacttaagcaggggagttcgaggctgcagtgagctgtgattgtgccactgtattccagcttggatgacagagcaagaccctgtctcaagaaaaataacaaatgtgataaagttgaagcagagcatggtggctcacacctgtaatcccagcactttgggaggctgaggcaggaggatcacttgagcccaggagttcaagaccatcctgggcaccatagcaagggttatgtctacccaaaaaaaaaaaaattttttttttaatatgccaggcaatggcacctatattcccagctacttgaaaggctgaggcaggcggatcacttgaacccaagagtttgaggctacagtgtgctgtgatcttgccattgcaccccatcctgggcaatggagcgagaccctgtctcaaaaaaaaaaagaaagaaaaaaaaaacagaaaggaaataaaatgaaaggaatttatgttattctctctctctttttatttatttttaaatattatttatttatttatttattttttgagatggagtcttgctctgtcacccaggctggcatgcaatggcgcaatctcagctcactgcaacctctgcctcctgggttcaagcgattctcccgcctcagcctcctgagtagctgggaaaacagacatgcaccaccatgccaggcttattttttatattttagtagagatagggtttcaccatattgtccaggctggtcttgaactcctgagctcaggcagtccatccatctcggcctcccaaaatactaggatcacaggtatgaaccactgcacctggcctcttttcatttatttatctatttatttagaccagatctgagtgtatcatgcaggctggagtacagtggcatgatcatagctctttaacacctggcctcaagtgagccttttgcctcagcctcctaagtagctacgactacagtcctgcaccaccctggcaaactaattaatttttttcttttgtttgtggaattggcggtcttactatgtacccaagctggtctcaaactcctgggctcaagcagtcttctcatccccgcctcccaaagggccgatattacaggcatgagtcaccatgcccagcctatgtgattctcttgactgtactataaattccttgactataagatcagggactataatagtttgttcaccattccattcacagagcctgacacacagtaggtgctcagtaactgttgggttaattggttgcaactctatggttgttattattgttgctttaaagatttgggttgtgaaaggtgtgtctgggtgcggtggctcacgcctgtaatccctttgggaggctgaggtgggaggatcacctgaggtcaggagttcaagaccagcctggccaacatggtgaaaccccgtttctactacaagtacaaaaattagctggacatggtggtgtatgcctgtagtcccagctatttaggcagctgaggcaggagaatcgcttgagcccggggaggcaaggttccagtgaactccagcttgggtgacagagcaagacttcatcgcaaaataaataaataaataaataaataaaataaaataaagaaaggtgaaaatgatagccaagggggccgggtgtggtaattcacacctgtaatcccagcgctttgagaggcctaggcaggtggatcacctgaggtcaggagttcgagaccagcctggccaacatggtgaaaccctgtctctactaaaaatacaaaaattagctgggcgtggtagctggcatctctaacttcagttactcaggaggctgagaggagaatcgctttaacccgggaggtggaggttgcagtgagccgggatcatgccattgcactccagcctgggcaacaagagcgaaactccatctcaaaaaaaccaaaacaaaacaaacaaaaaaaatttataataggccaggcgcggtggctcacgcctgtaatcccagcactttgggaggctgaggcgggaggatcacaaggtcaggagatcgagaccatcctggctaacatggtgaaaccccgtcattactaaaaatacaaaaaattagcggggcgtggtggtgggcgcctgtagtcccagctactcgggaggctgaggcaggagaatggcgtgaacccgggaggcggagcttgcagtgagccaagatcgcgccactgcactccagcctgggtgacagagcaagactccgtctcaaaaaaaaaaaaaaaatttatagccaaaatgaactaattaattacatagacatttaattcagttattccataactactggatattgagagttacatttaagtattttaaacctcttagctccaaaagattcgggcttttaaattagatatttcctgtatacaaaaaaatgaatataatacacatgatatgaaaataataaattctcatgtatccattatccagtgttagtttattatcagtttccttgtgtgccctgccccaatcttcttcccttttcttctccccaggagtaaccattattctaaatgttgtttttatcattctcttgcttttttgtttcagttttcctatttatatcccccaaataattaatgaagctttttggttttgaattttatatgttatgtcatgccagatgtaatagcgttcactcagtattcatttttgagatccatgttgatgcatgcaatggtaattttttcatttaattgctttctaatattccattttatgactgtctctatctactgttctactaagggacattagttttttctacagtttttttataattcatactctgctagtatgaacctccttatatatatttcccagtgtacatgtagaagttttggttttggtttttgttttgagacagagtttcactcttgttgcccagtctggaatgcaatggcacgatctcggctcactgcaacctctgcctcccaggttcaaggaatcctcctgcctctgcctcccgagtagctgggattaccggtgtgtaccaccacgcccagctaattttttgtatttttagtagagattgggtttcaccatgttggccaggctgctcttgaactcctgacctcaggtgatccacctgccttggcctcccaaagtactgggattacaggcttgagccaccacactttcaactttttgtttgtacattttcaactttgcaaagatagtgtattttcaactttgttttgtgcattttcaactttgcaaagatagtgtatttatactttcattgacatgtatgaaagttgaatacaatgtaatgtttcgcagcctatttaacatttgctattgtctgactttttaattttctttttctgtttttgtttttttttttttttttttgagacagagtctcactctgtcacctgggctagcgtacagtggtgtgatatcagctcactgcaacctctggatgcaagcaatcctcctgccttagcctccagagtagctgggactacaggtgcatatcaccactcctgactaatttttttttttttttttttttgagacacagtcttgctctgtcgcccaggctggagtgcagtggcatgatctcagctcactgtaagctccgcctcccagtttcatgccattctcctgcctcagcctcccaagtagctgggactacaggcgcccaccaccacacctagctatttttttgcatttttagtagagacgggttttcaccgtgttagccaggaccgtctcgatctgacctcgtgatctgcccgcctcggcctcccaaagtgctgggattacaggcgtgagccactgcgcgtggcctccgactaattttttaaaatattttttggtagagatgaagttttaccatgttggccaggctggtctcgaattcctgacctcaagtgatctgcccaccttgacctcccaaagtgctgggattacaggtatgagccattacacctggcctattttcttttttttttttgaggtggtctcactctgtcatccatgctggaatgtagtgcatctcagctcactgtgacctccacctcctcccaagctcaagtgatcctcctgcctcggccttccgaggagctgggactacaggcatgcactaccatgccctgctaatttttatattttttgtaaagacagggtctcactttgttgctgaggccagtcttgaactcctgggctcaagcaatccacccacctcagccccgagaagtgttcctcccaaagtgtggggattgtacatgtgagccactgtgtcccgcctgacttttttattttcccagtatgatgattgtgaatggtatctggttttcatcattttaattagcatttccctgatttgtaatgaggttcaaaaatcttttcatgggttcactagccttttgtgtttcgttttctgtgaaatgcctgttcatgccttttgctcatttttttaatgaagctgtaggcattctttatatattctagatattaatatagattattaatccctattaatctattgtcagttttccatgttgcacacatcttttcccatttgtggtttaccttttcactttttttttttttgtaacagtgcaaggatgatgctgaaaggaataacaaggcttatctctaggatccataaggtgagtcctgactgacctgaacactctgtgcatactgcctttaggttcccagattcttgttttcagatggattcattgtatctagagtgaaatgctctggaaaacttcatatgtaacaggtttcagtagaataattgtgcttgagaatttaccatggaataggagaattaatatttttccagaaaacataagtaagtttgactgtaattatctttattaactttatttctctagccaactagagaatggttatcatcccttaatgaagtatttaaaagaaaaacaagttgccaatttacagctttagcatctaaaatagaataaaaaataaaattgtacatgaaaaagaccattctgctggtttacttcattttttcacatatttaccaaatagtttttcagtacttttttttttttttttttgagacagagtctcgctctgttgcccaggctggagtgtgcagtggcgcaatctcggctcactgcaacctctgcctcctgggttcaagctattcttctgcctcagcctcccgaatagctgggactacaggcgcttgccaccatgcccggctaatttttgtatttttagtagaaacggtgtttcatcatattagctaggctggtctcgaactcctgacttcgtgatctgcccacctaggcctcccaaagtgctgggattacaggcgtgagccactgtgcccggccttcagtaccttctatatggcaggtactcagaattctaagatgcctcatttcactaataatagttattatttgttgggtattattatgtgccaggtactacactaagtgatttatttttttaatcctcatgatcaacccatgaacgagataatatccttgtttcacagatggagaaactaaagatgagactggctaggtaacttacctgaggaaatagcctgtgaggttgcaaagcccacacgagatgccaggtctgtctgacttcaaagcctgtggcctaaccactgtgctctattgcattttatggtccatgttctccagaagcttacagtccagtagaatcatgaaaaaatgactatttcagtatggtgctcttacagcaccaaagaggagcacctgagcgggattagtcgagtcagcaggagatcctgaaaggctcagaactgagccagaaagacttggtcattttcagctgattatttaattacagattagatttcctagaaaaggagcccttcctcctatatggctccccctgcatgtgcccccttccctcaggcctatatattaatacataaaataacccattattataaaatgaaacgaaagcaaggatcagcagagggatggattctggactcaactgatcatattacaaggctaaaataaatttcctctctcggccgggcacagtagctcatgcctgtaatcccagcactttgggaggccgaggcaggcagatcacctgaggtcagcagtttgagaccagcctggccaacatagtgaaaccccgtctctactaaaaatacaaaaattagctgcgtgtggtggcacacgcctgtaatcccagctacttgggaggctgaggtaagagaatcgcttgaacccaagaggtagaggttgcagtgagccaagatcacgccactgcactctagcctgggcaatagagcgagactccatctcaaaagaaaaaaaaaaatttcctctttcttaataacagacaacaaagacctgaggctagactgtagagtgctgttggtgagagaaagttttgtttttttttttttactagtttggttcagggtgactgtattagtcagggttctctacagggacagcactaataggatagaagtatatatgaaggagagtttgttaaggagtattgagtcacaccatctggcgaagtcccacagtaggccgtgagcaagctgaggagcaagtaagccagtccaagtcccaaaacttcaaaagtagggaagctgacagtgcagtcttcagtctgtggctaaaggcctgagagcccctggcaaatcactgttgtaagtccaagggtccaaaagctgaagaacttggagtccagtgttcgagggcgggaagcatctagctcaggagaaagatgaaggctggaagacccagcaagtcggctcatcctaccttcttctgcctgctttattctagctgccctggcaggtgattagatggtgtccacccacactgagggtgggtctgcgtctcccagtccactgactcaaatgttaatctcctttggcaacaccctcacagacacacccaggaacaatactttacagcctttaatccaatcaagttgacgcttaatattaaccatcacggtgatcttctagattggctcacaaatgctctttcagaaactgcaggatgttcattctggaactgtacagaggcaattgtacagatggttgttttctctggaaacaacagtctacttgagtgataacatatataaaactttaagaactaaagattccattttgctgtaggccaggcatggtggcttacacctgtaatcccagcactttgggaggccaaggcaggcagatcacctgaggtcgggagttcgagaccagccagaccaacatggagaaactccgtcactactaaaaatacaaaattagccaggcgcggtggcgcatgcctgtaatcccagctactcgggaggctgaggcagcagaatcgcttgaacctgggagacagaggttgcagtgagccaagatcacaccattgcactccagcctgggcaacaagagtgaaactccgtctcaaaaaaaaaaaaaaaaaaaaaaagattccattttgctagcttttaatttgcttcaaaaagtacctgtagtttcagctacttgggaggctgaggcaggaggatcatgtgggcccaggaatttgagactgtccggggcaatatagcaagaccctaccctatgtcaaaaaaaaaagtgtaacaaaaatgtcatcacattactgtagaaataggaccaccttgtgacccttgaatagtttgttttccactctgctttctctccagctaaagaggcatggtgctttctctccggtagataaaattgagtagcgtttaagtagtactagggtgtgttattcagattgctaccctgaagtaacaagccttgtattctcagtggcctaacacaaaggatattgtttgtgttgtgtgtatgtgttttgctttgtttttgctgttcctgtctttcaaaaaggctttgcaagcaagactgaagtctggatggagggacaaaagtttaccttcttgggatacatcgcaacatatagcttttaaggtggggagggagagataatttatacctcacacttaattggctctgattagaaaggacacaatgacacaagttattttcattcataggtctttagccaaaggaatcacatgacccctcctgtttctgcaagggaggctgagaagtgtagagaacgatttggatatttggatatttcccaagcattgctgcttcagctgtaatttacagtcatacattctcagacaaagctggagcaactctagtacttgacagttactttatattaaaatctacaagtaatggttcagaagtttctgtgtatacttcactaagtttcctatagagcatttactttccttcgtggatgctttacgtactctctcattgcatgttttcagtttcagattctttattccagggcaaactaaatacctgtagtgtgttaagtactcagagagggagatatgaaaatgaataaaatctgaccccttttcttccgagcgtgtagcctaggagacaagcatgtgtaagataacatgatacagtttttttaaaatagagacaaacttggatgtcaattctagttcaccacctaaaactctgtgaccttaatcaaaattactcagcttccctgaaccttatcttccccatcataacacagggttgataatattctgcctatcttctaggatttctaggtttaaaactagtacatgtacaatactgtattgcctaacatctaatagatactcagttaacagtaggcatgagtacaactcaaggcagtgtaataaaattgctgtgcaatacaaagagtgctattagcagaaaggaaagagaattacttttgactggaggtgtctggcaaattttcactgaggatgtgacattcgagttgaggcttgatgaatgggaaagatttaaatggggagagagggaagttgaagtagaatgagcagaagtatagaggcataaaagtgacatgtttcagcatggtcatatggttataaatgaaattacaaaggtaggctgaagtcatcacagtggtctagattgttatgctaaggaatttgagacttattttgacatcgttctggaaccttctaagctttttaaaatttttttattgtcggggtctcactgtgcttccctggctgatgtggaactcctgccctcaagcagtccttccactttagttcccaactagctgggactacaggagtggaccaccacacctggctccatccaagcttttagattagtcgaaggttaaacctattttcgggaaggttaaggactatgaacgatgaaaaaatcaaagatttagagataaagatacaagttaaaatgttatgtgttggctgggcatagtggctcacacccataatcccagcactttgggaggctaaggcgggcagatcacctgaggtcaggagttccagaccagcatgaccaacatggtgaaacccagtctccactaaaaatacaaaaattagtcaggcgtgatggcgggcgcctgtaatcccagctactgaggcaggagaaccacttgaacctgggggcagaggttgtagtgagctgagatcatgccattgcatcccagcctgggcgacaagagtgagactccgtctcaaaaaaaaagaaaaacaaaagtgatgggtacaatactgtctctcaacctgtgtagtgggaatgttagacacataatttaggatcatgtcataaaatgggtgtaagtgtgaggagggatggtacagagataacatatattttctgcactcaaaaagctgcttggtaggctgggcacggtggctcacgcctgtaatcccagcactttgggagcctggggtgggaggaccacctgaggtcaggagtttgagaccagcctggccaacatggcaaaatcctgtctctactaaaaatagaaaaattagctgggcatggtggcacactcctataatcccagctgctcaggaggctgtgtcaggagaatcacttgaacccaggaggcggaggttgcagagagccaagattgtgccactgcaccccagcctgggcaacagagcaagactccatctcaaaaaaaaaaaaaaaacccacaaaaagctgcttggtgagccaggtacagtggctcacacctatcatcccagcactttgggaggctgaggcaggaggatcgcgtgagtgcagcaagttggagagcagcctgggcaacatagcaagaccctgtctacaaaaaattaaaaaaattagctgggcatagtggcatgcacctgtagtcccagctacttgggagcctgagatgggagcatggcttgggcctgggagtttgagactacagtgtgccgtgatcgtgccactgcactccagcctgggtgacagagcaagaccctgtcttaaaaaaaagagagagagagagagagagaagctgcttggtgagactataaaatactggtagctttcatatgataacctatttattaagcaactcccttattacactatccattatatttctgttctcttgcttctcctggctgcattccctaatcttttcctcataacacatcttttcactttctacataaggtttgttatccttaagctcagttttggggtttttcacttaccattttgttagatttgtctaccgaaatccgcccccttcccctccctgttggttcagaggtttcggtgtacagttcactgagttacctatagagcagtttgctttcacttagctgtgtatttgacatactcccttattacatgtctctaatgaaagatcctttattccagggcacaattagcaggaaaattgttacagggcatgtaattatagctgtcacatagtgaggagcattgcactgatcccctgataactgaggtgactgacagagaatgagaattacacagttttgacaaccattcatcgctgtgcaagcgcattaaaagagctttcctgcttcaagtttgctaatggctatgctatgtatgctcctgaataatctctgacagaattgtttgtttccgtataggacagacccctgataaggcaatacacagactggaacagatacagaatatgaataatgtcattggacttagtgaattttaaataataacagggatcctttttacatagaagaaaaatgttgccgggcgcggtggctcacgcctgtaatcccagcactttgggaggcagaggcgggcggatcatgaggtcatgagatcgagaccatcctggctaacacagtgaaacccctactaaaaatacacctctactaaaaatacaaaaaattagccaggcgtggtggcgggtgcctgtagtcccagctactcgggaggctgaggcaggagaatggcgtaaacccaggaggcggagcttgcagtgagccgagatcgcgccactgcactccagcctgggcgacagagtgagactccatctcaaaaaaaaaaagaaaaatgtatgttagtgacatccctattgcagacatggctcaccttctcagtgttttggcaagcataaaaagtttgattagccaggtgtggtggctcaagcctgtaatcccagcattttgggaggcagaggcgggcagatcacctgagttcaggagttcaagaccagcctggcccatatggtgaaatcttgtttctactaaaaatataaaaaatcagccgggtgtggtggcgcacgcctgtaatcccagttactcaggaagctgaggcaggagaatcacttgaacctggaaggcggaggttgtagtgagcctgagatcacgccattgcactccagcttgggcaacaagagagaaactccatctcaaaaaaaaaaaaaaaaagtttgataaccccgtaacactgaaatggtttctcttatagttggaccctgggcgttttttacacatggggacccaggctcgccaaagcattgctgctcacctagataaccaggttccagttgagagtccgagagctatttcccgcaccaatgagaatgacccggtgagttactaatatgtatatggggtttctcagggcttatgatttgtgttcctgtcctcattttgcataggaaaactgaaactgaaagaagcttagtagatttgcatttactcagatagtgcacctgagatagcactctggaacccagattctccctgtccctgtctgatactgtggtaacatacactggccagctcggtctgtatcagttcccatgtaatctctactagtgaattcacctagttccacggattttgctgagcatagagttgtcgaatactcaatacttactaagtttaatttcttactgggcaagtttaccaattattattgcttatattatgtgttgggtgacaggctttttcttaaaggaccatgtagtgaatatttcaggccgatggactgagatgatctgtcacaagtactcaactctgccataaacaaatgggtgtgaacatgttccagtaaaactctatttacaaaacaggtgcccagccataacttaacaaactctggtatggagagtactaaagaaattaaactacttgcccacaattttctaccagggcaggttcagaacccaatttttctaataaccaatctggtgctattttgcagttttgtaagtggatttcctagggtctggagagggaactaacttggtttgttgtgagaagagcagcatttaaagtgaattttgtctgcagaagccaggattccagcagtatctagtgttgcattttctagtccagttccccattagactggatattgatttctttttgttgctgcctctcataaatgaaattaatttgtggtgtgtgctgtaatgttaggaaccaatagctttctttccctgcccctaccctctgagtcttcccatcttaatatagtctgtgtggaaagaaaaagtaaacacccattacccaaaacatgatctcagcagggtgtgttttaaatatatctctaggcttcggccatgcggggtggctcacgactgtcatcctagcattttgggaggccgaggcaggaggatcacttgaggtcaggagttctagaccagcctagccaacatggcgaaagcctgtctctactaaaaatactaaaattagctgggtgtggtggcgggcacctgtaatcccagctactcaggaggctgaggcaggagaattgcttgaacccaggaggcagaagttgcagtgagccaagatcgcgccactgcactccaggctgggcaagagagcaagactctgtcttaaaaagtatatatatatggctgagtgaggtggctcacgcctgtaatcccagcattttgggaagccaaggcaggcggatcatgaggtcaggagactgagaccatcctggctaacacagtgagaccccatctctactaaaaatacaaaaaaaaattagttgagcatggtggcgggcgcctgtagtcctagctactcgggagactgaggcaggagaatggtatgaacctggaggtggagcttgcagtgagctgagatcgtgctactgcactccagcctgggcgacagtgcaagactctgtctcaaaaaaaaaaaaagaaagaaagatagatagatagatagatagatagatagatagatagatagatatagatatagatgaagatatatatatataccattcacctcttttcacaaacacaaaatgaagtagaataaatgaatcaagccactgaagtgtcttttcagctttctttgtaattgcagtccttttatctgccaattcctctggggtttctatggaaacagcagcatgcagatgatcttgtcacatgactggagcatctctatacacagcacagaagaatccagatggcaagaattgtctttgctacccctacatctacggtttactttgatgagcaattggcttcattatttgggccaccacttttatatacatactgggtttgagggcagcaaccagcattcttggctaagataaatgaggctgggcacagtagcttatgcctgtaatcccaggactttgggaggcctaggtgggaggatcacttgagcttaggagttctagactagcctaggcaacatagcaagaccctaactctaaaacaatttttttttttttttttttgagacagagtttcactcttcttgcccaggctggagtgcaatggcgcagtctcgtctcactgcaacctccacctcctgggtttaaatgattttcctgtctcagcctcccaagtagctgtgattacaggcatccaccaccatgcctggctaagttttgtatttttagtacagatggggttttaccatgttggccaggctggtcttgaattcctgacctcaggcaatccgctcaccttggcctcctaaagtgctgggattacaggcatgagccactgtgcccagccaaaaaaattttctttttctttttcttttttttagacggagccttgctctgtcacccaggctggagtgcagtggcgtgatcttggctccctgcatcctccacctcccgggttcaagcagttctctgcctcagcctcccgaatagctgggattacaggcgcctgccaccgtgcctggctaattttttgtattttttgtagagacaggctttcaccctcttggccaggctggtcttgaactcctgacctcataatccacccaccttggcctcccatagtgctgggatgacaggcatgagccactgcactcggccaaaagtttttcaattagcagtgcatagtggcatgcgcctgtagtcccagctactcgagaggtttaggtacaaggatcacttgagcccaggaggtcaaggctatagtcagctgagatcaggccactgcactccagtctgggcaacaggctttctcaaaacaatgggagatatcttttccagctttaagagatgagtggtccaggtgcagtggctcacgcctgtaatcccaacactgagaggccaaagtgggaggatcacttgagctcaggagttcaagaccaacctgggcaacatagcaagacctcatctctaccaaaaaagtaaaaaaatgagccaggtgtagtggtgcacacctgtggtcccagctacttgtgaggctgaggcgggaggatctcttgagcctgggaattggaggcctcagtgagccgtgattgtaccactgcattccagcctggtaaaccgagcaagatcttgtctcaaaaaaaaaaaaaaaaaaaaaaaaaaaagacataaaggccgggtgcagtggctcacgcctgtaatcccagcactttgggaagctgaggcaggtggatcacttgaggtcgggagttcaagaccagcctgtctctactaaacatggagaaaccctgtctctactaaaaatacaaaattagccaggcatggtggcacatgcctgtgatcctagctacttgggagggtgaggcaggagaattggttgaacccgggaggcggaggttgtggtgagccaagatcgcgccattacacttcggcctgggcaacaagagtgaaactccatctcaaaaaaaaaacaaaacaaacaaaccaaaaaaaacacataaagacatgagtgaatagcaggccttatccaattttcaaagtcttggtcacagataaaaagacaaggctgggctaggcgctgtggctcacgcctgtaatcccagcactttgggaggtcgaggtgagcggatcacgaggtcaagagatcaagaccatcctggtcaacatggtgaaatcccatctctactaaaaatacaaaaattagctgggcgtggtggcgcgtgcctgtagtcccagatgctcgggaggctgaggcaggagaatctcttgaacctgggaggcgggggttgcagtgagccgagattacaccattgcactccagcctgggtgacagagcgagactctgtctcaaaaaaaaaagaagacaaggctgggcaagatggctcaccctgtaatcgcagcattttgggaggctgaggcaggcagatcacctgaggtcaggagtttaagaccagcctggccaacatggtgaaaccccgtctctactagaaatacaaaaattagccgggtgcggtggcagattgtaatgccagctactgggaggctgaggtaggagaattgcttgtacccaggaggcggaggttgcagtgagctaagatcgcaccattgcactcctgcctgggtgacaaaagtaaaactccattttaaaaataatatatatatatgtatgtgtatatatatatgtatgtatgtgtatatatatatgtatgtatgtatatatatatatatatacacatagacatacatatatacacacacatagataagacaaaaaagaaagtcttggtcactttgtcaccattatacctgtttgcactcttatttcctaggccaagcatggggatcagcacgagggtcagcactacaacatctccccccaggatttggagactgtatttccccatggccttcctcctcgctttgtgatgcaggtgctcaagacagggaatggaattggagggagcccagaatacaagctgctgctagcaaaggggtggggctaaatgagaagaaaatttaaaaagatgaaatttaatctgaaaaacagaaattcatgtgttgattaccttttgtgactagtacaattactttaagctcatgtttaaacaatattgatgttttcctccttgtatagcccaagaagattccagtaatttcagcatcaaataactgttttaaatgaacttaaaatttgccttggcaaaatatcatgaaaatagttaatatgctgcacaaaagcaaaatcatagtacactcctgagctaaatagaagcaatattttgattagatgcattggtttttattctcttgtggattttgtgaaaatgttatcaaacttgcctgtgcaggtgagttttagcatgcgagccagaggatctcatttctttagtgtggtttatttcgggaaattagatgaataataagggcataacaggccgggcgctatggctcacgcctgtaatcccagctgcactttgggaggccaaggtggaaggatcacttgggcccaggagttcgagaccagtctaggcaacatagggagacctgtctctacaaaaattaaaaattaaaaattagctgggcatgatgcacacctgtagtcacagctactcaggtggctgaggttggaggatcgcttgagctcaggaggtgagggcttcagtgagccatgattgcaccactgtaccccagcctgggcaacagagcaagaccttatctcaagcataaaataaaataaggtataacaggccaggcaaggtagtttatgcctgtagtctcagcactttgggaggtgaaggtgggaggattgtttgagcgcaggagttcaagaccagctgggcaatataatgagactgtatctttatttagaaaagaaaaacatgggcaaccctctcgggtccccttccacactgtggaagctttgttcttttgctcttctcaataaatcttgctgctgctcactcaaaaaaaaagaaaaacatttagtcatgtgtggtagctgcttcggaggctgaggcaggaggatggcttgagcccaggagttcaggctgcagtgagctacgatagtgccacggcactccaactcagacaacagagtgagaccctgtctccaaaaaacaattttaattaaaaaaaattttgttgaagaaatcatctgcagtggcactttaaactgttccaagacatacacagtacaatgtttattcagcttcagagctgtgaggttctatctttaattaactatttgaagttgttttcagactggcttaaccaacaatgctctgtaagaacttacaggttcttttcataattttcatttacatgaaggcctacttcctcaccattgtttgtggatattagcattgtcatactgcctaatatgacttttttttttttaaatactgctccttttggagcagacctaactcacggacagtgtgcccagggtagctgactttattttattactattattttaattatagagacagggtctcactctgacaaccaggctggagtacagtggcgtgaccacagcccacagcacactctacatctctgacctcctgggctcaagcgatcctcctgtattggcatctcaaagtgctgggattacaggtgtgagccacagctcccagccctgatgtgacttttttttgaaatggagtttcacttttgtcgcccaggctggaatgcagtgatgcgatctcagctcactgcaacctacgcctcctgggttcaagtgattctcctgcctcagcctcccaaagagctgggattacaggtgctcgccaccacgcctggctaatttttatatttttagtagacatggggatttgccatattggccaggctggtctccaactcctaacctcaggtgatccacctgtcttggcctcccaaagtgctgggattacagggatgagccaccacgcccagccaacatttgttttaatacctttatcatgtttttttgaacattgagccttccattaagtttggaattgcctgtcaaatcctacaccaattcaattgttttgttaggatttcttttaaaaatatcaacactggctgggtacaatggctcacgcctgtaattccagcactttgggaagctgaggtgggcagattacttaaggccaggagttcaagatgagcctggccaacatggtgaaactccatctctactaaaaatacaaaaattagctgggcgtggtggcacacgcctgtagtcacagctacttgtgaggctgaagcaggagaatcgcttgaacccgggaggcggaggttgcagtgagctgagatcgtgtcactgcactccagcctgtgcgacagagcgagactctgtctcaaaaaaaaaaaaaaaaaattaacactattttagttatacttacaaacagtatttgttagatattcttattagtagacatattttaatattttctttgcaaatcagtttcacacacattagtacttcccaaatttcccaccaaagtattctggtagcaaaaggggaattaaactctgaaaggttagtatgctggaggtatgaggtatggatggccttagagttgtgaggcagctggtcacacctgctcctgagccgccatgtatttagttctagagaaaaaagtctaaatggttaaagtaataaaaataaattttaggccaggtgcggtggctcacgcctataatcccagcaccttgggaggctgagacgggtggatcatgaggtcaggagttcgagaccagcctgaccaacatggtgaaagcctgtctctactaaaattacaaaaatcagcctggcatggtggtggcacctgtaatcccagctactgaggagactgaggcagaagaattgcttgaaccccggaggcggaggttgcagtgagccgagatcacaccactgcactctagcctgggtgacagagtgagactctgtctcaaaaaaagaaaaaaaaaaaaaatcaactaaaaataaattttaggccaggtgcagtggctcacgcctgtaatccctgcactttgggaggccaagacgggggtgtcacctgaggtcgggagtttgagaccagcctgaccaacatggagaaactccttctgtactaaaaatacaaaatagccgggcatggtggtgggtgcctgtaatcccagctactcgggaggctgaggcaggagaatcacttgaactgggaggcagaggttgtggtgagccgagatcgtgccattgcactccagcctgggcaacaagagtgaaactccgtctcaaaaaaaaaaaaagaaaaaaaatttaaagagttaatgtttattgaattattaacttgtgtcagaaattttaagcatttttctatatgctttccatatttacagtggccctaagtggtatacataattttgttatgagatatatcaattatttatagatttcagctgagatagaatatatgcttcagtaataggaataatcaaaagctgactatcatgttacttagtgcggaataatgtatttcagtttttagctaagttatatggatagattttcaaactcagtaccaacccagcttctcctaactgagtaaattagaggcatgcaatctgatggtcttggttgccactttaggcagagtatatataccaccccccacccactccttccacacccacccactctttccttctttcctactttatcaggtgaagacattcagtgaagcttgcctgatggtaaggaaaccagccctagaacttctgcattacctgaaaaacaccagttttgcttatccagctatacgatatcttctgtgtatcctttcctgcctgcgtggaccctcatgaaccaatgctttctcccctcaaataaggcaacagaagaaatgaaaaaaagtactgttgaggccgggcatggtagctcacacctataatcccaggagtttgggaagccgaggcaggcgtatcgcctgaagtcaggagttcaagacctgcctggccaacatggcgaaaccccgcatttactaaaaatgcaatatattagccgggtgtggtagcgtgcacctgtaatcccagctacttgggaagctgaggcaggagaatcgcttgaacccgggaagcggaggttgctgtgagctgatatcaagccactgcactccaaccccatctcaaaaaaacaaaacaaagcataactactgttcacatacaagtgatccttccagtcatgttttctttaacaacatatactttagatggagagaagggaacaggaaaaaccctaagtctttgccatgttattcatttctgtgcaaaacaggactggctgatactacatattccagatggtaagaacttcctgttgtttcttctgtctgttaggtttagttatcctgttactgtggtagccttgcagctttaattttcttttcttttcttttctttttttttttttttttgagatggagtttcgctcttgtcggccagtctggagtgcagaggcgcaatctcaggtcaccgcaacctccgcctcccaggctcaagagattctcctgcctcagcctcccaagtagctgggattacaggcgcccaccacaccaccacgcccagctaatttttttttttttttttttttgagacggagtcttgctctgtcgcccaggctggagtgcagtggcacgatctcagctcactgcaagctccgcctcccgggttcacaccattcttctgcctcagcctcctgagtagctgggactacaggcgcccgccaccatgcccggctaattttttttgtatttttagtagagacagggtttcaccatgttggccaggctggtctcgaactcctgacttcaggtgatccacctgccttggcctcccaaagtgctgggattacaggcatgagccattgcacccggcctcagctttactttcctaacagggatctgatagctaaaggaaaagcctttgccagtcacgatggctcaaacctataatcccagcactttgggaggctgaggctggaatattgcttagagcccaggaggaggctgcagtgagctgtgatcgcaccactacactctagcgtgggcaacaaagcaagaccctgtctcaaaaaaaaaaaaaaaaaagaagaagaagaaaagcctttactccagatgtagagcagactgagctcatccatcatgatttcttcgtgatattactgccaagcagattataaggtgaagtcaatgtgacaaaaggaaattcggctaaaagcttcctgaagccttttgatgctaagcagtccttcttttgatatttaatacccatggacataaacttctgccttagaggtcgccatggagttttgttttgttttgttttgttttgtttttgccatctgttaacagtcctgagtacccatagagccttttactatttatcagcattctagagtcgtcagtatggattgtcaaaacttgcatttgtctcttttttgttcagtgttgtgtgcatccacattttctttcttttttaaacaaccctgcttatgtaacatccacattttctgacttacctttcaaacctgccagaaagcagaagtgatatttaatacacttggtatgttttatatattgattctaatgataatgtttagtctaagatggacctgacaaggccaggcatagtggttcaacagcactttgagaggctgaggcaggatgattgcctgagcctaggagttcaaggttacagtgaactgtgatcacatcctgccttctagcctgggtgacagagcaagaccctgtctcaaaaaaaaaaaaaaaaaagaaaagaaatatatatatgagaaactaaagtcatttcccataacttaaaagaggcatagaatatttcgagttgaatacagtttctgcctggcttgttttcttctgcctcttttttttaaagctcatctttgggtgaaaaattgtcgggatcttctgcagtccagctacaacaaacagcgctttgatcaacctttagaggcttcaacctggctgaagaatttcaaaactacaaatgagcgcttcctgaaccaggtgactagactcccagaagttgagtgctaggtagtccttacatggattctttgtgccctgagtaccaatagactatggagaactgatactggagttggaataactgtatcatttttaatttctttcatacgttttgctcacagtggactcataacttgaaactcatttatccatgtgaaataaataggcaacagtaagttgttcccattttgtgggtagcaaagtgaaatccagttgattcattgacttttcaaggtacagcctccaatccctcgcaagcacatttccaactacatgattttctccagacaatatctttttagggaaccagaaatgtattggaaaaattcttctttaccctggtgattcttagataccctgtctagaccaggggccttcaactctggatataaagcagagtcacctaagagcttgttaaaaatgcagatgccagagtctcattctggacattttcatcagaatcccttatgtatgtttattcaaggctccaagcagaaatggattagaaagcattcactttggtcaggcacaggggctcacacctgtaatgtcagcactttgggaggccaaggcaggcagatcacctgaggtcaggagttcaagatgagcctggccaacatggtgaaatcccatctctactaaaaatacaaatattagccgggtgtggtggtgcacgcctgtaggcccatctattcaggaggctgaggcaggggaatctcttgaacctgggaatcagaggtttcagtgagccgagatagcgccattgtactccagcctgggtaacagagcgagatatggtctcaaaaaaaagataaaagaggtcaggcgtgtggctcagacatgtaattccagcattttgggaggccgaggtgggcagatcacctgaggtcaggaattctagaccagcctggccaacatggcgaaaccccatctctactaaaaatacaaaaattagccaggcgtggtgacacacgcctgaaatcccagctacttgggaggctgaggcaagagaatcccttaaacctgggaggtggatgttgcagcgagctgagatcatgccactgcacttcagcctgggttacagagaaagaagctgtctcaaaaaaaaaaaaaaagaaagaaaagaaagcattcacttctacattgaggtctcttacagaacctgaacaatagattaaaatgaactcctgttaaccttagcctccaaccttttcaagggatggtttcacccttaggccaagtagccttttttttggtttttattttctttgcttgcttttagataaaagttcaagagaagtatgtctggaataagagagaaagcactgagaaagggagtcctctgggagaagtggttgaacaggtataagaaaaaacactgaatgtgtaacatgcgataacaagagaaggcctctggtagcactacaatccactgtctctcccaatagggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccggtaggaaaactgggtgtctctatcttgtttctctgatttctgattccatcagtatggaggctgggtcttagccttgtagaccatgcaatatgttttcttgccctaggaatatttgaagataaacagtaaagagctgggtgcagtggctcacgcctgtaatcccattggctcacgaggctgaggtgggaggatcgcttgaggccaggagttcaagactaggatgggcactatagcaaggcccctgcctctaaaaaaataagaaattagccggtagctggcatggtggcacacacctgtagtcactgctactggaaggctgaggccagaggatcacttgagccctggagttcaaggttgtagtgtggcatgattgcaacactgcacaccaacctgggtgacagagtgaaatcctgtctcttaaaaaatatatatatggctgggcacagtggctcatgcctgtaatcccagcacttggggaggctgaggcgggcggatcacctgagcttggagttcgagaccagcctgaccaacatggagaaacccatctctactaaaaatacaaaattagccgggcatggtggtgcatgactgtaatcccagttactcgggaggctgaggcaggagaatcgcttgaacccaggaggcggaggttgcagtgagccgagatcgccatatatatatattcatatatatgtatatatacacacatatatattcatatatgtatatatacacacatatattcatatatatttatatatacatatattcatatgttttcataatatacgaatatacctatatgttcatatatgtatatataatattcatatatgtatatatgtatatataatattcatatatgtatatatgtatatatacgtatatatgcacacatacatattcgtatatgcatatgcacacatacatattcgtatatatatgtgaagataaacagcaaggcctggtgtgatggctgataaatcccagcacttttaggaggccaagaggtgatttgcttgagtccaggagtttggagtttgaggtcagcctgggcagcacagtgaaaccctgtccctacaaaaaatataaaaaactagctgggcatggtggtttgcacctgtatgtagctccagctacttggaaggctaagatgggaggatggcttgagcccaagaggcagagcccgcaatgagtggagatcgtgccactgcattccaggctgggcaacagaatgagactctgtctcaaaaaaataaaaaaaaagaaaagataaacagtaaaatggaatcagaggaggaggtaatgccaagagttccactattcattgaaaactaagggagtatgttgtggaaagagaatgacagcagaagctatgttttctttcttaatttttatctgtcttttgattcttttttcaaaatgagtctagatggtctaagcagaggagatcagaagcatcaaaatggggctggtttggggcagtgggtgtttttctcagtgactgttaatctccagaagcatggcagttctagggccagaggctacgtggcttatcctagagggagtaccttcaggtatacaattatgtcttagttgagggttttaaaaaaattgttgtcaccaggtgcagtggctcatgcttgtaatcccagcactttggtaggccgaggtgggtggatcacaaggtcaggagtttgagaccgtcctggctaacacggggaaaccctgtctctactaaaaatacaaaaaaattaggctctggtggcgcgcgcctatagtcccagctactcaggaggctgaggcaggagaatcgcttgaacccaggaggtggaggttgcagtgagcccaaatcgcgccactgcactccagcctgggcgacagagcgagactctgtcaaaaaaaaaaaaaaattgttgtcaattgtttcgggagaacatctaggaaaggcacgtgatgatctcttctctctttctgtccgatatgcagattgcccccgaggaattagcacttgttcacaacttgaggaaaatgatgaaaaatgattgggtaagtgcatatgatacctcacacatttcagaaagaaatgtattatcattttaaacatgttctactatttcattgctaatactttacagtctctaattttatggacagtaagttattatgtcttatttaattcctgtatctgtaccaagttagaaataaagtctgaattaaaatctatatatatgtggtttataatctttccaaagtaagtttattcaaaaccattttatttaaatattggcctaattttattttgcttgcagacatttaaagtgtttttgtatctccttaccgtctttggaaaagagtttgagacccacaaatatgtcatggtaaatttaaaatcaggtagcagtttattgtcagagccaaatctggaataaccaatttagttgccatttaactgtgctagaccacacttttgtaacactgtatgcccaagaaagaaaaaaaaaatctacagatgattaatgcagttttccatcctttttaactttttccagttcagccttttctcttttctttcagcatggaggcgccattgtgtcggctttgagccagactgggtctctctttaagccccggaaagcctatctgccccaggagttgctgggaaaggtcaagtcaaaggaaaatttgtttctacttagattgttatcctgtttaaagaaaaatatttttattaatctatgtattttgacataatttcagacttagagaaaaatcatattcctgtatgcccttcccctggattcctaaaatattaacttgatcatcattgctttatccgtctccgtctttctccagagtttcttttcttttttttttttttgagacggagtcttgctctgtcaaccaggcttgagtgcaatggcgcaatttcggctcactgcaacctccgccttccgggttcaagtgattctcctgtctcggcctcctaagtagctgggattacaggcgtccactaccacgcccagctaattttttgtatttttagtagagacgaggtttcaccatgttggccaggctggtttcaagctcctgacctcaagtgatccgcctacctcagcctcccaaagtgctaggattataggcgtgagccacggcgcctggccttgatgcttctttgtctccaaataatgtctcattcctaagaacaaagatactctaatataccctgagcataattatcaaagtcagaaaattgacattgatatcatacttttacctaattggtgggatttattctgatgtagccagttatcccagtatcttttatagaaaaataaatcccagataatgtgttacattaagttgtcatgtctctggctgggtgcggtggctcatgcctgtaatcccagcactttgggaggccgaggcaggcggatcatgaggtcaggagatcgagaccatcctggctaacatggtgaaaccccgtctctactaaaaatacaaaaaattagccaggcgtcgtggcgcgtggctgtaatcccagctactcaggaggccgaggtaggagaatcgcttgaacccgggaggtggaggttgcagtgagccgagattgcgccactgcactacagcgtgggtgacagagcgagactccgtctcaaaaaaaagaaaaagttgtcatgtctctttggtctcctttaatctgtgacagtctgtcagtctttgtcatttgaaatctttatgtttttggcatgtgcatgccagctattttgtaggtcactttttggggttgtctgaggtttcctcctgaatagaagtgatgttagaagtgatgacatgtctgagtgagtgcatcctatcaggaggcacatttctcccattactggtaatgattttggaactgttagctgaggtgttgtccatctggtttctcttcagtaaagttattattttgctttggaattaatatgtatgttgtagagatatactttgagactaggtaaagatcctgttacttctcaaacttccacctactggttttagtatccattactttagttatacctggcatggagcctccgcagctggtatggtcttgtggatttttatttaatagaatctaaatcattactgtcactttttattttggtgctcaaatcatcttagatttggccattaaaaattccttcattggccgggtgtgatggctcacgtctgtaatcccagcactttgggaggccaaggcgggtggatcacgaggtcaggagttcaagaccagcctggccaatatggtgaaatcctgtctctactaaaaatgtaaaaattagccaggtgtggtggtgcgtgcctatagtcccagttactctggaggctgaggcagaagaatcggttgaacccaggaggcggaggttgcagtgaaccaagattgtgccattacactccagcctgagccacaaagcaagactccgtctcaagaaaaacaaaaaacaaaaaaacaattccttcatggccaggcttggtagctcacagctgtaatcacagcactttgggaggccaaggcagaaggatcccttgagctcaggagtttgagaccagcctgggcaacaaagtgagaccccatctctacaaaaaaaaattttaaaactagctgggcatggtggcattcacctgtagtcacagctactctggagactgaggtgggaggatcgcttgagcccgggaggtcaaggctgtagtgggccctgattttgccagtgtactccagcctgggcaatagagtgcggccctatctcaacaggaaaaaaagctccttcaagctaacttctatatccttttaaaatgtccccatcattatttttttggagatagggtctcactctgtcacccaggctgtagtgcagtagcaccatcatagctcactgtagccttgagcacatgccaccacacccagcactgaatgttgtctttttcttttctttcctttttttttttagaggcatggtcttaactatgttgttgcctagggtggtcttgaactgctagcctcaggcaatcctcccacctcggcctcctaaagtgctgggattactggcgtgagccaccatatccagctcctatcattctttgaccacttctttattttctgtcatgagaatatgttccagacccctcttatacttcccatgcccagccctggaatctccatttctccaaagagcattggcttattttagaggagactggtatttagcaaccaaggcctgagtcctaggtatactcactgctactgaggtgtcctttctcctaggccctcacagcaaagttcataaatagatgtacatacatacatgtatgtatgtatatgtgtgaaccatatgcatatacatgtttatacacatccacacacatctgcgtttgtttctctaatcatattaaaaaactatgagttcctactagtagccaattccatgctaccatcacagcagtcattataccctttccatatctgtaactctaatctaaaataatgagaaatctgctgccagtagccatagtatatttacttattagctcaatactagaatatatgaaaagtagtttcagatttgatagctctcaggctgggcgtggtggctcatgcctataatcccagcactttgggaggccgaggcgggcagatcacgaggtcaggagatctagaccggcctggccaacatggtgaaaccccgtctctaccaaaaaatgaaaaaaaaaaaaaaagaaaaaaaaattagccgggcgtggtggggcgcctatagtcccagatactccgaaggctgaggtgggagaatcgcttgaccctgggaggcagaggttgcagtgagctaagatgtgccaatgcactccagcctgggagacagtgaaaaagaaagaaaaaaataagttccttgggccgggcgcagtggctcacgcctataatccctgcactttgggaggccagggcgggcggatcacctgaggtcaggagttcaagaccagcctggccaacatgatgaaatcctgtctctactaaaaatacaaaaaattagctgggcatggtggtgcaggcatgtaatgccagctactcgtgaggctgagacaggagaatcgcttgaacccaggaggcagaggttgcagtgagccgagatcgtgccattgcactctagcctgggcaacaggagcaaaactcagtctcaagaaaatgaaaaaaaaaaaagaaatacagtttgattacttcatttgtttccatttgttttccatctagcgtattttttcccattatttttattttttattttattttatttgagatgaagtcttgctctgtcacccacgctggagtgcagtggtgcaatctcagctcactgcaacctccacctcccaggttcaagtgattctcctgcctcagcctcccaagtagctgggattacaggcacgcatcaccacgcctggctaattttttttttttttttttttttgagatggagtcttgctctgtcaccaggctggagtgcagtggcttaatctcggctcactgcaacatccacctcccgagtttaagcaattcttctgcctcagtctcccgagtagctgggacgacaggtgcatgccaccacgcccagctaatttttgtaatttagtagagatggggtttcaccatattggccaggcaggtcttgaactcctgaccttgtgatctgcccgcctcagcctcccaaagtgctgggattacaggcatgagccaccgtgcccggctaatttttgtatttttagtagagacagtaattttgtatttttagtattttcaccatgttggccaggctgatctcgaactcctgacctcaggcgatctgccctccttggccacccaaagtgctgggattaccagcatgagccaccatattcctttgaaaatatgaaacattaactttgtttcaaaagccaaaactgtccaaaatacatacacacaatatgtgtgtgtgcgtgtgtatgtgtgtgtattcacacaagtagcatccgcctcctcaagcattgcctttttttttgtgtgtgtagacatggtcttactctgtcacccatactgtgacagtatgtgtagtggagcaatcgcagctcactgcaatctcaacctcctggtctcaagcaatcctcagcctcccgagtacctggggctagaggcacgcagcaccactcctggctaatttttgtattttctgtcgagacagggttttaccacatggcccaggctcgtctggaactcctgggctcaagcaatatgcccatctcagcctcccaaggtgctgggattacaggtgtgagtcactgtgcccagccacctctttttaatatatagcatttgtggccacgtagagcacgagtagccagccaccatatgtggagtccatatgtggagtcctgtatcaggcaatgttgccagagaatgagaagtagagttacatagaagaaaaacaaataccttaccttcaaagtgcttaagtagagtctgtctgtctggtgctttgttccttaactaacatgtttcctgatcctttttcttccccaggaaggatttgatgccctggatccctttattcccatcctggtttccaactataacccaaaggaatttgaaagttgtattcagtattatttggaaaacaattggcttcaacatgagaaaggtccatcatttagttttttcctatcagggctttgtgatcacagtagaatcccactcagtcagagccttgatctcttcttcccttaacaacagcctctaatttgtacttcatcctttatcttgacttctttctggctgataaatggtacagaaaagcgggtgggaggcagttaaggtttaatttacaaaagagattttatccctaaattttccatgataaagaagggaacaaaggcaactccatccactgggcagaatttccaggtaattgggttcctgccacattctccttattgaatttatttattcaatagacttcactggagagactcatgctgggacacccacagaaaaattcatactgtgcaagggctactccagcacctaagtaaatctttgccacacctgtcctagtatatgtacagaaattaactttcagcactatatttcatctactctgactgaaagcattccaactgttcatttacttgcccttgacctcacatttgagtatgaagaggggatatagaagaaaagctaaggctgctctatcactagataatagagttaatagtaatcggaggcctggtgcagtggctcacacctgtaatctacactttgggagggcaaggtgggaagaccacttgatgtcgggagtttgagaccaggctaggcaatatagtgagaccccatctctattgaaaaaagcaaaaaaaaaaaaatactatttagaatagcttattaaaggagtacagtgaagagtgtaagactaactgtagcatgttaagttgggatgcacaatagacagatttctaagagttgggagatgtcacaaaatcctgaagtccagaagacactcttggagtggagagagagctccatgctggtttggaggagtagacacagaaaaggaagtaatgcatacaaaagaagagtagcttgttggggtgagggtctagaagtaagatctcttgggagatgataattacctcagaacgtaatttggatatggtagcctctgactacacgatattctggggaacacagtgcagcaggaggaaactgccacttacctgtgtttgtctccattttagctcctacagaagaagggaaaaaagagctgctgttcctaagtaacgcgaacccctcgctgctggagcggcactgtgcctacctctaagccaagatcacagcatgtgaggaagacagtggacatctgctttatgctggacccagtaagatgaggaagtcgggcagtacacaggaagaggagccaggcccttgtacctatgggattggacaggactgcagttggctctggacctgcattaaaatgggtttcactgtgaatgcgtgacaataagatattcccttgttcctaaaactttatatcagtttattggatgtggtttttcacatttaagataattatggctcttttcctaaaaaataaaatatctttctaaagtgttgtgttagattaataatatggaaggagtctttagattggccaaattgcatttctctgatattcctcttgttgcaggtcagaagagatcaattctacagaaatttccagtggttctgttgaggctttatggaattcagcatgtcaaaattcacagctggctgggcacagtggctcatgcctgtaatcccagcactttggaagcccaaggcgggcagactgcttgagttcaggagtttgcaaccagcctgggcaacatggtgaaaacctgtctctactaaaaatacaaaaattagccgggcacggtggcatgcgcctgtaatccaagctacttgggaggctgaggcaggagaattgcttcaacttgggaggcggatgttgcagtgagccaaaattgcaccactgcactccagcctgggcagcagagcaagactccgtctcaaaataaataaataaataaataaataaataaataataa

SEQ ID NO: 717 - DNA, 49919 bp, Homo sapiens; identical to SEQ ID NO: 716

SEQ ID NO: 718 - DNA, 49919 bp, Homo sapiens; identical to SEQ ID NO: 716

SEQ ID NO: 719 - DNA, 49916 bp, Homo sapiens
gtctcaggacgggcgctttggagccggccccaggcagcgtgtgtcggtcgcctagtctggagaactagtcctcgactcacggtgagggaatggaccgacacgggtattgtaccgctgagggaaaggagcgggactccggacctccaggaggtagggagtgaggccggtagaccggcgcgcctccgggggggattcctcccgggcgttgagttgccaacctgggacccgaggaagttcggcgtggtggtgtgctttttgttgttgttaaccctcctcggatttctcgaatttcacaccactgtccatatgcgatgatgtttgtttgcccttgacgcacttactcatggatggtacttcagcctcgttagacagcctggtgatggaggatgaagaaaccatgtgcttctcattcagttctggactcagtttcccttgtcttcagcaagttatttttgttagttccttatcaaaaagtgtacataaaaattaggcaactccaaacatgcctccagggttggtgtgtgaaataataagatagggctgggcgcggtggctcacgcctgtaatcccagcactttgggaggccgaggcaggtggatgacaaggtgaagagatcgagacaatcctggccaacatggtgaaaccccgtctctactaaaaatacaaatattagccggccgtggtggcgggcgcctgtagccccagctactcgggaggctgaggcaggagaattgcttgaacccgggcggcggaagttgcagtgagccgagatcgcgccactgcactccagcctggcgacaaagcgagactccgtcacacacacacacacacacacgaaataataatatatgtaaagtggaattagctcctaggcatagggaaggtgcagagtattgccgtgttgtcatttacagttctgttgatgtcgataacgtttgtgggtgtaatgggtagtgttctgtccctccaagtcgttaataaaacaaagcaggccgggcgtcttgttaaatagttgtatcaatgacttgatttagattaatgaggatatatttttcaaatttatgccttttacaaaatttttaaagagtaggtaatgtcggtgatagatataaagaaaggaaaagatctccagatgtggaatcttctactggatcctgtaacagaaagaagacattaggctgggcgcagtggctcacacctgtaatctcagcactttgggaggcggaggagggcgcattgcttgagcctaggagttcgagaccagcttaggcaacacggtgaaaccccatctctacaaaaagacacaaaaattagacaggtgtggcacacgcttgtagtctgagctacttgggaggctgaagcaggaggattgaggaagaggttgcaaagttagccgagatcacgccatcacactgcagcctaggtgacagagcgagaccctgtctcaaaaaaagaaagaagacattagcagaaaagctgaggaaatgcaaataaagtctgcaatttttaaatagtattgtaccagctttaatttcttaattttgaaaattgtaccatggtcatatgtatgtaacattaaggaaactctaatgaaaattgtaagaaagcactttgtactacctttgcaactcttctgtaaatttacacttttttttgtttgtttgctttgagataggatctatgtcgccaaggctggaaggcagtagtgcagtcctggctcactgcaacctcaagctccttggctcaagggatcctcccacctcagccatctgagcaactaggactacaggcacatgccaccacatccagctaatttattttattttttttttgagacggagtctcgctctgtcacccaggctggagtgcagtggcgcgatctcggctcactgcaagctccgcctcccgggttcgcgccattctcctacctcagcctcctgagtagctgggactacaggcacccgccaccacgtccagctaattttttgtatttttagtagagacggggtttcaccgtgttagccaggctggtctcgatctcctgacctcatgatccacctgcctcagcctcccaaagtgctgggattacaggcgtgagccaccatgcccagcctccactatcgaactttagaacattttttatcacccccaaaagaatcttatcagtaagttgctttccattcctccctcccattgcctctcgcaaccactaaatcagtttatgtaattaataagcaaattatggacatttcatgtaattgaaatcatactatatgcaactgtcttcttttactttgttttgaaggttcatccagttgtgtaatgcatcagaactttgtttcgtattgccaaataatattccattatatggctataccacgttatgtttattcatcaattgatggacatgtgaggtatttccactttttggctcttatgcataatactgctacgaacatttgtgtacaacttttgcatacacttgtttttatttctcttttatacctgagagtggaattgcaggttcatatggtaactccatgttttaccttttgaggaactgccaaacttttccaaagtggcctcaccgcttaaaaaatcctaacagcaacatataagaatcctagtttttccagattctatccaacacatgttattatcagttcttttgaatttcatcattctagtgggtgtgaagtgtatctcattgtggtttttatttgcattttcttaattttgggggaccagtctcagcaccacccgtagggtatccgaagtccggtggcgacaaaggaatgagaagagacaggttaagtgttcataaaggtgggagccagggggccagttgcaaaatggaggctgcaaaaggcccagagttctgatctccacactgtttattgagtacagtcacttagatctaagaagcagatgttcagggcgaaacagtcaaagggaagcagtacgtcatacacataatctgtagcagtggcggtttaagtgaatctcctttgtgcttaaacaacgtatctttagttagctggtgggagtgggcttaactaggagcctgcatatctagccacattccagtgcttcagaggagcgtctttcttcttgagcacagtgtttatagataagagagcaggttgtgctcagagcatgggaacataatggcgataagaaggctttcctcctcagagtcctcttgtggctttccacaacttactgtcccatgtttttatggccagtttatgcaggcaccctgtaagcctttttcccaacatgccccccttttttcttttttaaaactgccattgctattaagacttgttcctggtgtctggtctctctccagaggcatcttccgcatctgcagactaaaagcaaacagcataaacaggtacacattaaagcaaaatttgcgatagttgattctctaacggtcttaatccacttaagaggatttatgtttgaaagtccatcagcagctccagtgagaatgtcagtcccaggcaggagagttaaatgagcctgagatgctttaaaaacctgttcctttaatttggctatattcagtgtaaaatttccatccctttcttccagatgatgtctaactttttcccagtgatgttcagtagcattgtatgaatggggagttatgcagaaatcagaagtattccaatcacattgcatttgcaatcgatgctctaagcttattatacgatctctcatccaaataacagtctgtctaagatcatttatttgatttgccaattgttggtctatccgggtctgataattccacaattttgaggaattcttttgccaattatttacatattctgcagtttgaacagaggagtgtaaagcaattccagcagccacaacagtagctgtgactgcaataaggcccataatgactgctataagggtaaaaataaatctttttgttctggtaaacactccctttaacatttctgtgaggatatgaatggaagaagaggctttccaaggtctattgagggaaaccggtatctaaactcctctagccctcaccagcaacacagatgttttcacatcaaacgtggaatcaatacaggtgaaaaggtgacagttttgacaagtaatagtttgagaattaggtcgaatatcaatatttccgaccatcaacataaaaggaggcttgacacagctctgaatgggcgccattcggttggaagaaaactgatacacaaattgaagtctctcaccttttccctcaaggtaatatttttcttctcaaacctgaatatgagattgggccatcattaccttccataatttgggatgttcagggcctattattggattaatcatttttggatgtgggccggctataccaaaattggttgaaattatgggaaactgggcatgtttttcagtgtaaatagtgtcatctctttgacagtatagttcctgttttagtcctgtcttgtatctatcattctgattggtacaattaactgcaaaggtccccttaggggaccaatcagtgacaattccataggaattattttgaagtaccacagcgtgatcagagatgcaatcctggccgggagtggtggctcacgcctgtaatcccagcactttgggaggccgaggccggcagatcacctgaggtcgggagttcgagaccagtctggccaacatggagaaaccccctctctactaaaaatacaaaattagcagggtgtggtggcacatgcctgtaatcgcagctacttgggaggctgaggcaggagaatcccttgaacttggggggcggaggttgcagtgagctgagattgcgccattgcactccagcctgtgcaacaagagcaaaactccctctcaaaaaaaaagaaagaaaaaaaaagagatacaatcctttcaaatcaatatttctaaatcatttgactgttgttgaggttgttgacacctctcttttctgggcttaaactgttacagttgaactgaactctgtggatgatccgggctccatccagaaaataaatgataggatactggtctttgattatgacctgaaattttaactagccaatgttgtccgtagccttttaggcaaccgacagctggccctatgcaaagaggaggggaactgataacccatggacatatttattaacattccttcctcctctgggtgagagggcccttgagtatctgtaggctcaggcatccaaacactattattaacataagcctcaaccgggggttccaaccatgtgacaggcctaattaaaggtggaaatgggacgtatgcccaataggtataattttggtctgctgtagccacagggagacttaccaccatggtaattaccgcaatcatagctaccatcaggttactcgaggttagtggtttttgttgtgttttcaggttttcttctgcaaggtgggtcagcctcttgatctgtccccaagttggtgggctcgcttgatgggttttgttggtcttcatctggttggctgaaatgttcattcgagccatcaggcgtgctgggagtggagatcttggttccaaaatccttttctcttctttggaaatttgctcatggtagaatttaagatgtcttgtaggtacccaaactggaagctggttttcttctggggaaatacaaacaaaccctcttccccatgttatatctctctttttcccaggtctttgttttaaagtccttccaccacacaggttttccttcatgaacatttaccttctgtcctgttaaatgctcttcagctgctatagtaacctgattgcggaagatgttcaaaaaatttaaggtaacaagagccaattgtaactgcatatgaggggtggaatattccctatctccccctattttctttttatgtaattgcatttttaaggttcagttggctcgctcaacaatcgcttgcctttgagaattataggggataaccgtactgtgttcaatgctctgttgttttaaaaatgtttggaaagatctactacagtagcctggtctgttgtctgtttttaatttttgtggaattcccatgacagtaaaacaggaaagcaagtgtctttttatatgtgttgtagtctggctggtttggcaagtagaccatataaatgagaatatgtatctatggtcacatggacataagaaagtttgccaaatgcaggaatgtgggtgacgtccatttgccagatcatgttaggtgccaaccctcgagggttaacaccagttccttgatacggtagttgcagtacctggcactgaggacgatgttgtacaatgtccttggcctgtttccacataatttgatagttgtttgtaagtcctgttacattaaggtgtgttaatgagtggaaagtctgggcatcagtaagtatgggggaaaccaacaagtcagcttgctcattagcctcagtcaagggtcctggaagattggtatgtgctcggatatgagttatatagaaaggaaaatcccgagcacacacagctgtttgtaaagagttgaacaattgataaagctgtttatcaataatatatttaattaaggcagtttcaatatgctgagtagcttatacaacataagctgaatctgaaacagtattaactggctgattaaaatcttctaatactgcaatcattgcctgtaatttagctctttggactgaggaagagttagtgtggataactttaccacaaggtcccacatatgccgctttcccagtactggagccatcagtaaaaacaatcatggctccttccaaaggggcatcacgagtaattttcggaagaacctatgtagttaattttaagaactggaaaattttatttttaggatgatgattatcaatacattcaataaattctgctaaattaacttgccatgtaactgagttaataaatgcctgcttaatgtgacttttatttattggaactataatcttattgggctcagtgccataaagtttaacaatttgcatatgagcctgtccaattaaaattgtgatctgatctacatagactgtaagtgttttcatggtattatatggcaaaaaagaccattcaaccaaatcattattttgaacaataaccctcattgaggagtgtgaagtagggaacacaatgaattgaaaaggcaagactgagtcaatcctactaacctgggcttgctgaatttttttttttcaattactcttaactcattcatggccttgggtgttaattctcttttatggtgtaagttgcaatctcccctcaatatttagaaaatattagacatagcataagtagaaattcctaaggtgggctgaatccaattaatgtctcctaacaatttttgaaaatcatttaaggtttttaaagaatcttttctgatttgaaccttttgaggcttaatggctctatcttgtacttgtatccccaaatattgaaaaggaagagttgtttgaattttgtcaggtgttataagcaatccagcatttgtaattgccttttgcaaagatgaataacattgaataagttggtctctattttttgttgcacatagtatgtcatccatataatgaatgatgtaacaatctggaaattgatctctaactagctggatagctttgcctacaaaagtttgacaaactgtggaactgtttaacataccttggggtaaaaccttccaatgatatctggctgcaggttctttgttattaatggcagggatagtaaaggcaaatttttcaaaatctgtctctgccaaaggaattgtaaagaagcagtcttttaaatctataataacaagcagccagtctttagggagcatggtgggggatgggagccctggttgtaaagctcccattggttgcattacagcgttgacctcttgcaagtcggtcagcatgcaccatctaccatactttttttaaaattacatatactggggaattccaaggagagaaagtgggtgaaatatatcctttttctagtagttttttaactatttcatggaacgcccccaagtttttctgagggagcggccactgttcgacccagacaggatgctgcagggtgagcctgaattgcttcttcaccatagtgaactgcaggttgggcagtaatgggtgcggcaagctgagtttcaggctccctccccctgcactcactcagctgaggaggaggtggccattccggacatttctctgaagaagctgcgggctgaacaattttctgtgtaggtttagggagaccggggggattggtagaaatcacctccggtatcgggggaaccagcccccaatatttcaacataggttctattttccgtaagtgtgccagtctgagaaataaagagaaagagtgcaaaagagaaattctacagctgggtctccgggggtgacatcacatttcagcaggttccatgatgcccctgagccgcaaaaccagcaagtttttattatggatttcaaaaggggaggggtgtacgaatagggagtgggtcacagaggtcacatgcttcagaggcagtaaaatatcacaaaggcagagaggcagagcgagatcacaaggccagggcgaaactagaattactgatgaaggtccatgtcccgctgggcacattggacgttgatattgataaacatcttaacaggaaacagggttcgagagcagacaaccgatctgactagaattcgccaggctggaatttcctaatcctagcaagcctgagggtgctgcaggagaccagggcatatttcatcccttatctccaactgcataagacagacactcccagagcagcgattttacagatgtctccctgggaatgcattcgttttcccagggttattccttgctgagaaaagaattcagcgatatttctcctattcgctttctgaaagaagagaaatatgactctgttctgcctggccccacaggcagtcagactttatggttatctcccttgttccccgaaaatcgttgttatcctgttcttttcaaggtgcccagatttcacattattcaaacacaaatgctttacaaacaatttgtacaggtaatgcaatcatcacagggtcctcaggcgatatacatccccagcttacgaagatgacgggattaagagattaaagtaaagacaggcataggaaattataagagtattgattggggaggtgataaatgtccatgaaatcttcacaatttatgttcagagattacagtaaagacaggtgtaagaaattataaaagtattaatttagggaactaacaaatgtccatgaaatcttcacaatttatgttcttctgccatggcttcagccggtccctctgtttggggtccctgacttcctgcaacactctggactctccctttttattagtacttggtaggggtggttcagagtcctgatcattaaactcctctctctcctctgactcagcctcatcatctatctgaaaagcctccagtgctgtacacaccaatgaccaaactgaccaaacaggcaaaggaatttcctttccctttctttgtgctcttttaaggtcctttccaattctttcccaatctttcaattccaaagttctctgttccgggaaccaagggcaaaattgttccacagcataaaacaaatccataagattttttgtatcaacttttacaccactacgcttcaagagctgccatagcaagctcaaatacatggcgtacttactttcagtttgtcccatttgtgtccctagctttctccaagtgccccgctcacctgcggagcttaaaactttttcgtctttgggagtcctttgtctgtcggtcctccatttcacacgcttgagcatgccttcactggattctttcgggcctcatgttgggcaccagaatgtaggggaccagcctcaacaccatccgtagggtacctgaagtccggtggcgacaaaggaatgagaagagacaggttaagagttcataaaggtgggagccagggggccagttgcaaaatggaggctgcaaaaggcccagagttctggtctctacactatttattgagtataatcacttagatctaagaagcagatgttcagggcaaaactgtgaaagggaggcagtacgtcatacacgtaatgtgtagcagaggcggtttaagtgaatctcctttgtgctcaagcagcatatctttagttagctggtgggagtgggcttaactaggagcctgcatatctagccacattccaatgcttcagaggagcgtctttcttcttgagcacagtgtttatagataagagagcaggttgtgctcagagcatgggaacataatggtgatcagaagactttcctcctcagagtcctcttgtggctttccacaacttattgtcccatatttttatggccagtttatgcaggcaccccatgagcctttttcccaacgcttaatgactagtaatgttaaacatcttttcaggtgcttatgggccatttgtataactactctggagaaatgcctactcaaatatttttccttttcatttttttaatttgaggcagggtcttactctgttacctgggctggagtgcagtggtgtgatcatagctcactgcagcctcaagctcccaggcccaggtgatcctcccactttagcctcccaagtagctaggaccacaggctcacaccaccacacctggctaattttttaaatttttggtagaggacaaggtctcattatgttgcccaggctggtctcaaactcctggaattaagcagtcctcccgtctcagcctcccgaagtgtgagaattacaggtgtgagccactgcacctgacccttttgcctatttttaaattgagttgcctttcttttttttgagatggagtctcgctctgtcgccaggctggagtgcagtggcatgatcttggctcactgcagcctccacctcctgggttcaagtgattctcctgcctcagcctcccctctagctgggactataggcgtgcaccaccacgcccagttaattttggtatttttggtagagacagggtttcaccatgttggccaggatggtctcaatctcttgacttcatgatctgcccgccttggcctcccaaagtgctgggattacaggcatgagccactgcacccagccttgagttgactttattgttaagttgtaagagttctttatatattatggatataagttaagttctatgtgatttgcaaatattttctcccattctgtgggctgtctttcacttacttgatggtatcccttgaagtacaagtgtctgatttggataaaattcaattctccatttttagtttttttgcttgtgcttttgatgttatagttaagaaaccattgcataacacatgataatgaagatttactttctctgtagaaaattagaaaacttgagggaggtggggggggcggtcagccccccgcccggccagccgccccatccgggagggaggtggggggtcagccccccgcccggccagccgccccgtccgggaggtgaggggcgcctcggcccggccgcccctactgggaagtgaggagcccctcagcccggccagccaccccgtccgggagggagatgggggggtcagccccccaacccggccagccgccccgtccgggagggaggtgggggggtcagccctccgcccagccagccgcgccgtctgggaggtgaggggtgcctctgcccggccgcccctactgggaagtgaggagcccctctgcccggccagccgccctgtccgggagggaggtgggggggtcagccctccgcccggccagccgccccgtcccgtccgggaggtgaggggcgcctctgcccggccgcccctactgggaagtgaggagcccctctgcccggccagccgccccgtccgggagggaggtgggggggtcagccccccgcccggccagccgccccctccgggagggaggtgggggggggtcagcccccctgcctggccagccgccccgtccgggaggtgaggggcgcctctgcccggccgcccctactgggaagtgagtagcccctctgcccggccaccaccccgtctgggaggtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcctctgccttgggatcctgttgatctgtgaccttaccctcaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaaaaaaaagaaaatgatcaaaacaaatgacagggctcagggcaaggggcaaaactgttcccctgccaggctgtttgatagaaaaaggaatggttttcttagttctaaagcttcaaccacactggatccttgtgttttcacaacccttaaggttagagccaactttcaaaaagaataattaaatcgggaaataagtggggtcagcaggtttcgtagtgcttttaaacaggaagtctcagaactcatggagggaagtagctgacagcaaaactgctttcctactcatcaacccaaagaactgcttaattccagaagaagatagaggagcacatctcaccaaagacaagttgaccctaactcttaaatcatctacagccaaaaaactgattctgtacctggttgatcatgcctgtaaaaaaaaaaaaattaaaaattaaaaaaattgattctgcctataaaaaaaaaaaaaaaaaaagaaaattagaaaacttgggccaggccccgtggctcacacctgtaatcccagcactttgggaggccgaggcaggtggatcatgaggtcaggagatcgagatcatcctggctaacacagggaaaccccgtctctactaaaaaaaatacaaaaaaattagctgggcatggtggcgggtgcctgtagtcccagctactcgggaggctgaggcaggagagtggcgtgaacccgggaggcagaggttgccgtgagccaatgagctgagatcacaccagtgcactccagcttgggggacagagcgagactctggctcaaagaaaattagaaaacttgcccctgcaagttttattcttggagctcttatgagtacgtctatgatctattttgagtatgatatgaggtaggggtccattttcattcttttgtgggtgaatttcaggttgtcccaacagcatttgttgaagacactattctttcctcattgaattgtcttggcatccatgttgaaaatcagttgaccaggccgggcacgatggctcacgcctgtaatcccagcattttgggaggctgaggctggtggatcatgaggtcaggaggtgaagaccagcctggccaagatggcgaaactccgtctttactaaaaatacaaaaaattagccaggcgtggtggtgggcacctgtaatcccagctactcaggaggctgaggcagagaattgcttgaacctgggaggcagaggttgcagtgagctgagatggtgccactgcattccagcctgggtgacagagtgagactccgtttcaagaaaaaaagaaaaagaaaaagaaaaatcagttgaccgtgatgtaaatgtatgccaataccacactatcttgattactgtagttttgtagtaagtgttggaatcaggacatatgaggcctccaaatttgttccttttcaagaatacttgggctattctaggtctgttgcatttccaaatgaattttgagattagcctgtatattagtccattttcacgctgctgataaagacacacccaagactgcgtaatttattaagaaaaagaggtttaatggactcacaattccacgtggctacggaggtcttacaatcatggcagaaggcaacaaggagcaagtcatatcttacatggtggcaggcaagagagcatgagagccaagtgaaaggggaaacaccttattaaattattagatcttgtgagatgtattcactgtcacatgaacggtatggggaaaccgcccccatgattcaattatctaccatggggtccctcctacaacacatgggaattatgggagctgaaattcaagatgagatttgggtgaggacacagccaaaccaaatcagcttgacaagttttttcttaagacagggtcttgctctgtcgcccagactggagtgcagtggcatgaacttggctcacggcaacctctgcctcccgggctcaagcaattctcctgcctcagcctcctgagtatctgggactacaggcgcccgccaccacacccagctaattttttgtatttttagtagagatggggtttcaccgtgttagccaggatggtctcgatcttctgacctcgtgatccacccacgttggcatcccagagtgctgggattacaggtgtgagccactgcgcctgacctagacttttttaacttgaaaactagtgagggccaggcatagtggctcgcgcctgcaatctcagcactttgcgaggctagggcaggaagattacttgaggccaggagttagagatcagcccaggcaacatagccagaccccatctctgtaaaaataaaaaattagccaccaggtggttgcacatgcctgtagtcccagttacttaggaggctgagaaaggaggattacttgatcctaggagttaggggctgcagtgagcctagattgtgccactgcactccagcctgggcaacagactgagacccgatctcacaaaataatcaagtagtgaggaaatactgaagaattttaagcaaggcttcagtggagaaaatgtttaagtctggatgctggtagatcatttattttaatttgggttcaagatgatagtgtcctagaacggaagctgattacacgttctgaccgtcatttctcatagtgtctataacataggcaaaataatagctccagtgtccacaggcacgcctatggaaagaagtgcatctggaccatgtcacacactccttcctctccagtacccagcctgcttcctagtccacagctcttccagtagtggttgtgccggggagcattgagaagatctggggagcacagtggggcaggtcaaatactattggagtgacattgcactctagaaaaggagccctgaaatcccacaagtgaaaaggcaggcaggccagtagagaccatcccagtcttattcaccactatagactctgtgtagtgtgggcgtgtggaagcatgtcatatgcttcttgaatgactgagtttaggagtgctttggcgtcttcattaaatagtatggctgggcaggtggcttatgcttgtaatcccaatactttggggggctgaggcgggaggatcacttaaggtcaaaattttgagaacagcctagccaacatggcgaaaccctgtatctactaaaaatacaaaaataagctggcgtggtggcgggcgcctgtagtcccaggtacttgggaggctgaggcaggagaactgtttgaactcgggaagtggatgttgcagtgagccgagatcatgccactgcactccagcctgggcgacagagcaatattccatctcagaaataaacaaacgaatccagtatatttaaggccaagtgcgatggctcatacctgtaatcccagcacttcgagaggctgaggtgggaggatcacttgagtccaggagttcaagaccatcgctggcaacataatgagactctgtctctacaaaataaaaaagccaggcacagtggcacgtgcctgtaattccagctacttgggaggctgaggtgggaagatcacttaagcaggggagttcgaggctgcagtgagctgtgattgtgccactgtattccagcttggatgacagagcaagaccctgtctcaagaaaaataacaaatgtgataaagttgaagcagagcatggtggctcacacctgtaatcccagcactttgggaggctgaggcaggaggatcacttgagcccaggagttcaagaccatcctgggcaccatagcaagggttatgtctacccaaaaaaaaaaaaattttttttttaatatgccaggcaatggcacctatattcccagctacttgaaaggctgaggcaggcggatcacttgaacccaagagtttgaggctacagtgtgctgtgatcttgccattgcaccccatcctgggcaatggagcgagaccctgtctcaaaaaaaaaaagaaagaaaaaaaaaacagaaaggaaataaaatgaaaggaatttatgttattctctctctctttttatttatttttaaatattatttatttatttatttattttttgagatggagtcttgctctgtcacccaggctggcatgcaatggcgcaatctcagctcactgcaacctctgcctcctgggttcaagcgattctcccgcctcagcctcctgagtagctgggaaaacagacatgcaccaccatgccaggcttattttttatattttagtagagatagggtttcaccatattgtccaggctggtcttgaactcctgagctcaggcagtccatccatctcggcctcccaaaatactaggatcacaggtatgaaccactgcacctggcctcttttcatttatttatctatttatttagaccagatctgagtgtatcatgcaggctggagtacagtggcatgatcatagctctttaacacctggcctcaagtgagccttttgcctcagcctcctaagtagctacgactacagtcctgcaccaccctggcaaactaattaatttttttcttttgtttgtggaattggcggtcttactatgtacccaagctggtctcaaactcctgggctcaagcagtcttctcatccccgcctcccaaagggccgatattacaggcatgagtcaccatgcccagcctatgtgattctcttgactgtactataaattccttgactataagatcagggactataatagtttgttcaccattccattcacagagcctgacacacagtaggtgctcagtaactgttgggttaattggttgcaactctatggttgttattattgttgctttaaagatttgggttgtgaaaggtgtgtctgggtgcggtggctcacgcctgtaatccctttgggaggctgaggtgggaggatcacctgaggtcaggagttcaagaccagcctggccaacatggtgaaaccccgtttctactacaagtacaaaaattagctggacatggtggtgtatgcctgtagtcccagctatttaggcagctgaggcaggagaatcgcttgagcccggggaggcaaggttccagtgaactccagcttgggtgacagagcaagacttcatcgcaaaataaataaataaataaataaataaaataaaataaagaaaggtgaaaatgatagccaagggggccgggtgtggtaattcacacctgtaatcccagcgctttgagaggcctaggcaggtggatcacctgaggtcaggagttcgagaccagcctggccaacatggtgaaaccctgtctctactaaaaatacaaaaattagctgggcgtggtagctggcatctctaacttcagttactcaggaggctgagaggagaatcgctttaacccgggaggtggaggttgcagtgagccgggatcatgccattgcactccagcctgggcaacaagagcgaaactccatctcaaaaaaaccaaaacaaaacaaacaaaaaaaatttataataggccaggcgcggtggctcacgcctgtaatcccagcactttgggaggctgaggcgggaggatcacaaggtcaggagatcgagaccatcctggctaacatggtgaaaccccgtcattactaaaaatacaaaaaattagcggggcgtggtggtgggcgcctgtagtcccagctactcgggaggctgaggcaggagaatggcgtgaacccgggaggcggagcttgcagtgagccaagatcgcgccactgcactccagcctgggtgacagagcaagactccgtctcaaaaaaaaaaaaaaaatttatagccaaaatgaactaattaattacatagacatttaattcagttattccataactactggatattgagagttacatttaagtattttaaacctcttagctccaaaagattcgggcttttaaattagatatttcctgtatacaaaaaaatgaatataatacacatgatatgaaaataataaattctcatgtatccattatccagtgttagtttattatcagtttccttgtgtgccctgccccaatcttcttcccttttcttctccccaggagtaaccattattctaaatgttgtttttatcattctcttgcttttttgtttcagttttcctatttatatcccccaaataattaatgaagctttttggttttgaattttatatgttatgtcatgccagatgtaatagcgttcactcagtattcatttttgagatccatgttgatgcatgcaatggtaattttttcatttaattgctttctaatattccattttatgactgtctctatctactgttctactaagggacattagttttttctacagtttttttataattcatactctgctagtatgaacctccttatatatatttcccagtgtacatgtagaagttttggttttggtttttgttttgagacagagtttcactcttgttgcccagtctggaatgcaatggcacgatctcggctcactgcaacctctgcctcccaggttcaaggaatcctcctgcctctgcctcccgagtagctgggattaccggtgtgtaccaccacgcccagctaattttttgtatttttagtagagattgggtttcaccatgttggccaggctgctcttgaactcctgacctcaggtgatccacctgccttggcctcccaaagtactgggattacaggcttgagccaccacactttcaactttttgtttgtacattttcaactttgcaaagatagtgtattttcaactttgttttgtgcattttcaactttgcaaagatagtgtatttatactttcattgacatgtatgaaagttgaatacaatgtaatgtttcgcagcctatttaacatttgctattgtctgactttttaattttctttttctgtttttgtttttttttttttttttttgagacagagtctcactctgtcacctgggctagcgtacagtggtgtgatatcagctcactgcaacctctggatgcaagcaatcctcctgccttagcctccagagtagctgggactacaggtgcatatcaccactcctgactaatttttttttttttttttttttgagacacagtcttgctctgtcgcccaggctggagtgcagtggcatgatctcagctcactgtaagctccgcctcccagtttcatgccattctcctgcctcagcctcccaagtagctgggactacaggcgcccaccaccacacctagctatttttttgcatttttagtagagacgggttttcaccgtgttagccaggaccgtctcgatctgacctcgtgatctgcccgcctcggcctcccaaagtgctgggattacaggcgtgagccactgcgcgtggcctccgactaattttttaaaatattttttggtagagatgaagttttaccatgttggccaggctggtctcgaattcctgacctcaagtgatctgcccaccttgacctcccaaagtgctgggattacaggtatgagccattacacctggcctattttcttttttttttttgaggtggtctcactctgtcatccatgctggaatgtagtgcatctcagctcactgtgacctccacctcctcccaagctcaagtgatcctcctgcctcggccttccgaggagctgggactacaggcatgcactaccatgccctgctaatttttatattttttgtaaagacagggtctcactttgttgctgaggccagtcttgaactcctgggctcaagcaatccacccacctcagccccgagaagtgttcctcccaaagtgtggggattgtacatgtgagccactgtgtcccgcctgacttttttattttcccagtatgatgattgtgaatggtatctggttttcatcattttaattagcatttccctgatttgtaatgaggttcaaaaatcttttcatgggttcactagccttttgtgtttcgttttctgtgaaatgcctgttcatgccttttgctcatttttttaatgaagctgtaggcattctttatatattctagatattaatatagattattaatccctattaatctattgtcagttttccatgttgcacacatcttttcccatttgtggtttaccttttcactttttttttttttgtaacagtgcaaggatgatgctgaaaggaataacaaggcttatctctaggatccataaggtgagtcctgactgacctgaacactctgtgcatactgcctttaggttcccagattcttgttttcagatggattcattgtatctagagtgaaatgctctggaaaacttcatatgtaacaggtttcagtagaataattgtgcttgagaatttaccatggaataggagaattaatatttttccagaaaacataagtaagtttgactgtaattatctttattaactttatttctctagccaactagagaatggttatcatcccttaatgaagtatttaaaagaaaaacaagttgccaatttacagctttagcatctaaaatagaataaaaaataaaattgtacatgaaaaagaccattctgctggtttacttcattttttcacatatttaccaaatagtttttcagtacttttttttttttttttttgagacagagtctcgctctgttgcccaggctggagtgtgcagtggcgcaatctcggctcactgcaacctctgcctcctgggttcaagctattcttctgcctcagcctcccgaatagctgggactacaggcgcttgccaccatgcccggctaatttttgtatttttagtagaaacggtgtttcatcatattagctaggctggtctcgaactcctgacttcgtgatctgcccacctaggcctcccaaagtgctgggattacaggcgtgagccactgtgcccggccttcagtaccttctatatggcaggtactcagaattctaagatgcctcatttcactaataatagttattatttgttgggtattattatgtgccaggtactacactaagtgatttatttttttaatcctcatgatcaacccatgaacgagataatatccttgtttcacagatggagaaactaaagatgagactggctaggtaacttacctgaggaaatagcctgtgaggttgcaaagcccacacgagatgccaggtctgtctgacttcaaagcctgtggcctaaccactgtgctctattgcattttatggtccatgttctccagaagcttacagtccagtagaatcatgaaaaaatgactatttcagtatggtgctcttacagcaccaaagaggagcacctgagcgggattagtcgagtcagcaggagatcctgaaaggctcagaactgagccagaaagacttggtcattttcagctgattatttaattacagattagatttcctagaaaaggagcccttcctcctatatggctccccctgcatgtgcccccttccctcaggcctatatattaatacataaaataacccattattataaaatgaaacgaaagcaaggatcagcagagggatggattctggactcaactgatcatattacaaggctaaaataaatttcctctctcggccgggcacagtagctcatgcctgtaatcccagcactttgggaggccgaggcaggcagatcacctgaggtcagcagtttgagaccagcctggccaacatagtgaaaccccgtctctactaaaaatacaaaaattagctgcgtgtggtggcacacgcctgtaatcccagctacttgggaggctgaggtaagagaatcgcttgaacccaagaggtagaggttgcagtgagccaagatcacgccactgcactctagcctgggcaatagagcgagactccatctcaaaagaaaaaaaaaaatttcctctttcttaataacagacaacaaagacctgaggctagactgtagagtgctgttggtgagagaaagttttgtttttttttttttactagtttggttcagggtgactgtattagtcagggttctctacagggacagcactaataggatagaagtatatatgaaggagagtttgttaaggagtattgagtcacaccatctggcgaagtcccacagtaggccgtgagcaagctgaggagcaagtaagccagtccaagtcccaaaacttcaaaagtagggaagctgacagtgcagtcttcagtctgtggctaaaggcctgagagcccctggcaaatcactgttgtaagtccaagggtccaaaagctgaagaacttggagtccagtgttcgagggcgggaagcatctagctcaggagaaagatgaaggctggaagacccagcaagtcggctcatcctaccttcttctgcctgctttattctagctgccctggcaggtgattagatggtgtccacccacactgagggtgggtctgcgtctcccagtccactgactcaaatgttaatctcctttggcaacaccctcacagacacacccaggaacaatactttacagcctttaatccaatcaagttgacgcttaatattaaccatcacggtgatcttctagattggctcacaaatgctctttcagaaactgcaggatgttcattctggaactgtacagaggcaattgtacagatggttgttttctctggaaacaacagtctacttgagtgataacatatataaaactttaagaactaaagattccattttgctgtaggccaggcatggtggcttacacctgtaatcccagcactttgggaggccaaggcaggcagatcacctgaggtcgggagttcgagaccagccagaccaacatggagaaactccgtcactactaaaaatacaaaattagccaggcgcggtggcgcatgcctgtaatcccagctactcgggaggctgaggcagcagaatcgcttgaacctgggagacagaggttgcagtgagccaagatcacaccattgcactccagcctgggcaacaagagtgaaactccgtctcaaaaaaaaaaaaaaaaaaaaaaagattccattttgctagcttttaatttgcttcaaaaagtacctgtagtttcagctacttgggaggctgaggcaggaggatcatgtgggcccaggaatttgagactgtccggggcaatatagcaagaccctaccctatgtcaaaaaaaaaagtgtaacaaaaatgtcatcacattactgtagaaataggaccaccttgtgacccttgaatagtttgttttccactctgctttctctccagctaaagaggcatggtgctttctctccggtagataaaattgagtagcgtttaagtagtactagggtgtgttattcagattgctaccctgaagtaacaagccttgtattctcagtggcctaacacaaaggatattgtttgtgttgtgtgtatgtgttttgctttgtttttgctgttcctgtctttcaaaaaggctttgcaagcaagactgaagtctggatggagggacaaaagtttaccttcttgggatacatcgcaacatatagcttttaaggtggggagggagagataatttatacctcacacttaattggctctgattagaaaggacacaatgacacaagttattttcattcataggtctttagccaaaggaatcacatgacccctcctgtttctgcaagggaggctgagaagtgtagagaacgatttggatatttggatatttcccaagcattgctgcttcagctgtaatttacagtcatacattctcagacaaagctggagcaactctagtacttgacagttactttatattaaaatctacaagtaatggttcagaagtttctgtgtatacttcactaagtttcctatagagcatttactttccttcgtggatgctttacgtactctctcattgcatgttttcagtttcagattctttattccagggcaaactaaatacctgtagtgtgttaagtactcagagagggagatatgaaaatgaataaaatctgaccccttttcttccgagcgtgtagcctaggagacaagcatgtgtaagataacatgatacagtttttttaaaatagagacaaacttggatgtcaattctagttcaccacctaaaactctgtgaccttaatcaaaattactcagcttccctgaaccttatcttccccatcataacacagggttgataatattctgcctatcttctaggatttctaggtttaaaactagtacatgtacaatactgtattgcctaacatctaatagatactcagttaacagtaggcatgagtacaactcaaggcagtgtaataaaattgctgtgcaatacaaagagtgctattagcagaaaggaaagagaattacttttgactggaggtgtctggcaaattttcactgaggatgtgacattcgagttgaggcttgatgaatgggaaagatttaaatggggagagagggaagttgaagtagaatgagcagaagtatagaggcataaaagtgacatgtttcagcatggtcatatggttataaatgaaattacaaaggtaggctgaagtcatcacagtggtctagattgttatgctaaggaatttgagacttattttgacatcgttctggaaccttctaagctttttaaaatttttttattgtcggggtctcactgtgcttccctggctgatgtggaactcctgccctcaagcagtccttccactttagttcccaactagctgggactacaggagtggaccaccacacctggctccatccaagcttttagattagtcgaaggttaaacctattttcgggaaggttaaggactatgaacgatgaaaaaatcaaagatttagagataaagatacaagttaaaatgttatgtgttggctgggcatagtggctcacacccataatcccagcactttgggaggctaaggcgggcagatcacctgaggtcaggagttccagaccagcatgaccaacatggtgaaacccagtctccactaaaaatacaaaaattagtcaggcgtgatggcgggcgcctgtaatcccagctactgaggcaggagaaccacttgaacctgggggcagaggttgtagtgagctgagatcatgccattgcatcccagcctgggcgacaagagtgagactccgtctcaaaaaaaaagaaaaacaaaagtgatgggtacaatactgtctctcaacctgtgtagtgggaatgttagacacataatttaggatcatgtcataaaatgggtgtaagtgtgaggagggatggtacagagataacatatattttctgcactcaaaaagctgcttggtaggctgggcacggtggctcacgcctgtaatcccagcactttgggagcctggggtgggaggaccacctgaggtcaggagtttgagaccagcctggccaacatggcaaaatcctgtctctactaaaaatagaaaaattagctgggcatggtggcacactcctataatcccagctgctcaggaggctgtgtcaggagaatcacttgaacccaggaggcggaggttgcagagagccaagattgtgccactgcaccccagcctgggcaacagagcaagactccatctcaaaaaaaaaaaaaaaacccacaaaaagctgcttggtgagccaggtacagtggctcacacctatcatcccagcactttgggaggctgaggcaggaggatcgcgtgagtgcagcaagttggagagcagcctgggcaacatagcaagaccctgtctacaaaaaattaaaaaaattagctgggcatagtggcatgcacctgtagtcccagctacttgggagcctgagatgggagcatggcttgggcctgggagtttgagactacagtgtgccgtgatcgtgccactgcactccagcctgggtgacagagcaagaccctgtcttaaaaaaaagagagagagagagagagagaagctgcttggtgagactataaaatactggtagctttcatatgataacctatttattaagcaactcccttattacactatccattatatttctgttctcttgcttctcctggctgcattccctaatcttttcctcataacacatcttttcactttctacataaggtttgttatccttaagctcagttttggggtttttcacttaccattttgttagatttgtctaccgaaatccgcccccttcccctccctgttggttcagaggtttcggtgtacagttcactgagttacctatagagcagtttgctttcacttagctgtgtatttgacatactcccttattacatgtctctaatgaaagatcctttattccagggcacaattagcaggaaaattgttacagggcatgtaattatagctgtcacatagtgaggagcattgcactgatcccctgataactgaggtgactgacagagaatgagaattacacagttttgacaaccattcatcgctgtgcaagcgcattaaaagagctttcctgcttcaagtttgctaatggctatgctatgtatgctcctgaataatctctgacagaattgtttgtttccgtataggacagacccctgataaggcaatacacagactggaacagatacagaatatgaataatgtcattggacttagtgaattttaaataataacagggatcctttttacatagaagaaaaatgttgccgggcgcggtggctcacgcctgtaatcccagcactttgggaggcagaggcgggcggatcatgaggtcatgagatcgagaccatcctggctaacacagtgaaacccctactaaaaatacacctctactaaaaatacaaaaaattagccaggcgtggtggcgggtgcctgtagtcccagctactcgggaggctgaggcaggagaatggcgtaaacccaggaggcggagcttgcagtgagccgagatcgcgccactgcactccagcctgggcgacagagtgagactccatctcaaaaaaaaaaagaaaaatgtatgttagtgacatccctattgcagacatggctcaccttctcagtgttttggcaagcataaaaagtttgattagccaggtgtggtggctcaagcctgtaatcccagcattttgggaggcagaggcgggcagatcacctgagttcaggagttcaagaccagcctggcccatatggtgaaatcttgtttctactaaaaatataaaaaatcagccgggtgtggtggcgcacgcctgtaatcccagttactcaggaagctgaggcaggagaatcacttgaacctggaaggcggaggttgtagtgagcctgagatcacgccattgcactccagcttgggcaacaagagagaaactccatctcaaaaaaaaaaaaaaaaagtttgataaccccgtaacactgaaatggtttctcttatagttggaccctgggcgttttttacacatggggacccaggctcgccaaagcattgctgctcacctagataaccaggttccagttgagagtccgagagctatttcccgcaccaatgagaatgacccggtgagttactaatatgtatatggggtttctcagggcttatgatttgtgttcctgtcctcattttgcataggaaaactgaaactgaaagaagcttagtagatttgcatttactcagatagtgcacctgagatagcactctggaacccagattctccctgtccctgtctgatactgtggtaacatacactggccagctcggtctgtatcagttcccatgtaatctctactagtgaattcacctagttccacggattttgctgagcatagagttgtcgaatactcaatacttactaagtttaatttcttactgggcaagtttaccaattattattgcttatattatgtgttgggtgacaggctttttcttaaaggaccatgtagtgaatatttcaggccgatggactgagatgatctgtcacaagtactcaactctgccataaacaaatgggtgtgaacatgttccagtaaaactctatttacaaaacaggtgcccagccataacttaacaaactctggtatggagagtactaaagaaattaaactacttgcccacaattttctaccagggcaggttcagaacccaatttttctaataaccaatctggtgctattttgcagttttgtaagtggatttcctagggtctggagagggaactaacttggtttgttgtgagaagagcagcatttaaagtgaattttgtctgcagaagccaggattccagcagtatctagtgttgcattttctagtccagttccccattagactggatattgatttctttttgttgctgcctctcataaatgaaattaatttgtggtgtgtgctgtaatgttaggaaccaatagctttctttccctgcccctaccctctgagtcttcccatcttaatatagtctgtgtggaaagaaaaagtaaacacccattacccaaaacatgatctcagcagggtgtgttttaaatatatctctaggcttcggccatgcggggtggctcacgactgtcatcctagcattttgggaggccgaggcaggaggatcacttgaggtcaggagttctagaccagcctagccaacatggcgaaagcctgtctctactaaaaatactaaaattagctgggtgtggtggcgggcacctgtaatcccagctactcaggaggctgaggcaggagaattgcttgaacccaggaggcagaagttgcagtgagccaagatcgcgccactgcactccaggctgggcaagagagcaagactctgtcttaaaaagtatatatatatggctgagtgaggtggctcacgcctgtaatcccagcattttgggaagccaaggcaggcggatcatgaggtcaggagactgagaccatcctggctaacacagtgagaccccatctctactaaaaatacaaaaaaaaattagttgagcatggtggcgggcgcctgtagtcctagctactcgggagactgaggcaggagaatggtatgaacctggaggtggagcttgcagtgagctgagatcgtgctactgcactccagcctgggcgacagtgcaagactctgtctcaaaaaaaaaaaaagaaagaaagatagatagatagatagatagatagatagatagatagatagatatagatatagatgaagatatatatatataccattcacctcttttcacaaacacaaaatgaagtagaataaatgaatcaagccactgaagtgtcttttcagctttctttgtaattgcagtccttttatctgccaattcctctggggtttctatggaaacagcagcatgcagatgatcttgtcacatgactggagcatctctatacacagcacagaagaatccagatggcaagaattgtctttgctacccctacatctacggtttactttgatgagcaattggcttcattatttgggccaccacttttatatacatactgggtttgagggcagcaaccagcattcttggctaagataaatgaggctgggcacagtagcttatgcctgtaatcccaggactttgggaggcctaggtgggaggatcacttgagcttaggagttctagactagcctaggcaacatagcaagaccctaactctaaaacaatttttttttttttttttttgagacagagtttcactcttcttgcccaggctggagtgcaatggcgcagtctcgtctcactgcaacctccacctcctgggtttaaatgattttcctgtctcagcctcccaagtagctgtgattacaggcatccaccaccatgcctggctaagttttgtatttttagtacagatggggttttaccatgttggccaggctggtcttgaattcctgacctcaggcaatccgctcaccttggcctcctaaagtgctgggattacaggcatgagccactgtgcccagccaaaaaaattttctttttctttttcttttttttagacggagccttgctctgtcacccaggctggagtgcagtggcgtgatcttggctccctgcatcctccacctcccgggttcaagcagttctctgcctcagcctcccgaatagctgggattacaggcgcctgccaccgtgcctggctaattttttgtattttttgtagagacaggctttcaccctcttggccaggctggtcttgaactcctgacctcataatccacccaccttggcctcccatagtgctgggatgacaggcatgagccactgcactcggccaaaagtttttcaattagcagtgcatagtggcatgcgcctgtagtcccagctactcgagaggtttaggtacaaggatcacttgagcccaggaggtcaaggctatagtcagctgagatcaggccactgcactccagtctgggcaacaggctttctcaaaacaatgggagatatcttttccagctttaagagatgagtggtccaggtgcagtggctcacgcctgtaatcccaacactgagaggccaaagtgggaggatcacttgagctcaggagttcaagaccaacctgggcaacatagcaagacctcatctctaccaaaaaagtaaaaaaatgagccaggtgtagtggtgcacacctgtggtcccagctacttgtgaggctgaggcgggaggatctcttgagcctgggaattggaggcctcagtgagccgtgattgtaccactgcattccagcctggtaaaccgagcaagatcttgtctcaaaaaaaaaaaaaaaaaaaaaaaaaaaagacataaaggccgggtgcagtggctcacgcctgtaatcccagcactttgggaagctgaggcaggtggatcacttgaggtcgggagttcaagaccagcctgtctctactaaacatggagaaaccctgtctctactaaaaatacaaaattagccaggcatggtggcacatgcctgtgatcctagctacttgggagggtgaggcaggagaattggttgaacccgggaggcggaggttgtggtgagccaagatcgcgccattacacttcggcctgggcaacaagagtgaaactccatctcaaaaaaaaaacaaaacaaacaaaccaaaaaaaacacataaagacatgagtgaatagcaggccttatccaattttcaaagtcttggtcacagataaaaagacaaggctgggctaggcgctgtggctcacgcctgtaatcccagcactttgggaggtcgaggtgagcggatcacgaggtcaagagatcaagaccatcctggtcaacatggtgaaatcccatctctactaaaaatacaaaaattagctgggcgtggtggcgcgtgcctgtagtcccagatgctcgggaggctgaggcaggagaatctcttgaacctgggaggcgggggttgcagtgagccgagattacaccattgcactccagcctgggtgacagagcgagactctgtctcaaaaaaaaaagaagacaaggctgggcaagatggctcaccctgtaatcgcagcattttgggaggctgaggcaggcagatcacctgaggtcaggagtttaagaccagcctggccaacatggtgaaaccccgtctctactagaaatacaaaaattagccgggtgcggtggcagattgtaatgccagctactgggaggctgaggtaggagaattgcttgtacccaggaggcggaggttgcagtgagctaagatcgcaccattgcactcctgcctgggtgacaaaagtaaaactccattttaaaaataatatatatatatgtatgtgtatatatatatgtatgtatgtgtatatatatatgtatgtatgtatatatatatatatatacacatagacatacatatatacacacacatagataagacaaaaaagaaagtcttggtcactttgtcaccattatacctgtttgcactcttatttcctaggccaagcatggggatcagcacgagggtcagcactacaacatctccccccaggatttggagactgtatttccccatggccttcctcctcgctttgtgatgcaggtgctcaagacagggaatggaattggagggagcccagaatacaagctgctgctagcaaaggggtggggctaaatgagaagaaaatttaaaaagatgaaatttaatctgaaaaacagaaattcatgtgttgattaccttttgtgactagtacaattactttaagctcatgtttaaacaatattgatgttttcctccttgtatagcccaagaagattccagtaatttcagcatcaaataactgttttaaatgaacttaaaatttgccttggcaaaatatcatgaaaatagttaatatgctgcacaaaagcaaaatcatagtacactcctgagctaaatagaagcaatattttgattagatgcattggtttttattctcttgtggattttgtgaaaatgttatcaaacttgcctgtgcaggtgagttttagcatgcgagccagaggatctcatttctttagtgtggtttatttcgggaaattagatgaataataagggcataacaggccgggcgctatggctcacgcctgtaatcccagctgcactttgggaggccaaggtggaaggatcacttgggcccaggagttcgagaccagtctaggcaacatagggagacctgtctctacaaaaattaaaaattaaaaattagctgggcatgatgcacacctgtagtcacagctactcaggtggctgaggttggaggatcgcttgagctcaggaggtgagggcttcagtgagccatgattgcaccactgtaccccagcctgggcaacagagcaagaccttatctcaagcataaaataaaataaggtataacaggccaggcaaggtagtttatgcctgtagtctcagcactttgggaggtgaaggtgggaggattgtttgagcgcaggagttcaagaccagctgggcaatataatgagactgtatctttatttagaaaagaaaaacatgggcaaccctctcgggtccccttccacactgtggaagctttgttcttttgctcttctcaataaatcttgctgctgctcactcaaaaaaaaagaaaaacatttagtcatgtgtggtagctgcttcggaggctgaggcaggaggatggcttgagcccaggagttcaggctgcagtgagctacgatagtgccacggcactccaactcagacaacagagtgagaccctgtctccaaaaaacaattttaattaaaaaaaattttgttgaagaaatcatctgcagtggcactttaaactgttccaagacatacacagtacaatgtttattcagcttcagagctgtgaggttctatctttaattaactatttgaagttgttttcagactggcttaaccaacaatgctctgtaagaacttacaggttcttttcataattttcatttacatgaaggcctacttcctcaccattgtttgtggatattagcattgtcatactgcctaatatgacttttttttttttaaatactgctccttttggagcagacctaactcacggacagtgtgcccagggtagctgactttattttattactattattttaattatagagacagggtctcactctgacaaccaggctggagtacagtggcgtgaccacagcccacagcacactctacatctctgacctcctgggctcaagcgatcctcctgtattggcatctcaaagtgctgggattacaggtgtgagccacagctcccagccctgatgtgacttttttttgaaatggagtttcacttttgtcgcccaggctggaatgcagtgatgcgatctcagctcactgcaacctacgcctcctgggttcaagtgattctcctgcctcagcctcccaaagagctgggattacaggtgctcgccaccacgcctggctaatttttatatttttagtagacatggggatttgccatattggccaggctggtctccaactcctaacctcaggtgatccacctgtcttggcctcccaaagtgctgggattacagggatgagccaccacgcccagccaacatttgttttaatacctttatcatgtttttttgaacattgagccttccattaagtttggaattgcctgtcaaatcctacaccaattcaattgttttgttaggatttcttttaaaaatatcaacactggctgggtacaatggctcacgcctgtaattccagcactttgggaagctgaggtgggcagattacttaaggccaggagttcaagatgagcctggccaacatggtgaaactccatctctactaaaaatacaaaaattagctgggcgtggtggcacacgcctgtagtcacagctacttgtgaggctgaagcaggagaatcgcttgaacccgggaggcggaggttgcagtgagctgagatcgtgtcactgcactccagcctgtgcgacagagcgagactctgtctcaaaaaaaaaaaaaaaaaattaacactattttagttatacttacaaacagtatttgttagatattcttattagtagacatattttaatattttctttgcaaatcagtttcacacacattagtacttcccaaatttcccaccaaagtattctggtagcaaaaggggaattaaactctgaaaggttagtatgctggaggtatgaggtatggatggccttagagttgtgaggcagctggtcacacctgctcctgagccgccatgtatttagttctagagaaaaaagtctaaatggttaaagtaataaaaataaattttaggccaggtgcggtggctcacgcctataatcccagcaccttgggaggctgagacgggtggatcatgaggtcaggagttcgagaccagcctgaccaacatggtgaaagcctgtctctactaaaattacaaaaatcagcctggcatggtggtggcacctgtaatcccagctactgaggagactgaggcagaagaattgcttgaaccccggaggcggaggttgcagtgagccgagatcacaccactgcactctagcctgggtgacagagtgagactctgtctcaaaaaaagaaaaaaaaaaaaaatcaactaaaaataaattttaggccaggtgcagtggctcacgcctgtaatccctgcactttgggaggccaagacgggggtgtcacctgaggtcgggagtttgagaccagcctgaccaacatggagaaactccttctgtactaaaaatacaaaatagccgggcatggtggtgggtgcctgtaatcccagctactcgggaggctgaggcaggagaatcacttgaactgggaggcagaggttgtggtgagccgagatcgtgccattgcactccagcctgggcaacaagagtgaaactccgtctcaaaaaaaaaaaaagaaaaaaaatttaaagagttaatgtttattgaattattaacttgtgtcagaaattttaagcatttttctatatgctttccatatttacagtggccctaagtggtatacataattttgttatgagatatatcaattatttatagatttcagctgagatagaatatatgcttcagtaataggaataatcaaaagctgactatcatgttacttagtgcggaataatgtatttcagtttttagctaagttatatggatagattttcaaactcagtaccaacccagcttctcctaactgagtaaattagaggcatgcaatctgatggtcttggttgccactttaggcagagtatatataccaccccccacccactccttccacacccacccactctttccttctttcctactttatcaggtgaagacattcagtgaagcttgcctgatggtaaggaaaccagccctagaacttctgcattacctgaaaaacaccagttttgcttatccagctatacgatatcttctgtgtatcctttcctgcctgcgtggaccctcatgaaccaatgctttctcccctcaaataaggcaacagaagaaatgaaaaaaagtactgttgaggccgggcatggtagctcacacctataatcccaggagtttgggaagccgaggcaggcgtatcgcctgaagtcaggagttcaagacctgcctggccaacatggcgaaaccccgcatttactaaaaatgcaatatattagccgggtgtggtagcgtgcacctgtaatcccagctacttgggaagctgaggcaggagaatcgcttgaacccgggaagcggaggttgctgtgagctgatatcaagccactgcactccaaccccatctcaaaaaaacaaaacaaagcataactactgttcacatacaagtgatccttccagtcatgttttctttaacaacatatactttagatggagagaagggaacaggaaaaaccctaagtctttgccatgttattcatttctgtgcaaaacaggactggctgatactacatattccagatggtaagaacttcctgttgtttcttctgtctgttaggtttagttatcctgttactgtggtagccttgcagctttaattttcttttcttttcttttctttttttttttttttttgagatggagtttcgctcttgtcggccagtctggagtgcagaggcgcaatctcaggtcaccgcaacctccgcctcccaggctcaagagattctcctgcctcagcctcccaagtagctgggattacaggcgcccaccacaccaccacgcccagctaatttttttttttttttttttttgagacggagtcttgctctgtcgcccaggctggagtgcagtggcacgatctcagctcactgcaagctccgcctcccgggttcacaccattcttctgcctcagcctcctgagtagctgggactacaggcgcccgccaccatgcccggctaattttttttgtatttttagtagagacagggtttcaccatgttggccaggctggtctcgaactcctgacttcaggtgatccacctgccttggcctcccaaagtgctgggattacaggcatgagccattgcacccggcctcagctttactttcctaacagggatctgatagctaaaggaaaagcctttgccagtcacgatggctcaaacctataatcccagcactttgggaggctgaggctggaatattgcttagagcccaggaggaggctgcagtgagctgtgatcgcaccactacactctagcgtgggcaacaaagcaagaccctgtctcaaaaaaaaaaaaaaaaaagaagaagaagaaaagcctttactccagatgtagagcagactgagctcatccatcatgatttcttcgtgatattactgccaagcagattataaggtgaagtcaatgtgacaaaaggaaattcggctaaaagcttcctgaagccttttgatgctaagcagtccttcttttgatatttaatacccatggacataaacttctgccttagaggtcgccatggagttttgttttgttttgttttgttttgtttttgccatctgttaacagtcctgagtacccatagagccttttactatttatcagcattctagagtcgtcagtatggattgtcaaaacttgcatttgtctcttttttgttcagtgttgtgtgcatccacattttctttcttttttaaacaaccctgcttatgtaacatccacattttctgacttacctttcaaacctgccagaaagcagaagtgatatttaatacacttggtatgttttatatattgattctaatgataatgtttagtctaagatggacctgacaaggccaggcatagtggttcaacagcactttgagaggctgaggcaggatgattgcctgagcctaggagttcaaggttacagtgaactgtgatcacatcctgccttctagcctgggtgacagagcaagaccctgtctcaaaaaaaaaaaaaaaaaagaaaagaaatatatatatgagaaactaaagtcatttcccataacttaaaagaggcatagaatatttcgagttgaatacagtttctgcctggcttgttttcttctgcctcttttttttaaagctcatctttgggtgaaaaattgtcgggatcttctgcagtccagctacaacaaacagcgctttgatcaacctttagaggcttcaacctggctgaagaatttcaaaactacaaatgagcgcttcctgaaccaggtgactagactcccagaagttgagtgctaggtagtccttacatggattctttgtgccctgagtaccaatagactatggagaactgatactggagttggaataactgtatcatttttaatttctttcatacgttttgctcacagtggactcataacttgaaactcatttatccatgtgaaataaataggcaacagtaagttgttcccattttgtgggtagcaaagtgaaatccagttgattcattgacttttcaaggtacagcctccaatccctcgcaagcacatttccaactacatgattttctccagacaatatctttttagggaaccagaaatgtattggaaaaattcttctttaccctggtgattcttagataccctgtctagaccaggggccttcaactctggatataaagcagagtcacctaagagcttgttaaaaatgcagatgccagagtctcattctggacattttcatcagaatcccttatgtatgtttattcaaggctccaagcagaaatggattagaaagcattcactttggtcaggcacaggggctcacacctgtaatgtcagcactttgggaggccaaggcaggcagatcacctgaggtcaggagttcaagatgagcctggccaacatggtgaaatcccatctctactaaaaatacaaatattagccgggtgtggtggtgcacgcctgtaggcccatctattcaggaggctgaggcaggggaatctcttgaacctgggaatcagaggtttcagtgagccgagatagcgccattgtactccagcctgggtaacagagcgagatatggtctcaaaaaaaagataaaagaggtcaggcgtgtggctcagacatgtaattccagcattttgggaggccgaggtgggcagatcacctgaggtcaggaattctagaccagcctggccaacatggcgaaaccccatctctactaaaaatacaaaaattagccaggcgtggtgacacacgcctgaaatcccagctacttgggaggctgaggcaagagaatcccttaaacctgggaggtggatgttgcagcgagctgagatcatgccactgcacttcagcctgggttacagagaaagaagctgtctcaaaaaaaaaaaaaaagaaagaaaagaaagcattcacttctacattgaggtctcttacagaacctgaacaatagattaaaatgaactcctgttaaccttagcctccaaccttttcaagggatggtttcacccttaggccaagtagccttttttttggtttttattttctttgcttgcttttagataaaagttcaagagaagtatgtctggaataagagagaaagcactgagaaagggagtcctctgggagaagtggttgaacaggtataagaaaaaacactgaatgtgtaacatgcgataacaagagaaggcctctggtagcactacaatccactgtctctcccaatagggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccggtaggaaaactgggtgtctctatcttgtttctctgatttctgattccatcagtatggaggctgggtcttagccttgtagaccatgcaatatgttttcttgccctaggaatatttgaagataaacagtaaagagctgggtgcagtggctcacgcctgtaatcccattggctcacgaggctgaggtgggaggatcgcttgaggccaggagttcaagactaggatgggcactatagcaaggcccctgcctctaaaaaaataagaaattagccggtagctggcatggtggcacacacctgtagtcactgctactggaaggctgaggccagaggatcacttgagccctggagttcaaggttgtagtgtggcatgattgcaacactgcacaccaacctgggtgacagagtgaaatcctgtctcttaaaaaatatatatatggctgggcacagtggctcatgcctgtaatcccagcacttggggaggctgaggcgggcggatcacctgagcttggagttcgagaccagcctgaccaacatggagaaacccatctctactaaaaatacaaaattagccgggcatggtggtgcatgactgtaatcccagttactcgggaggctgaggcaggagaatcgcttgaacccaggaggcggaggttgcagtgagccgagatcgccatatatatatattcatatatatgtatatatacacacatatatattcatatatgtatatatacacacatatattcatatatatttatatatacatatattcatatgttttcataatatacgaatatacctatatgttcatatatgtatatataatattcatatatgtatatatgtatatataatattcatatatgtatatatgtatatatacgtatatatgcacacatacatattcgtatatgcatatgcacacatacatattcgtatatatatgtgaagataaacagcaaggcctggtgtgatggctgataaatcccagcacttttaggaggccaagaggtgatttgcttgagtccaggagtttggagtttgaggtcagcctgggcagcacagtgaaaccctgtccctacaaaaaatataaaaaactagctgggcatggtggtttgcacctgtatgtagctccagctacttggaaggctaagatgggaggatggcttgagcccaagaggcagagcccgcaatgagtggagatcgtgccactgcattccaggctgggcaacagaatgagactctgtctcaaaaaaataaaaaaaaagaaaagataaacagtaaaatggaatcagaggaggaggtaatgccaagagttccactattcattgaaaactaagggagtatgttgtggaaagagaatgacagcagaagctatgttttctttcttaatttttatctgtcttttgattcttttttcaaaatgagtctagatggtctaagcagaggagatcagaagcatcaaaatggggctggtttggggcagtgggtgtttttctcagtgactgttaatctccagaagcatggcagttctagggccagaggctacgtggcttatcctagagggagtaccttcaggtatacaattatgtcttagttgagggttttaaaaaaattgttgtcaccaggtgcagtggctcatgcttgtaatcccagcactttggtaggccgaggtgggtggatcacaaggtcaggagtttgagaccgtcctggctaacacggggaaaccctgtctctactaaaaatacaaaaaaattaggctctggtggcgcgcgcctatagtcccagctactcaggaggctgaggcaggagaatcgcttgaacccaggaggtggaggttgcagtgagcccaaatcgcgccactgcactccagcctgggcgacagagcgagactctgtcaaaaaaaaaaaaaaattgttgtcaattgtttcgggagaacatctaggaaaggcacgtgatgatctcttctctctttctgtccgatatgcagattgcccccgaggaattagcacttgttcacaacttgaggaaaatgatgaaaaatgattgggtaagtgcatatgatacctcacacatttcagaaagaaatgtattatcattttaaacatgttctactatttcattgctaatactttacagtctctaattttatggacagtaagttattatgtcttatttaattcctgtatctgtaccaagttagaaataaagtctgaattaaaatctatatatatgtggtttataatctttccaaagtaagtttattcaaaaccattttatttaaatattggcctaattttattttgcttgcagacatttaaagtgtttttgtatctccttaccgtctttggaaaagagtttgagacccacaaatatgtcatggtaaatttaaaatcaggtagcagtttattgtcagagccaaatctggaataaccaatttagttgccatttaactgtgctagaccacacttttgtaacactgtatgcccaagaaagaaaaaaaaaatctacagatgattaatgcagttttccatcctttttaactttttccagttcagccttttctcttttctttcagcatggaggcgccattgtgtcggctttgagccagactgggtctctctttaagccccggaaagcctatctgccccaggagttgctgggaaaggtcaagtcaaaggaaaatttgtttctacttagattgttatcctgtttaaagaaaaatatttttattaatctatgtattttgacataatttcagacttagagaaaaatcatattcctgtatgcccttcccctggattcctaaaatattaacttgatcatcattgctttatccgtctccgtctttctccagagtttcttttcttttttttttttttgagacggagtcttgctctgtcaaccaggcttgagtgcaatggcgcaatttcggctcactgcaacctccgccttccgggttcaagtgattctcctgtctcggcctcctaagtagctgggattacaggcgtccactaccacgcccagctaattttttgtatttttagtagagacgaggtttcaccatgttggccaggctggtttcaagctcctgacctcaagtgatccgcctacctcagcctcccaaagtgctaggattataggcgtgagccacggcgcctggccttgatgcttctttgtctccaaataatgtctcattcctaagaacaaagatactctaatataccctgagcataattatcaaagtcagaaaattgacattgatatcatacttttacctaattggtgggatttattctgatgtagccagttatcccagtatcttttatagaaaaataaatcccagataatgtgttacattaagttgtcatgtctctggctgggtgcggtggctcatgcctgtaatcccagcactttgggaggccgaggcaggcggatcatgaggtcaggagatcgagaccatcctggctaacatggtgaaaccccgtctctactaaaaatacaaaaaattagccaggcgtcgtggcgcgtggctgtaatcccagctactcaggaggccgaggtaggagaatcgcttgaacccgggaggtggaggttgcagtgagccgagattgcgccactgcactacagcgtgggtgacagagcgagactccgtctcaaaaaaaagaaaaagttgtcatgtctctttggtctcctttaatctgtgacagtctgtcagtctttgtcatttgaaatctttatgtttttggcatgtgcatgccagctattttgtaggtcactttttggggttgtctgaggtttcctcctgaatagaagtgatgttagaagtgatgacatgtctgagtgagtgcatcctatcaggaggcacatttctcccattactggtaatgattttggaactgttagctgaggtgttgtccatctggtttctcttcagtaaagttattattttgctttggaattaatatgtatgttgtagagatatactttgagactaggtaaagatcctgttacttctcaaacttccacctactggttttagtatccattactttagttatacctggcatggagcctccgcagctggtatggtcttgtggatttttatttaatagaatctaaatcattactgtcactttttattttggtgctcaaatcatcttagatttggccattaaaaattccttcattggccgggtgtgatggctcacgtctgtaatcccagcactttgggaggccaaggcgggtggatcacgaggtcaggagttcaagaccagcctggccaatatggtgaaatcctgtctctactaaaaatgtaaaaattagccaggtgtggtggtgcgtgcctatagtcccagttactctggaggctgaggcagaagaatcggttgaacccaggaggcggaggttgcagtgaaccaagattgtgccattacactccagcctgagccacaaagcaagactccgtctcaagaaaaacaaaaaacaaaaaaacaattccttcatggccaggcttggtagctcacagctgtaatcacagcactttgggaggccaaggcagaaggatcccttgagctcaggagtttgagaccagcctgggcaacaaagtgagaccccatctctacaaaaaaaaattttaaaactagctgggcatggtggcattcacctgtagtcacagctactctggagactgaggtgggaggatcgcttgagcccgggaggtcaaggctgtagtgggccctgattttgccagtgtactccagcctgggcaatagagtgcggccctatctcaacaggaaaaaaagctccttcaagctaacttctatatccttttaaaatgtccccatcattatttttttggagatagggtctcactctgtcacccaggctgtagtgcagtagcaccatcatagctcactgtagccttgagcacatgccaccacacccagcactgaatgttgtctttttcttttctttcctttttttttttagaggcatggtcttaactatgttgttgcctagggtggtcttgaactgctagcctcaggcaatcctcccacctcggcctcctaaagtgctgggattactggcgtgagccaccatatccagctcctatcattctttgaccacttctttattttctgtcatgagaatatgttccagacccctcttatacttcccatgcccagccctggaatctccatttctccaaagagcattggcttattttagaggagactggtatttagcaaccaaggcctgagtcctaggtatactcactgctactgaggtgtcctttctcctaggccctcacagcaaagttcataaatagatgtacatacatacatgtatgtatgtatatgtgtgaaccatatgcatatacatgtttatacacatccacacacatctgcgtttgtttctctaatcatattaaaaaactatgagttcctactagtagccaattccatgctaccatcacagcagtcattataccctttccatatctgtaactctaatctaaaataatgagaaatctgctgccagtagccatagtatatttacttattagctcaatactagaatatatgaaaagtagtttcagatttgatagctctcaggctgggcgtggtggctcatgcctataatcccagcactttgggaggccgaggcgggcagatcacgaggtcaggagatctagaccggcctggccaacatggtgaaaccccgtctctaccaaaaaatgaaaaaaaaaaaaaaagaaaaaaaaattagccgggcgtggtggggcgcctatagtcccagatactccgaaggctgaggtgggagaatcgcttgaccctgggaggcagaggttgcagtgagctaagatgtgccaatgcactccagcctgggagacagtgaaaaagaaagaaaaaaataagttccttgggccgggcgcagtggctcacgcctataatccctgcactttgggaggccagggcgggcggatcacctgaggtcaggagttcaagaccagcctggccaacatgatgaaatcctgtctctactaaaaatacaaaaaattagctgggcatggtggtgcaggcatgtaatgccagctactcgtgaggctgagacaggagaatcgcttgaacccaggaggcagaggttgcagtgagccgagatcgtgccattgcactctagcctgggcaacaggagcaaaactcagtctcaagaaaatgaaaaaaaaaaaagaaatacagtttgattacttcatttgtttccatttgttttccatctagcgtattttttcccattatttttattttttattttattttatttgagatgaagtcttgctctgtcacccacgctggagtgcagtggtgcaatctcagctcactgcaacctccacctcccaggttcaagtgattctcctgcctcagcctcccaagtagctgggattacaggcacgcatcaccacgcctggctaattttttttttttttttttttttgagatggagtcttgctctgtcaccaggctggagtgcagtggcttaatctcggctcactgcaacatccacctcccgagtttaagcaattcttctgcctcagtctcccgagtagctgggacgacaggtgcatgccaccacgcccagctaatttttgtaatttagtagagatggggtttcaccatattggccaggcaggtcttgaactcctgaccttgtgatctgcccgcctcagcctcccaaagtgctgggattacaggcatgagccaccgtgcccggctaatttttgtatttttagtagagacagtaattttgtatttttagtattttcaccatgttggccaggctgatctcgaactcctgacctcaggcgatctgccctccttggccacccaaagtgctgggattaccagcatgagccaccatattcctttgaaaatatgaaacattaactttgtttcaaaagccaaaactgtccaaaatacatacacacaatatgtgtgtgtgcgtgtgtatgtgtgtgtattcacacaagtagcatccgcctcctcaagcattgcctttttttttgtgtgtgtagacatggtcttactctgtcacccatactgtgacagtatgtgtagtggagcaatcgcagctcactgcaatctcaacctcctggtctcaagcaatcctcagcctcccgagtacctggggctagaggcacgcagcaccactcctggctaatttttgtattttctgtcgagacagggttttaccacatggcccaggctcgtctggaactcctgggctcaagcaatatgcccatctcagcctcccaaggtgctgggattacaggtgtgagtcactgtgcccagccacctctttttaatatatagcatttgtggccacgtagagcacgagtagccagccaccatatgtggagtccatatgtggagtcctgtatcaggcaatgttgccagagaatgagaagtagagttacatagaagaaaaacaaataccttaccttcaaagtgcttaagtagagtctgtctgtctggtgctttgttccttaactaacatgtttcctgatcctttttcttccccaggaaggatttgatgccctggatccctttattcccatcctggtttccaactataacccaaaggaatttgaaagttgtattcagtattatttggaaaacaattggcttcaacatgagaaaggtccatcatttagttttttcctatcagggctttgtgatcacagtagaatcccactcagtcagagccttgatctcttcttcccttaacaacagcctctaatttgtacttcatcctttatcttgacttctttctggctgataaatggtacagaaaagcgggtgggaggcagttaaggtttaatttacaaaagagattttatccctaaattttccatgataaagaagggaacaaaggcaactccatccactgggcagaatttccaggtaattgggttcctgccacattctccttattgaatttatttattcaatagacttcactggagagactcatgctgggacacccacagaaaaattcatactgtgcaagggctactccagcacctaagtaaatctttgccacacctgtcctagtatatgtacagaaattaactttcagcactatatttcatctactctgactgaaagcattccaactgttcatttacttgcccttgacctcacatttgagtatgaagaggggatatagaagaaaagctaaggctgctctatcactagataatagagttaatagtaatcggaggcctggtgcagtggctcacacctgtaatctacactttgggagggcaaggtgggaagaccacttgatgtcgggagtttgagaccaggctaggcaatatagtgagaccccatctctattgaaaaaagcaaaaaaaaaaaaatactatttagaatagcttattaaaggagtacagtgaagagtgtaagactaactgtagcatgttaagttgggatgcacaatagacagatttctaagagttgggagatgtcacaaaatcctgaagtccagaagacactcttggagtggagagagagctccatgctggtttggaggagtagacacagaaaaggaagtaatgcatacaaaagaagagtagcttgttggggtgagggtctagaagtaagatctcttgggagatgataattacctcagaacgtaatttggatatggtagcctctgactacacgatattctggggaacacagtgcagcaggaggaaactgccacttacctgtgtttgtctccattttagctcctacagaagaagggaaaaaagagctgctgttcctaagtaacgcgaacccctcgctgctggagcggcactgtgcctacctctaagccaagatcacagcatgtgaggaagacagtggacatctgctttatgctggacccagtaagatgaggaagtcgggcagtacacaggaagaggagccaggcccttgtacctatgggattggacaggactgcagttggctctggacctgcattaaaatgggtttcactgtgaatgcgtgacaataagatattcccttgttcctaaaactttatatcagtttattggatgtggtttttcacatttaagataattatggctcttttcctaaaaaataaaatatctttctaaagtgttgtgttagattaataatatggaaggagtctttagattggccaaattgcatttctctgatattcctcttgttgcaggtcagaagagatcaattctacagaaatttccagtggttctgttgaggctttatggaattcagcatgtcaaaattcacagctggctgggcacagtggctcatgcctgtaatcccagcactttggaagcccaaggcgggcagactgcttgagttcaggagtttgcaaccagcctgggcaacatggtgaaaacctgtctctactaaaaatacaaaaattagccgggcacggtggcatgcgcctgtaatccaagctacttgggaggctgaggcaggagaattgcttcaacttgggaggcggatgttgcagtgagccaaaattgcaccactgcactccagcctgggcagcagagcaagactccgtctcaaaataaataaataaataaataaataaataaataataa

SEQ ID NO: 720 - DNA, 49916 bp, Homo sapiens; identical to SEQ ID NO: 719

SEQ ID NO: 721 - DNA, 138465 bp, Homo sapiens
  misc_feature (32876)..(82875): n is a, c, g, or t
gaaaccattctggctcacaactttaattgattgctttccctccactgggcccaccgggtcggcttacatagctcatagctcagtgctgctgaaatagacccagggcaagaaaggtatgaacaaccagtgaatgccactggagcataaatgttcacaaaattgtagagaaggggtgacaagaagcaagcagtggggcagggagtgtcactgatgtccgaaaccccgggtcagaccaacacgcagcacagccactgcaaaggaaagggacaagattgagttcttggcttctcaggggctggtgtgctttcaccattgatgctctcctgcctcacatgggtgcgatctttttatctccattctccagtaagtgccttgctcaaacatgggaagcaaggaaggctttcactatatcactaactcctgaaccagggtactacagaaatgtgactcagaaaaagctctagacccaaagggagctccaaaaataggtatgtgcatgtatattcatacacacacacacacatacatatatacacaatagtgtatactattatatacacacatatatatacactatatatgtgtgtgtgtatatatatccctatagattcctatatatgtgtacatatcttttcctatatatgtatttgtttctatatgtgtatatatatattcctatatgtgcatatttgtgtgtgtatatatgtatattttatgcacccacacaaccacactccattttaggttccacactattgtccaggtatctgtgggaatccacaggtctatttctaggaaggcctttcctgggctacaggaaagaggtcaatagcattcccactttagagaagaaaagaaagtgggtaagcacagacaatggggcacagccagtaataacctggccctctagttccaccgcctcagaatcaagtcaaaggccaatgcctccccctgcctggacccttggagacatctccacacttcctgctgtcccctctggccagtaaaggcctctgtcgtacaggggtgcagtgtccacgggggaagtactctgattttttctgcaaaaacattatgtgacttgtacacagtaaaaacacttgttcattttgcatcttcattctacccactgcaatttcatttttgtttcctacatccttccataggtccatataagacagctggtcctagaagccagacactttatattgtgcccactacccacaactccatccaaattaacaagggcttgcatctccgaaattatctgaaatgtagctgtagctttatctttacgatcataataataataaacaaaaatgtttggaaaactgtataacagttgccttcctccctgctgggtgcctgccacagaacgtgcatggtattcacatggaactaagacagccaacaggaataagcatcacttggcagctacatggtccaagaatttcagagtaccatcagccagcaattcatcaaacctcaggacattcacctcggccagagagagctgaaccatgccatccttgtcttcgtccagaaggctgaatagttctaaaacaccagagaaggaaatgaaattagataaggctgttcctggactttggaacaatcagagagctgcctctgtctaccccatccccacctgcggaactctcctttcccctaccaccccctcccctccagcccccacctaggcccaggggcctcaaaaagctagatccagggcacacaatgagcttttgggggatcagatgcccccctgccgaaacagacaaaccccgttgccagcagagatggtccctttggtatctccatcctcagaagctttatatcagaaacgtgcaattactttatcaaggtcaaacagattgtggttgtcttgcttgtgggtaatccagtcccttagctttgtctctggctaactgaccttgacccactagaacgtaacacctaccaaacctcagtggaaggaaaaatcccttcctaataagatatctaatctcaaggcccaagatggcagaaaaacgcctattgccttcagagggcaccccccatcccttcattggaaggtggcacatgttctcaatatgatccctattgaaaaacaaatataaatagacactaaacaccatctaagaacagttactgtgactcattcatcttggcctagtgactgcacactgtagatgcgcaatagtctggatggcagctttgttaagtctccaaaaaaggcatcctccgtcctggatctggccagcctggacttcctcagccccttcaggtccagctgcccctcgcccccaaggtgccagcattccagaagccctgtctatcattttctgggtccctggcctcctaaaggcaatgtctggttctgccccttggccctgcccctgccccaacttgcaccttgggattaataggatggggctggaggacagagtgactcactgaagagggtctccaggcggatcatacaagccacgaagctgtcaaagttgatgccgagcttgctgcacgcataccgcagggcaatggtctgctgcacctggctgttgagggtgaaacctgagggcagagggagcctgggtcacaggtagagtggaggactcagcactgtctcccataaacactcaaggagctgacatcccaggggcccctctgtggttctgtatcaatctgcaaaccaggcctgactctgccttctccaggggatcccagaaggtgtcctgccatccatccctctccttgtagctactcctcaccaagatcagcctaattccaggtccagcgctagtaccagcaccaactcagccatgggtcacatcagcaagcaaaagcagagaaggtgagggggctgcctgtctggccagttcctgtctgtctccttcatagccccttcctctgtaattgctgtcaccttcccagtaacaggcagagatcttggaaaaattctaaaatattatgctatatggaatcgagcaatattctccccttcctggacagggaaggtactcaacaaagctctgttgttgccttgatatcccatataagaaagctacaaatgatgatcattagcaatcatcatcatgagaataaatatttacaatgtgcacacctggatcccaagaccctgtctacaggatgtgtcctcacctgccttcctgagggctgtcctcatctcgtgggcatcgatggtgcccgagtggttataatcagtttcccaatagatctcctaaagcaggaaagaaatcccaagtagaaaacaaccattcacggcccctgccagaaccatctccctccaccacactgctttctcaaaaggccagggacactttcaaaaggagaccctattgactcctcccaagaaggtttcagagcaagcataagagcttggccagtgctggcccctttgctgtctgaacagcagggctttcagggcagtggttggcatgagagtctctcattgccttcttgttccttcgtgaccaatgtgcccaggactcaatagttttgaccatgattaaggatgtggtcagactacaatggaccaggaatgagtgtaagggaggattagaacagaggagaggatgcccagaaggaaaagagagttaccagatacttctgaatcttcagccagagcgtcttgaattccaccgcccccaaagtgcccgttccattgctctaggcacgttaaagaccaacatgattgagtccaaattctacatgccttacagatttctttctcttgtgagcttgcatgagtgccttaaggccttagtgaaccttccatgtctgtggcaagcagagcagtgggggtgacggtgtgtaacaggttcaaataaagattaaaaagtcaaacgtgcaccaaggctctcctctgaggccaggcacagagctaggaacaaagggcaagtcatgagctggccaatctgcaatatcgtgaataccctaatcatcctggtttatttacagggtggagctgtatgatctgtaaattcgcttctacatttacatttctgtgattgatcattcagctaattagagtttgttggaatgtcaaaatgttatgggaaaagacatcaggagccaggaaccatgggactgggagtctaagccacagaatctgctcataggccactatacaaccaaacaggaggatattatgagggattttctgtgtccaacttacattcactccacaacttttttttttttttttttttttttttgagacggagtctctctgtcgcccaggctggagtacagtggtgtgatctcagctcactacaaccactgcctccagggttcaagcaattctccatgtcagtctcccaagtagcagggattacaggcacccgccaccatactccactaatttttttttttttttttttttttagtagagatggtttcaccatgttggccagtctggtcttgaactcctgacctcaaatgatctgcctgcctcagcctcccaaagtgccacgactatttttttttaacgctgtgctagtcaatagggatttagttttgaatgcacttatgctcctaaagttaagttttttagagactctacaattttctcaccagtcacaactaatcaataaacagtgcgtatgttacagcaccaatgttaaaattttgaaacagccccagctactcaggaggctgaggcagggggattgcttgagcccaggagtttgaggctgcagtgagctcagattatgcctgtgaatagccactgcactccagcctgggcaacataataagaccccatctctgaataaataattagaattctaaaacagactatcactttaattagccaaacaaaaagtcctgtaagcctcatactttaagaaagtctgtgttcttggatctataatccgcactgagtgttgaatgcatcatagccttcaaatccttactaataattcaaccaacacatctcagaacagtagtatgcaaaggaagctaacactcggggctaggtactctacatacttgtatctcatttcatcctaacaatagccacacaagctagacataattatcccattttccaggagaaactgaagttcagagcatttagtaacttcctcaaatttatacacctcaataagtggtagagccagaatttggacccctgtctgtttcaaaacctttgtcccagaacaccagtggtcttcaattccagataaaattgcttgcagagaccacacctatggaatcaggatctccaggaatcaggggtttttgtttgttttgtggttgttgttgttgttgttgttgttgttgttgttgttgttgttgtttgagacagagtctcactctctcacccaggctggagtgtagcagtgtgatcttcactcaccgcaacctctatctcccaggctcaagcgattctcgtgcttcagcctccccagtagctgggattacagacatgtgccatcacgcctggctaatttttgtatttttagtagagacaggatttcactgtgttccagactggtctcgaactcctggccttaagtgatctgcccaccagtgccacccaaagtgctgggatgacaggcatcagcccctgcgcccagtcaatttttaaaattttttttctagcactttgtaggacatgtgaaagactgtatttttaaactgtatttttaacaccccatgggtgataaagtactgatacatgctatagtaattgaaacatcatgttcagtaaaaaaagtcaattacaaaggaccacatattgtataatttcattatatgaaatgtccacaatagacaaatttgtagagacagaaagtaaattagtggttgcctagggatggtcgtggaggttgggggaaatggagagcgactggtaataggagtacagggtttctttttagggtgatgacaatgttctaaattatgtgatgatggttgctcaactctgaatacacaaaagccattgcctgatatactttaaatgagtacgctgtgtggtgtgtaaatgatatctcaatagagttgttatttttttaaggattccatgggtatttctgctgattcagaaccactgccccacactacctaaactgtggaacagaaactcctgaagagtggcagagagtcacactcctctttgaaccgtgagagacacaaataccattgggaataaagagtgggtagattacaaggcaactctcaaatctaaactgaagtcaacagatggggtttgatgagaatgattcagaaaccagggaactatttgcagtaaagtgaatcaatacttaacagttccttgcagtccacaaattaaattgtcaagcatggagaaaagacacaagggctaaagagccccagcctcatgcagggagtggccgactgaagctcagaggccaaaagatagcaccagccctccatggtggatcagccacgcagaggtgggcacacatgctctgtcatccaggaccactctgcatgacaaccatgcaaaggaaaatccttcctcccgtcccgcagttaatgaaagaacccacagtaaagatcatcatggatgaacagacagagctcatcatggatgaggccccaaggaactgagaaaaaccctccaaggctccaatttttaaagaaatcacttcaccatcagcactgtgataaatggcaacctggacccactgtgggcaaagctctaaggaagtgatgttacaccactcaccctctgcgccttcacacctagaaggttccttccacctagaatgccctgaccttctccattcctcccgaaaactactgcccatttgctatagactgagtgtttttgtcctccaaaatttgtatgctgaaacccaatcctcatgtgaggatattaggagatgggcctttgggaggtaattaggtcatgagggtggaaccctcagaaatgaaattagtgcccttataaaaggaaccccaggaaactccctcaccccatctaccatgtgaagttatagcaagaagatgccatctatgaactaggaaactggcccttatccaccacaaaatctaccagcaccttgatcttggccttctcagcctccagaagagtaagaaataaatttctgttgtttataagccacccagtttatggtctcctgttacagcagccagaacagcctaacacaccatacttcaatatcaagtgagggttaaactagatcagggagaacaaatagattttatcttgtgtgataactctaaactatcagtagtagctgtccacaagccatgttaagattctgaagcaaagatcagatagtgatggggagagcttgggaagcagggaacggtagagggtgggggtggggactggtagaattgaaggggaggaggaagatgaagagatgaacagagtgtggagggaggaggtgcgcaaatgccccatgcttgctacctccagattacatgattttaaataagtcacctaaacactgcacacctcggtttcttcacctgtgaaacggagataatctcaagctttctgagacacatccatgatatgatacattttcctttgaggcttcaagtacaatccttgacatatgctccatgcctgctctctccccttctcattttttacccgtcccttccttctaactggaaaaggtggaggagtctttaaaaaccggacgaaagtaaaaaaaaaaaataatgcaacatttaaaggatacatccaacagactgatcatttccctgcaagtgttgatgttgaatccatcgaattttatgtctgttcctaaagatttaaatagaaaaggggagtgggaatcggatcatttgaaggtgagggaaagaacctccacggtagaagacctccaaagataccatccaagggtgtggaaccgaacttggtctctgccaaaaggggagagcatcatggcaggcttgtgggcagatacgcctgagcctcctggtgccgtgggagatagaacagacaagcaccagcatccaagtacagcatctgaaccttggcttggctccccacaagccacagacttcagcaaattaatatctttgagctttaatttcctcctccatcaaatgggaataatcatgatagtaacaatgaccatacttgccccaaagactggctgggtattaactgagataatgaaagtgaagttttagcccaggcttgatatatgataagttcttaataaaacagctaactttatatggctaggtattgttataagcactgcacatctactcttcaaaatcactccgtgtggtagatgctatcattatacccactttatagatcaggaatctgagtcccagagaggttatatgatttgctcaaggtcacaaccagtagggggcaaagctaggagttaaatgcaggccagccagctccacagcctgagcttgtaatcacaacacacagccactcaatgacagcagctatccttccttactaaattgcaggcatgtcactggagctccatccctggcctccaccctcaccttccatatacctgggagccaagacaggtgccaaagaccctgcaaccccttctctttctctccactcttcaacaactgcaggagcaagagtggtgtggagaggagacgggcctgtgctccgagccctggggatccatctgctcagccctgggttcgtccctgggaagggtatgacttggctcctgggccaagcccctgcttcctgcattctcaagccctgtcctgctgcagtgagtgaatgagagcccatcactcactggaagacttaacctggcccatccctggacccggaaagaaaccagctccctgtgtcctcctgtgggctggggctcagaggggagatgcaaatctttcctcctgacagctctgaggcttgcaaaaatctgaagatggggaactgaggacagtctaggagagtcagaatcatcccttccttcctccttccctcaagatgagctacagaactagatctttcatctgcagaggtttccacagtatccaagttattaattttgtgaaaaaaattcacttaagtcaatcccagcccagctctttttctcctgggactcagcctgcaatttcacttgacactatggagctttgttccttcaggtgctggctgcttgccagcaccagccccgccttcacctccaccctcgcctccccgtcttctgcctctccttcttcccctcttgtcttgctggactgaatcagggctcctggggtcagacaccaatgccctttctcccacctgtggtgctgccagcccaatgcctgcctacccatccctcaccctgccccagcatctcctacggactttctgaaagaccccaagaaggaacttactcttggaaaacgcctcattcaaaagtatcttgagtgcattggcagtaatctcagaatcctagaaagaggaacccaaatgcaaatcatgtcaggccctgacaagttgtttcaagacagtaaattaatgcagtgcttcctcacagtcagacaccaggcccactggccctgtgaggtttatttgtttttgttttttgtttttttttgagacagtcttactctgtcactcaagctggagtgtagtgccgcaatctctgctcactgcaacctccatttcccaggctcaagcaattctcctgcctcagcctcctaagtagctgggactacagatgcgtgccaccacgcctggctaatttttgtatttttagtagagacggggtttcaccatgttggccaggatgatcttgaactcctgacatcatgatctgcccacctcagcctcccagagtgctaggattacaggcatgagccaccgtgcccggctggccctgtgattttaaaagcaggtggcatctttaaaaactcaaattatcctcttcttttggggatcccagcagcctggccagaggtgtgttagtgccatgagtgtggtacacaccgtggcagaaggctgccatgccagggtcctgctgcctttcacagggctcgcttgaacagggataaagtaacaggaacagcagtgataggattgaaccagatgtgccagagccagtgtggaagatccttaaatcctcagcacaattccacagccattttcaagttaaggaagtcgtgattttgtaaactgctgaacactgtatacatgcaacatcatttgtcattttcatgtgacgtaattgcttgtggtttgtagctaccaagaggcagagctagacttggaaacctaaggttggttcaccccaaagtgccggctttccccaccacacctacaggagttggtatttcacataggagcccatctcaaactgggggcagagattgagagaatagcatattctgtgtgcatctgggataaacactgagccagagggaagagtcatcccttaactctcagatggagagcagatctcaggcaggatgaccaaggaaatgcagagaaggggtgctgggctgatgtctgggtcccagtctcaactcagccccttattcatcatgtgactttagccgagtcactttccatcttcccatcctccgctagccaggccctggcaattctactggaaatgagagaggcaagagctgcacaaagcagtgtctcctctgaggacaactggcctcaccccagcacagagtggtcagtcccaataataagacctgaggacctgggccaggcacggtggctcacgcctgtaatcccagcactttgggaggctgatgtgggcggatcatctgaggtcaggagttcaagaccagcccagcgaacatggtgaaacccctactaaacctctactaaaaatacaaaaattagccaggcgtggtggcgggtgcctgtaatcccagctactcgggaggctgaggcaggagaatcgcttgaattcgggagttggaggttggagtgagccgagatctgccactgcactccagcccgggggacagagcaagactctgtctcaaaaaaaaaaaaaaaaaaaagaacttctaggaataaatctttttaaaaaaagatgtgcagagaactacaaaatattcctaagaaaaaattattgctttggagagtatcagtatgaacccacaattcttaatatataaacagaaggatgtaccacgcccatggattggaagacccaatacggtaaaaatgtcaggtcaccccgcatcagtcaaaagaatcaatgcaatcccaatcaaattccagcaggtgtgtgtgtgtgtgtgtgtgtgtgtgtgtgtgtgtgtgtgtgtgtgagatatttggcaatctacttctgaaaagcatatgaaaatgcaaaaaatagccaacgcaaggcaaatcataaggaactcaaacctgaaagagttagagaaaatatttagaaagattcagaaaaaatttttaaaaacatgtactgccatagggaaaaacagagagatcaagggtatagaacagagttcaattacaaacacatataatttacagactcctgatacacagcaaagggccccgcaggccagcggcggaaaagaccttctcagggagaacgtaggtccactggaaagtaaaacgggaacaagtgaattttgagccctggatcacagcacacacaaaaatccatgccagacgtactacagatctgaaagtctttaataacaaatcgtaagagagtccgaatcttgactattaggaaagaaaaataggaagagaaaaagaaaaaaggaagggaggaaggtcaggaagaaccccagagtgttgattgctttggagagtatcagtatgaacccacaattcttaaatatgtaaattcctagctctgactgctaaaaggctataaaaacaaaaatacttagtggcaatgaacaaatctagcaccaagatcctggtttctaaattccccactacaggagaaataactgattctagggctaggaaccagaaagtctaggatgcgcctggaatgttttgctgaaagcaagaaaatgctttaaaaaaaaaaaaaagtctacactgatagtaaataaatagtaacaataaatgaaggaataaaaccagtgagtgggggatataggggaagctctttcctgtaagactgctaactagtaaatatgggagttgtggagttagaaataatcataattgggggccaggcacagtggctcatgcctgtaaccccagcatttcggaaggcactggcgggccgatcacctgaggtcaggagtttaggatcagcctggccaacatgctgaaaccccatctctacaaaaaatacaaaaattagccgggcatggtggtgggtgcctgtaatcccaggtacttgggaggctgaggcaggagaatcacttgaacccaggaggcagaggttgcagtgagctgatatcacgccactgcactccagcctgggtgacagagcgagactccatctcaaaaacaaaacaaaaaccaatcctatttgcacccatcagagagcagtacctgattcaggcaggaatcatcaataaatactagaattaatggatggaaggctgaggacaggcaggatatttacacagcctcttctcacaaaggggagaacagtgaccacctggcagagaccacctgcaccaaaccatcaaaggaacatcaccaatattgagccaaagtggtgtcacgtgactcctgtgacgcactgagaaggttccgctgctatgaattgcagctgaaatgcacaacctgaccccagtcctgaggagaaacctgacaaacctaaagagagggacattctacaaaataatgaactgcgcttttcaaaggatcagtgtcaaaaaagatagaggctgagacactattctagaataaagagatgaaagagaagaaccacaaaatgcaatgtgtgattctggattaaataccacatcagggaaaaaaccactgttctaaagaacaatattgagacaactggaaaaaggtacagtctgtagttacatgaggatgatggattgagataacacttcttgaattttgcacagcgtactgtgattatataagagaatgtccttgtttgttaaaaaaaaaaaaaaagttcagccttttgatgtaaagggcataatatctgcaacttactttcaaatggtttagtgaaaaacctctacaagtaaaaagaatgacagagcagatgtggtaaattcctaccaattgtgaaggggatacagaagttctccgtacttatcttacaacttttctgcaagttgaaaatgatttcaaaacaatgtgtgttttttgtttttttacaaacatagaacatcatcatgatcctgagggaggaagaaatttctttaaataggatataaaaactgctattgtacaaaaagtttgataaacttcactataaaaaattatattaacaaaacggaaagttgcacagtgggagaagctacttacgtgtctgacaaaggatgccaattcacagtgtagaacgtgcaaagtggcaagaaaaggacagataactcactctgcgaagaagtggggcaaaatatttaaataggcacttcacaaaggaggatgtccaagtggctgataagcctatgagaatgtgcccaacgtcatgactcattattgaaattctacctaataccactgtgagagaatcaaggacggcaacttggagatgctcaacaatgtaacaattacaatgtccagcatctattaaaaaaaacaaacaagtgaaaaaccacagaaaggtcaccttaaggagaagaaaaatcagtaaacagaaacagaccaagaaatgacaaaatgctagcattagctgatacaggttattttatatatacatacacacacacataaatacatatatatacacacatacacatacatctatataaatacacacatatacatatacatatatatacacacgtatattagctgacaactggctattataaacatgatcagagcattataaaacaaaacaggaatgaggggagaaatggaaagtataaaaaagaacaaaacagaactttagaaaagaaagcccttgagcatgaagaaaccacagcagagattactcggctgaaagcctatagaagaaaaagtctaaataataatcagaacctcagtgacaaaaacatacatttagtttaacttctagagggtaaggggcagaagaatatttgaagaaacaataatttttaaaatcccaaatttgattttttaaaaaagtaaaaatgcacgtgttcagaaagctcaacaaatcctaagcagaataaatacaaagcaacacaaaggcatctaatagtcaaattactgcaaacatgagataaaagcagcctgagaagaagacacaataaacacagaagaacatagataaggatgactgtgatttcctgggcaatccagaagacaaagaatatgacacccttaaagtactgaaagcaaaaaagaaccgtcaacctagaattctatatgcagcaaaagcttccttgaaagatgaaggtgacaataaattacacaaggaaagctgatgccttttattttatgcaaggtttacctcacttaggcagatatttttatataaagttttttctttttttgagatggaagctcactcttgcccaggctggaatgcagtggtgtgatctcggctcattgcaacctctgcctcccgggttcaagcgattctcctgcctcagcctcccgagtagctggaactacaggcacacaccacacctggttaatttttgtattccattgtatggccataccacagtttgcatactcattactaattactcattagtaattatgaactaagctgccatgaacatgtgcatatgtgattttgtatgcacttaaattttcattttttttttttgagacagagtctagctctgtcactcaggctggagtacagtggtgcaatctcagctcattgcaacctctgcctcctaggttcaagcgattctcctgtctcagcctcccaagtagctgggattacaggcacccgccaccacatctggctaattttttgtatttttagtagagatggggtttcaccatgttggccaggctggtctcgatctcctgacctcaggtgatcctcccacctcggcttcccaaagtgctaggattacaggcatgaactactgtgcttggccaagttttcatttctattgggtcaattaacctaagagtaggttatatggttaaaaaaaaaatgaaaacttaagtgcatacaaaatccagtacacacgtttatggcagcttagttcataattattaaaatcctaatgtcctttaaccagtgaatgcgtacacaaattgtggtgtggccatacaatggaatactacttactcagcaacaaaaaagaatcaatgctaatacaacatgaatgaatctcaaaatgtattcagatccaagaggccacatactgtatacaacaccatctataagccaggaaacagattagcggtggccgggagtcaggggaagcggggggaaatgaccacaaaggggcaggatgagtttagagtgatgaaattgttctatatcttgattggggaggtgactacatgactatacgtatttttttaaacaccaggctgggcgtggtggctcatgcctataatcccagcaccttgggaggccaaggcaggtggattgcttgagcccaggcgttccagaccagcctgggcaatgtgctgaaatcctgtctctacaaaaaaaatccacaaaaattagctgggtgtggtggcatgtgcttgtagtctcagctactcaagaggctgagatgggaagatggcttgagcccgggaggcagagggtatagtgagttgagatcgtgccactgcattccagcctgggtgacagagtgagattatgtctcaaaaagtaataataatataaatttttttaaacttccaaattgtacatcaaagagtaaatgttataatatgtaaaatttaaaagttattaaaaatggaaaaagattactttatggtaaaaattacttcttcatatgctataagcctgatgttaagtgcaggacaacattagcacaaaggactggaggaggaacatgagaatataccattttaagggtcttaagttatgcacgaggggcatcgcacaattgaggaggtgggctgagggaagtgagagatgctaccgtgcggtctagagcaattgctaaacaactgaggcagaagcaggaatagctagtaagcaatcgtggagctaaaaacgatcatattcaacagagaaacatgcagggaaggagaaaaggtaaatgaacaaatagcaagatggtagacgtacacctaaagccactgaaagtaacagcaaatgtaaatggtctaaagattccaaataaaaggcagattgttagactgcataaaaatgcaaatcccaaccatatgccgtctctaaaaaatacactttaagacacaggtaagttaaaagcaataggacaaaaagagccaaaaccacacaaatactaaatataagaaagctgaagtgctatggtgatatcaaagtgacttcagagatggataaatgacatgaaagaccattaccatgactagaacaagatgaaagagaaaatcctaatagttctatgtctaaagtaatattggtaattaaagtcaattgtaattggtaagaatgctgctaattacagtaaattggtaattaaaagccttcccacaattaacaacagcaacaaaccccaggcccaagtggcttcgctggtaagacaagtttatcaaacacttcaacaacatcaagcttatatcaactcttcgaaaaaacaaaggagaagggaacataaagccagcataatgtggataccaaaaccagacaaagacattagaggaaaattacagatcaataaccttcatgaacataaatgcaaaattccttgagaaaatatcagcaagttgaatctagcaatatatgtaaacactgtaatacaaaatgaccaagtgaggtttctcccaggaatgcaagggtggttcaatactggaacactaactgatgcaatacaccatatgaacaaaactaagaacacccacaaaatcacttgcatagatagaaacttctacaaactggtcaaatgcagccatgcaaaaactacaagtgacatcacacgtaacaaagaaaggctgatatgttccccccgagagagagcatggcaaagagatgtttgctttcaccacttccactcaatctggagtggagatccagaaatacaaggtgtgcaaactgcagtaaaactgtctttattcacaaacaggatgatggcctatgtaggaaatgccaaggaatttacggaaagctattagaactaatcactaaaggtagcaaggttgtagaatacaaggtcaacatacaaagaaaccaactttattccagctgggcacaggggctcactcctgtaatcccagcactttgggaggctgaggcgggtggattacaaggtcaggggattgagaccatcctggctaacatggtgaaatcctgtctctactaaaaatacaaaaaattagccgggcgtggtggcgggcacctgtattcccagctactcgggaggctgaggcaggagaatggcgtgaacccaggaggcagaggttgcagtgagccaagatcacaccactgcactccagcctgggcgacagagcaagactccgtctcaaaaaaaaaaaatcaactttattcctatgtactgaaaataaacaattggaaaatgaaattataaacaatataattcacaaacacatcaaattaaaataaaataggagaacggagaaatacatgcaaaaaatatgtaacatcagcaattctactcctaggtatgtaggcaaacatgcaaaacacatgtctgtaaagacttgtacctaaatgctcacagccgcattattcaaaatagccaacaagcggaaacattccaaaagtccatccactactgaactgataaataaaatgtggcattatccacacaatggaatttgacttcacaagaaaaatggccaggcgcagtggctcacacctataatcccaacactttgggaagccaaggcaggtagatggcttgagcccaggagttcaagaccagcttgggcaacatggtgaaaccctgtctctacaaaaacgcaaaaaaattagccgggtgtggtggtgcacgcctgtagttccagctactctgggggctgaggctagaggactccttgagtctgggaggcagaggctgcaatgagtagagattgtgccattgcactccagcccaggcgacagagtgagagtgagaccctggaaagaaagaaagaaagaaaaggaaggaaaggaaggaaagaaaggaaggaaggaaaggaaaggaaagaaggaaagaaaaggaaggaaggaaggaaggaaaggaaggaaggaaggaaaggaaggaagcaaaggaaaggaaaggaaggaaggaaaggaaggaaggaaaggaaggaagcaagcaagcattcttggctgggcacagtggctcatgcctgtaatcccagcactttggaaggccaagacaggcagatcacttgaggtcaggagttcgagaccaggctggccaatgtggtgaaacctcgtctctactaaaaatacaaaaaatcagctgccatggtggcgggttcctgtaatcccagttactcaggaggctgaggcagaaactgcctgaacccaggaggcggaggctgcagtgagccgagatcgcaccactgcactccagcctgggtaagagtgagacatgatctgagaaaaaaaaaaaaagaaataaagaaaaaaatgaagcattgacctattcttcaacatgggtgattcctgatgccaaaagaaaaaagccagtcacagtatatcatacgattccattgaaccaaagtgcccagaataggaatctacacagagagtagactagtgcttgtctagggctgaagggaatacggggaaatagaaatatctgccaaatgccaaggggtttctttgggggatgacagaaatattccaaaattgattgtagtgatggccacacagctctgaatatacaaaaaaaacactggattattactttaaacagatgaacagtatggcgtgtgaattacgtctcaataaagctattacatctatgaatgacatccatatattaaaagctgggggaaattacagtggcaagaaattgagagatgtactttcttcatggattagaagcctcaatattgttaagaggtcagttcttctcaaactgatttacagaatcagtgcaacatcgatcaacattttagtaatcttttagttagagatcagcaaacagcaaaggactacgataatccttcaaaacaatttctttttttttgagacagagtctcactctgtggcccaggctggagtgcacgatcttggctcactataacctccacctcctgggttcaagggattctctcgcctcagcctcctcagcagctaggactacaggcgcatgccaccacactggctaatttttgtatttttagtagagatggggtttcaccatgttggcaaggctggtctcgagctcctgacctcaggtgatccacccatctcggcctcccaaagtgctgggattacaggtgtgagccaccttgtccagcccaaaacaattttcaataagaaaatgaagttgaagacctacacaacctgacttcaagaattaaagctacagtaatcctgacggggggtatctggcataagcacagacacacagatcaatggaaccgaacagaatccagaaataggcctgcaggtacgtattcgactgattcttgtcaaaggtgtgaagggaattcagtggagacctggtgctgcaatgactggacgtccacaggggaaggaaatgaaccttcccactacctgaccccttctgcaaaaacgagcccaacatgaaccatccactagaccatcagagcaaaactgttaagacttttgcaagaaaacacacacagactcacagacacacacacacagaaacacacacagacacacagacatacacacacagacacacacacagacacagagacacacacacagacacagacacacacagacacagagacaagagacacacacacagagacacacacacacacacacatagacacagtgttgccccatcctggataggcaggaattcacacacagacacatacagacacacacagagacaaacagacacacacacagacacatacagacacacacagagacacagagacaaacagacacacacagagacagacagacacacacagacacacagagacacacacatagacgcagacacacagacacagtgttgccccatcctggataggcaggaattcacacacagacacacacacacagaacacagaattttaggtagacaaggatttctcgaacaggctacaaaaagcactagccgtaaaatacaactttaataaattgatcttcatcaaaatttaaaacttctggtctttgagagtcaccattacaataatgaaaaggcaggtcagactaggagagaatgcccgcaatacccatatgtgaacttacttgcaaattatatagggaactcttaaaatctaatttttaaaaaatggacaaaagatctgaagaaatacgtcacaataaaagttataaagtacggcttattcaacctgtgaaacgtgctcagcgttactgaccatcagggaaatgcaaatagaaactacaatgggatgtcactgatattccacccacgaggaagggctgaaacgtcaaggctgacagagaaccccggctgccgtaaggccgtggggcgcctgctgctctcacgggctgctggtgggagtgcggcctcatgcagccccttggcctcatgcgttcaaccacatgacgaacagaaaccatgacacacggaaatatacaggatctaccgctgcacggtctcacgcacagggatcctatgagaagcaaaagggcagtaggaggcagcagggtggtggtcccgtggggccaggatgaggtagacgactctgtgcaaagaaccccagggtaacattgtacaggagggaactgttctgtatgttgattgcaacattgcacttgattgcacagtgaactcactgatggcacactttgtaaaggatacaaatacttttggtttttgttttttggttggggacagggtctcgctctgtcaccaggctggagtgcagtggcgcaatctcagctcactgcagcctctgcctccttgttcaagtgatcctcctgcctcagcctccagagtagctgggactacaagcgtgcatcaccacacccggctaatttttgtattttcagtagagaaggggtttcgccatgttggccagccagctctcaaattcctgaccttaagagatctgcccacctcagcctcccaaagtgctgggattacaggggtgagccaccacgcctggccaatacaaatactttagcaagcaaaaaaggcggggaggagagaacaatggcctagacgggccacaccacagatgcaccatatctacaggatgctgatgaaagcagacagatggtccagtgcggtgctcccacctgtaatcgcagctttttgggaggctgaggcgggaggatttcttgagcccaggaattcgaggccacctggacaatatagcgagaccctgtctctataaataattacaaaattagctgggcatagcggcacatgactgtggtctcggctcctcggaaggcctgagttgcaggggtattggcccttcaaagcagaaggaacccttcacccccgacccctgcagccaacggcactccccggtctggccatctctgcttggggcctcctcttgggccccaccctatccaggccagagatgaaggcaccctctgctccctgggtggtggtgggggggctctaacagtgcggacgcccccgtcccaggccacaaggcagcagagtggggacgatggtgcgatttgcatactcagcaaccccaagttcagcccctcttcttgcttctctctgggaaccccaaacaacagtcctgagttttgagctgctggtgggagcggcctcggacatacagccctgctccccgaccgggcaggtgtaccttccggatgggtaatggtggggggtgagtggctgcaacggagaccaccctagccagcagccctggccacctgggttctgtggcccagggccgggagcaccccacccaagcctgggtgttcagccgggggatggacggggccagtgctgaccttgcaggtcaccctgaaaagggtggggcccgcagcaggcctctcctgatgggcagagccaggacagatgtgctgctgtgtgccacgacccacacccagtggcatctgtccagggtccaggatgtgggcagctggtctgaggctggatgggagggtctcctggaccctgagcagttccaactttgcctgttttgcctgagttcagaccgccccacggaagtgggtacccagcttagggatgggtgcctgacccccatgccctgcagagaggcacacaggggacaccgggtggaccccagagaggtgggggtggagggagccagaagggaaggggaagcggacatgcacagggccacccactcacgggcccacaggccctgtggccagagctgtcccctgccaggaaagggttaccgtcacgggcccacaggccctgtggccagagctgttccctgctgggaaagggttatcgtcacgggcccacgggccctgtggccagagctgtcccctgctgggaaagggttaccgtggaaatgtgcagctggtgtcaatacccaggcgtggctttgtctctgccagccacacagagtgacatctgccagctgcaattaaacatctgcccgcccgaagccactgctgagggcatgaaagggatggccgggcgagccccatcaggcacaggagggggtgtgggcgcaggtccgggcagccccctccccttcagaggacaggagagaagccccagcatggcactaccccttccctctgcgagctccatttccctgtccctcgacctcagcggtctgccatgccacaggtgcccgtcctcagcttgggtgacaacggccacccccactcaatgaaataaccgtcagggccccgtgctgtcatctgccctggggtaaaagcagctgccatgaccgtctcggctgttgcagggacctgtggatccagatgtgccaaggagaccacgggaacagacccctgagcgcagctggggagcccccaccccaagcccagccccagctggcgctgcccacccggccggctgccttgccggggaagccccggctcccggtgtccctgctggacgttcagatgcccccgagccctgagccccagcgggaatgcagccgcaccctgggggaatgaaggcgggtacgcgaggaagagggcccgaagaggaaaggggctcccgctcagaccacagcaccaccaagtcccaaggcacaggctccctctgcccggcccacctcctgctctctggaggggctggcccctgactcacccccgtggtggggcgggaagggatgggggtgcaggggaggcggaggcaggcatttcgcaatctctagctcagatgcaaggcccctgacaacgccaggcagggacgcctgcgcctcaccctctgggaggtttccccatcagccagaggggaactgcactgggcgtttcccttccggtggatacgatgtttttctttcacccctgggtgcaccccacccccagctcatcttgctccggggtctcccgtggctgccggccacagggccaggaggaaggtccctgcctgccgcaggggtgatggcttaaggcccaggagggcgccctgaagtgactgctgcagagatgagggctggtgggtgggaagcactgagcgtcccgagccagcgtccacctgatggggaccgagacggggcctgcctcgctgggggtgggggggcttgaactcggccccatcaacctcacacacccatgcatggcgccttctcgcagctttgctcctgactgcaacaaactgaaaacaacctgaatgtcctttgataaggcactggagaaatcaaacgtggcggctccttctgacgggtggtgacgcaggacctggagggagggaggagaggcacgagacagacaccgcatggagacccttgccgtgaggccacacagaccatggggcgggggctgtgccggggacaaaaggcaattaactttatctgtaatattttgacttatttcaaaaacaggagaacagccctacaggacaaactgtccatggttcttaacgcgagagagggtggaacaggcacacgcattaccacacaccaaggtgcagctccgggaccctcggcaatcgctcaggcccgcctctcactcaacagatagggagactgaggccagggaggaggaggagctcagcctgcagggaccttagaacacgctagtcctaccagcccagagagacagctacctggctccactcctgcacggcctggcgagggcagcagccagcctcctgcgtgggtgtgaggacgttccccggacgagcccgggacacggagggcacggggagctagcacccaggggcagctccaggtcaggcgacggcccctccctctacctgctccccccatggcaccgccaacccagcacacccagcgacgccagcaacgtcacagccagtaacctagattttaaccaagaaatcacacaccccctttctctgccccacttatgggcttgccgaacagaaaaaccatgacaagaaacccagactgtggcatccagagccaaactgtatggtaggtgggcgggagcaggcctggcctcccagccgcccactttccacctcgctggcatcagcgacacccgtgcaaaggcagagaatgccgcgcagcacctgcggcctggacaaagccctgcaggaacatggccttgagggtgtccccacccctcagccccaatgggactgtacctcgtgtggtctgagtacgggggagttggagggaaggactcaccagagcagctgcctcccgtccccacccaacacacatccgggactccacagagccgcttcctggctgcggtcctgctggctccccaaaaacccatcaaggcaggtgggcgtgagggcttctagctcacgaagtccaggtgatgtgagggcttaaggctgacccagcacccaggggcagatgcatgggacaagtcacgaggcttcaccgtgctcccagcaaacccgacacccagccctggctcccatcaccccaaacacaccaaggcccaaggtcacattggagcagcagggggctgtgcagggaggaccctgggaagatgtttggatacgatgggtctgtttccatctccatggtgcagctccctgacccgtcggcaacccgtcggcagggccctgtctggctgccattgtcggcagggcactgtctggctgccatcaatgggggatgtcctcagggactgtaggggtgcccagcctgtctggggttctgccctgggactggagcccatggacagagctccttcccaacaggggccctgggtgggccttgggagccttccccagcagcctctggctggtcccctgccttccctggggtggctgtcagcaggggcagagggaaagcgcacatggggcggattccccggaggcctcagccagccgggtccacaagcactgacatcctgtacggcctctgtggtgagccggagcccggtgtgctctgccctcaggaagggccaattccgtagctagcaaagctcccagtctcaggaaaaatcaagccctaccccctaccactaaaagaaaacaaaagctgtgaagcccagatcgaggtggcctgtgagctggcattctgtgggattcatgcaaacacagcaatatacatttaaaccaagtgcggagttctcaggaagacaccacggagcccagagcacctgctggcaaggcagtggcttctcctgcaggcggagagggagccaggttggccaaagcagtggttaccctgctgtcccggctgtggtggcagacgctgcacagggacccagctggcctaggggtccaagctggtgggtggtcctggccccctctgcccccaaccagcactgcaggaggggaagggcaggggggcgtcccatcagggcacagggatatgcgtggtggggtggagagagtccctacactgcccctcggggtccaccacctgcccgtggctggcattatgcacccgtacccaggcccaggccgctgcacacaggccctgcatgcagaccagccaggtggccagcccagacacacagtcaggttgcagggacacccgatcctgggcaccaactgtgggactctgcccagcaaagcctgaacagtctccagaggctgtaaccaggaatctccaattagggcaccctgggtttgtggggcccaggacggggagcagccctccttgaaagaaaggaacggagaggagggggagcgactgctcactcggctcagcacaccgggcgcttcctggcccatccctggcgcggggcctggagaggtggtggcaaaggggctgggttcaggggactctctagacctggccgggtgaggcgcagactgaggttaaaggggaagtaggcgggtcctcccgtacaccgcgtggcgccaggcccttcacagacggggaacgtgaaccctggggcaggtccctgggccacgggacacctgcgtttcctcatctatccagtggagacaagacccttcctacaggctggcagagtctcctaggagttcttgtctcatccaggaccaagtctgaaccccatggtgaacagagctctgccacctcctccaggcttggtggggggctcccctgtggccccgcaggcctccggcccagtggcctcctgagccacccgggtcccaggcaggccccgcttcccagccaggtggtgtggggctccaccccgccgcgttacctgcatagctgccggaggccttgatgtacatctggccgtactgctcctccaccatggtgtcgtaggcctcgtcgtcctcctcgtcctcctcgttgtggtacgaggtggggctgtcggtggtgggcaggctgctggcgcctggactggtccgctccccctgggggtagggcatctgctggatgccggggatgagggtggccaggctgggcaccccgtagtaggagacacggggcagtttgagaggggctgtgcccgccgccaccgcagcccccgcggccaccgccacgccgtcccggggccccgtctccagcgggcgcttgggggccaggcctgggccggccggcggcagctccatggcttcatgctttactcgggtcagcagcgggatgggcaccgagggggacacgacgtagggggccgcggcggcggcggccggctgcagctggttgcaggggctctggggctcggagccggcgtcctcgatcacagcggtctgcgagtcgcagtggggcgagctcaccttgaacatgaggtcggtgccgcgctccacgatgtgctggatctgcaggaagccggccgtgtacatgaccacgagctgctcgctggccgtcatggtgagcctgcccgtgtagcagaaggacaggatctgctggaagcaggcgggcggcacggagccgggcagctcgaaggcgctcttgctgttgccgctgaacaggtcgcggaagtagaggctgctggcggccagcaccgcccggtgggccttgaaggcctggcccttgaccacgatggacacatcgcagtagaggcccagcaggcgctgctcgttcaggcagcccagcactgtgttcccgaagttggggatctcgatgtgcagcatctgagacatggcgggcgggcagcggcggggctgggctctcagcgcggggcggccctagcggggctcatctgtggggggcaggaggcacgtggtcagttcctccaggtcacgggctccccgctcaaggggccgttcccaccccctcctcccccgccgggggcttacaaagagcgagccttccgcacgcgccctcccccgcccctcctggctgggacactccagagaagggacacggggtctcccagaccccctggcatacgggcaagagggcccggccagcactgctgcagatccccggggtgctgcccggcaggagtgcgcccacgccactcccagggggctgctcttagcgactcggtctcagcaggcgaggaggagcgcaggcctgaacctgccccgggacaggaggtgggggccgccgggggagcctctgggcaaacctgcagccactctcctcccctcaaaaaagttccagcccgcacaggagctcccgggaggggccgcgctggagcagcggggaaggagggagggagggggatctctggagctgtgcagtttgcggtttgctttccctctcttccctccgagcagcctcgcagagggcccctgcggggaaggcgggccagcgtcccctagtccccctgagcctcccgggcaggtagggaatggctgggggtgccgggaagtccgctgaagccgcgtccactcctccctcgcgcagagagaccaccctgggcgcgcccgctccgttctcccgtgctctcctggctcggaccagacccaggttcccaagccgccgccagggcaggagttgggaagcctgtcgcagccccactcgcggacgccccccaccccgctcgcctcgctccccacgcgggccaatcccgacggcccggccccaacccaggtgactacaggggtcccagccctcgccgggctgcccggaccccggggctgggagctggggagggcgccgctgtttatctggtgcggactccggagggggcgggggcggcccagaaggcgccagcccaactccgcagggccgcacaaaggccgctgtgtcccacgggaggaaagtgcgggcggccgcagaggcgccgggtggcgggaggagggcggagccaccgcgccgggagctgggcaggtggacgcgcgccgggggcggcccgcagtgcccccgctgcggagaagttgccggccggtcgggaagacctaccttcagccgctgcggccgccggccggcactgcccgctccgcctggcaggacaggctccccgcacgcagcccgcctgcccagctgctccgcgaatgcagcaaacggagcgggagccctggggcggggagggcgcagggagccggcaaggaggaggaggaggaggaggaggaggaggaggaggaggaggaggagatggtggaggaggaggaggaggagggcagagcgcctgggcgctgggctcgcggccgcagctcagctgcacccaggccggccctcccgggcagcgcaccgcatctcaatgaaggggccggatgcagacgaacgttccggcggctcgggaatgaatagccgcctttgatttgggagccgaagtaaatgccagctcccagccccggctttaaaaacagtggagtgttggtgccagaggaatgcgcggccccgggtgctggtacgagacagacttttgatgactcactgcaatgcaaacaaagatggcagaaatactgtacagtagtggagaaatgcttcccggtgccacggcaactgagacagcctggaaatttatggtgcagttttgcatatgaattacccagtaaactgcctcccggccttccaggacagccccagtgtcaaagcatttaaactattccaaacagtctgcagagctggcagagctgaactcctccagcgagggtggggaatgggcagaggcgccagggggagggggtaagggggtcaggacagctaggggagccagggaaggggaggggaggtacagcagggggtgaagagaggcacagaaacggcaggcagtgggtgggcgaggcggcaccccaggtcctgggggccttagagctgtgtcctctgcccaggcggcaggcccgggagtccagccccagcacccctccccatcccactcccagcgccctcctggcactttaagaaaagagcgactttgtggccgggcaaccaggagccggaaggggcagccccgcctgagaggtcccagcagagggcaaagcggccgcctcgctcctcccgcacactcctggctgcggccacacaggctgcacctcctgcccaagggggtctgcagcgtctggctgttattgagccttttcctgggaaggggctgctgctgtgcaggacttgtggtggccccgggacccctccagagaatgtgtacttcatcctgggctcataccaccctctctgcgtggggccctgaggctgacctctggactgcccagcctcagtttccctgccactggctgtgacccccaggaagagcacattccacccaaaagaaggggcagggtccaggctcgaggccttgaggtgagccccctcctgcttggccagctgcctccaccaccctcggggtaaccctggcagcaggatgcggaggaggcccgaacaggcctggtgggaggcaaggcgacacagccctgcccctcactcccggcgcccctctgaggcatccggagaccagagagagggccatctggctcctccctagtcacacaccatgggctcagcttctccagaccagacaaaaagccactgaatggggacgggaagagatccaggtgcggggaagctgccggcaaaggcccgtggaggtggcttcgtgcctagtgttttctgcctcctacaaggggctggtgacaactcaaggagactgggatgggggcgtttacagaaacgtccccactcggccatgctgatgagctgggctccaccgggccaggagacacagggcccagctgtcaccctccccgccacaccctccaccctcaggtccccacttagtttctgcctcatccaggaagtctgccaagtgccctcataagctcggcaagggctgaatgctggacacaacccgggcaggggggtacaagagaggggcctgtgcaacacagcacagagggcagaggcccctagacagctcccttcacagacccactgcacccaccaccaggagcctcccagagagcccgtggcttctgttgtgggcaacttcgccccaaggacaggggggtagggatgtctgagtcatacaggggcttttgtaccaaaagaggggacaggcagaggccagcacggcgcaccggttcctgggggtcccaagtacctgggctgggtagggcagcagccagggctgacacagacagcaagggacaatgtaggctctcagcctgtcccttccagcagcaagagggtcctggcctgttggcaaggctgaaatcctaggtcccgtgggcaccagccacttcctgtaaggacacctcagcctcagacgctgagctgtgaactggggttatgatttaccctcagatggttcctgggggtgaatggaacaatgtttgtgaagccggcggctgaagcctcacacacagaaagccggtgatgcctgcaacctgctgtgacctgggcaggagagcagctctcagctgggcatccaggtgggcgtcttaacgcccagcccagttcggcctgcgtccgcacctcaggagctggagccccagggctgggggacagaccagctctcccagagaagggaccattattccctttgaaggtgatggggccgtgtggtccctggggatcgaggacaactggagcttttgctggcttgtcctcaggccacctgcaccggtgaggctgcagccccacgccccagcctgctgagagccggacaggagctggttttaggttgctttcttggaaggctcaagaacaaagctgaactttaggagaaaagaataaaataaaggcttggctcacgcccccagggccaggaaagcagacacacgggggctgaccctcctgctacacccagagaggagggggccgagggcccaggtgggcccagggacgtgagcagagctgtctgctcaggagggcaggggccaagcctggttctcagacatcagggcatccccaccctcccctgcacattctccagtgactcagtttccccaccactttgcttcccaagcaacacctcctattgtttccccttctcggtgagattcaacacactcattcacttatggaaagttctgcagagccaggcaaaaaatcagaggtcgccaactttgtttaccccagccatcctcagggttgtggcaccaacgacccttgctctcaaaacgcccttcagaacagaacccactttggagaacctctgcaggtgacccaaggcccgagtccactccctgcagctgtgccagccttcggtgccccaccccacacagacacacagaggaggctgggttcctctgagcccacaagccaccctcaggaataagaaaatacaggtggctgtggtgtcggagtggggggtctctcctctgcagagcctcacttgaggaaggctgagatccaggcctgccctgccctggggttaggggttgcccaccatgatgagccccatacccagcaacctgccgatgggtgagaggagcccgcggggaggacaggggctcactggaactgcagccagacgcgcacacaggggttggggcagcgtctccagaacgacccccctgcctgagtgtcgtcccggcaggattcacacaaggacacaggttacgaggttggtgccaggccagggcacctgggtcctggcatcaagtacccaggagcagaggctctggcaggtacaagacccctgaaagcatcccccaggccagaggactgggacagggaccagtcaggcagcccaacaggaggagcccttttcctggggcccagccaggcagctccatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcaagatgcctgtgacagaggccaggtgctgatacactgcaagggctgttaacttctgtgtgacccagagctgaaatgtccaccccagagtggacagtgttcattcttggtcatcagaccctctttggattacagatctgctaagcaaagaaggaagcaggccacctgcccccactaccctagtcaggactccacatagagccctcaggcagtccccactaacccggccactagggtgcccacagtccttgagattctccctaaaaatgcttacattctgggcaggagaatgctggtggtgtggccagagaggatgtgaccaaggcctacatgtcatgagttaaaggtcattcttgccatacctgatggtagcaaagggaggagacagggcactggtaggagaaagcactcaggagagttgaagtaaggaagctactctaatttgtcttgggttgggaagggggcaaactgagttccagcaagaatccaggggtggagcaggttagagaagtcctatttgggggccagagtgggaactggaggacactgaggcaagatctaggtaagactctgtcctactagggaccccaagtaagcaggtgccacaaggtccctggcccccacatctgcccttgacatagctcagctcaaagttacaggatggaggttgggcaggtttaactaagggtggttctcagtgtgggatcaggatcagcaggagcaccccagggtaacttgttagaatgcaaattctcaggccccaccctagactgaaagaatcaaaaactccaggagcagggcccaaaaatctgtgcttcaacacgccctctaggggattcagaagcacattctaagtttgacaactgttgtcctgaaggccccccggcactcgtagagcacaggatccagggtgacacattgagggcactgtgaggtgctgctggagaaagctccattgtgtgtgcacgtcacctctctctcatataaatggggcatttctgatgggaaccaccatcacccagacttaaatcagctttggttttaattattttccagtagtaatgaggtaggaggtaggactcaactcccagcaggacgctggaccaaatggagcactagctgaaacagggaagaggtgaaagcacctctccatgagacatacccaccagtgtgccctatcagtttactgttgccttggcaacatccagaagttactgcccctttccatggcaacaacctgacaacccagatgttaacattctttttctagaaatttctgcataatctgccccttaatttgcatataattaaaagttggtataaatatgagtgtggacctgcctgtcagctgctactgtgggctcactgactatgaggtagccctgctctgcaaggacctctgttgctgctctaccctgccacttcaataaaagttgctaacaccactgtctggtccttgaattttttcctgggtgaagccaagaaccctcccaggctaagccccaatttgagggctcacctgccctgcatcagtaagaggtatttgctctaaaccattcacttccttgtctgttccctctgtaatcaataacatgcactttgtgagccaagggcaggtggaccagtaatctgcagccttggatcaaggcatacactagagctgatgaattgagccttgctggcacatgcttcatggctagccaagcttgaaaacccagaagaactggggtaaagctgagcagggtggatgcacctatacataattagtgcaactgactccagctagaggaagcccagatagaacactggttctcaaccttggctgcccattggaatcaccttgttcagaccaccaggggcatggggaaaaaggtcaccactgttccttccatgagggcctgacagatgggacttgcaatggtcctcacccactctcagagctaccagcctactcatgtggtttgattcatgactggatcatgtgagagctgtggaacaaccagcttctaccacaggaaacagacgctgctggctgcccatcctgaaggcagccaagctatttctcaccaaaggaaggaatctctgtcagcactcacatacctccttgggaacctgtggggcagaagaaaagagcaggtcacctgagagctccaaggtcctccttctgctccttttcctctctccctatgtcttgcaaacagactgtgcagtcctggggcaactgaggagacatttgtgctaaagtgagaagccagtcagcatttctgaaactggaacactactgatgaatttcaaggccatctataaataggatcctagaaatctggtgggggaccaccagatttctaggttctactttcttattttctagttgtagaatctaccaagatctcaaattattcaggagtaatagccttggggtttcaatgagagctaatctcttcttcagacctacagacctggtgtccaagatcaagagtttgaccagagtgggggaatctcactcaacctgagccatagtttattctgcccttggctatggtgaaatggttcaagaacaggcacatgacccaagctgagcccatcagagacttacttctctgggatttctgaattggaactaacagaagggactcctttcttaatgctagtgatattagggaatgaagaaatctagactagcacaatgtcatcagcactagagaggagatgtggaaagaaagaatcctggtagtatccaagtcccttgtcccaagccttcatctccttcccttaatttggtttcatgagctggtacactattttcactagcctagctcgagttgggctttattatatgcaactggaagtgttgactcccataagagagtagctctcagatccagagtagaagctttcccatgcctggggttcctatgccaggctagagaagaggattcagaccccataatttgtccctttccattctttgtccctgacacataggcccttttgaccagaagaccatccattatttgtggtttaggtctatggtcaactgcctataactctgaaaaacaacaatattacagaaaatgtgtatcagctggcatgctcacttctggagcccccatgggtcattggcagcagaagtagaagagtccagggtcacagtcattcctctaattttgagtgtaaaaccaaaatcacccatgcagaggcctcacaagtatcttcctgtcagctcctggcctaatagcctttacacacccttggcaggggcttgcccaaccacatgggccgtctttccacaaacaacttgaccacctctgctgccatcagtatgctccagatccaccctaccaagaatcacccagcagaaactgagccaggcaggtggggcctcttggtggcacaaatccagagcagcgaggtaagggagcaggccttagccactgcccatgggtggatggaaagaaacagtcatctttcaaatgcaggatcctgactgcaaatgacaggctggcctggcatcactgcaggaagatagaggggagagagaggaggccagacaaggagggctctttagtctttggaggcacctggctgcttctcagtcagcagcaggttttcatcctcaatccaaactccagttaaagcaagagaagggagatacaggaatgagaatatggcacccactccctgcaaccccagctactccctataaccccagctacttctgataccctcttaacctgacttttaaactgttttcacttatggatgtcatgctctaaattatatgcctgtggccagatatagaaggaccacagatcacacacactggaatattttataagcagctataatttgatgactaaaaaactgatatgctttatatattatttatgagcgcaaatgtcatgccacacaaagctatttcagtccctttgaaagaatgctttgctggtctggttatataaggtaggcctggctgagtgcagtggctcacgcctttaatgcccgcactttgggaggccaaagcgggtggatcacctgaggtcaggaatttgagaccagcctggccaaaatgggtgaaaccccatctctactaaaaacacaaaaattagccagatgtggtggcacgcacctgtaatcccagctactcaagaggctgaggcaggagaattgcttgaacctgggagacggaggttgcagtgagccgagttcacagcactgcactccagcctgggcgacatagtgagagtccgtctcaaaaaaaaaaaaaaggtaggcctgatggatgaagaactgagtagcccaccctgcagccatgcccacctactattgactctccaaaaccatcacttaactttcaagctgccaagaaatgtccttttggctggaatgttctcccttgaaatcaagttcatctttcaaggttctcatcaaaatctcctcctcgatgaagctgaggtgaacccagcccattgtgtcaggtccccatcacagcagatctgacctgctctgttgccagtggagtgtgcatctcactttccacttcagattgtgagcaccttgagggcagtaactatgtgataatcctccatgtcctcagctttcagcacagcacccggcacataatagatgctcactacagtttgttgaattgatgcgcatacactaagtgcctactcaggtttttatctcttcaaacagagtctggctttgtgctacttacattctaggtggagatgaaagagccacactggagtagaattggagtttatttatttgcaattcctttctcctgccatcaattagcaattattttccaactcccattcttcaacataaaatatactcgcatgctcgtgcatgtgcacacatgcacatatacaccctaaactctaaagccctaaattccagaatatgagaaataaagtgtggggtgcagataggatctcgaccattgcactatttccttactggtttcttattacaatatttttttcatacattaatttatactgagatattgggcctccagacagctcttggtcttcctgattagaattgtatttttcccaagaaattcctttaataaaattgatttaaaaatggccaccatgagccccgctggaatttgctataaggagtctttgcctgtataaaaaagtggattccaatttgcttctggctagacttgtcaagacacaaaggtcttgctttaacatatctgtgaggctgttaagtctgtagaggggtggctgccaggaaaactggcatattagtcagggactgcagcgtgagcccagagacagctgtattccagagttcagagacaccagaactgaaaatgggcacgtggtttccatcaccccagctcatgccctgtgtgctccaagtgtctcaaggcctcccagggaatagttgtctttggctcccatatccagcctccttccctgactcagtgatgcccctcatcttccttgtgccacctcaagtgccttatgcccccatgttcttggctcttgtccctggggaagcctgtacttggaaaagagtctaatgaacacatgtacactgagccctcaatgacaggcaaaggttaatgtatcacacatctcaatgttaacagcagagacttaagccataggaatgaatctctaaatgtggaattcaggcctcagtaaggccactgggagaggtatatagaggagcaaggacgcttctcgattaggaatactccagcaataggaaagatgtgctacaatgactggccaagatattcagccccaaaacatcaagtgtataatgaaggacaaacccagcacagcagtacctggtagacggcatagccgatgctaagcatgccttgtcctatccgcttccgccacctgcgatttttctgcatcaggcccagcagcactgtacagcagggttcaccgatgctctcctcctggtcctcatccacttcatccaaacggattttgaactggggattggtccagtacgtggctggaagtcacccaggtgatggtggttccccacgtagcgggtgaggagatgaagaagaataaagtaaaagggaagaaacttgatcatcctaatgaatgcacagctccatccaaactgtgcctagtaagcaggcctcagaaagtgttctttacaaggtggtcaggcatttcctcctaccttcctacacatccacacacacagacatatggcatcgcatttggaaatgtgtgcttgtccatttgatcaacgaggagcccagaagtgcttgactgggaatattcaggatcccatgatccgagggctacactgggcagcactgcctccaagtcttcctggggaaagacttaacatcaccttgctctcagcacttgacatgtgaaggcaaacccaccttctggaggaagggagatctctgggtaaaaagcatgtccccaggacagtagaggagaaagtccctgaagagactagctaccaaaaaggtctctccgtgacactattaagacaactgctcttgccatctgattgacacctattctccctctgagagggccccagctgcagagcacagcctgcggcacccctgagaactaatctgctgtccatcaccccaggggcctcacaggatggcttcagtgttgcagcccactgatgagacacactttcttcaagagaaagtcatttaataatgcatgaggaatcacaattggcaattaagaagcagtcctgccacaccacgtatggatattgaaaaagactccttcatttcaaagatggctttttttaaatctctcagaatagtaagtacacaagccaaggcacggagagattaaaaggatcatccaaggatatgcagcaagtctatgacagagtccagtggcagagcaaaattgcagaaggcacgcctgacaggtgtctccactctagggcctcaacaatttcaataatgatgtgcccgggaggaaaaaagaagtggaagggcatgggatttttccttacatcctttaaagaagagtctaacttggaaaataacaaggcattcacaggtgaccaagagccattgattatcacttttctttacagtaggattacttattcaattccaccttctcagaatccccacttccactttttttttgggggggggggttgtttgttttgttttgttttgtttttttgttgctgtgttttgtttgtttgtttgttttagggctcaagtttatggattttaaagccggatatctgtggatcccataggagatggaaaaaaaaatctgtaatcgcctatacttccatcactaccaaagggcaggaactatccatgtcttcctgacagctagttggcagcatggatgggactgtgatttggtgcatccagataccttgtgcaccccctacagttctgagctcccaaaatgatccatgcaaatttcctccacattttctaagagcttgctaatggtgagcatattttaatttctcccaaatgcaacattactgcaatccatacattttttgtttactccttaacagtactggaggaagagaatgggccataaaaataatactcccatttatataatgctacacagtttacaaagtgcttccctacacactctgtgttccaaggcttgcagtgacccagtaaggttggaaggttgaaccccatctggaggactaggaaactgaagctcagaagagggaaatgcccttcccagagtctaaatcaagcaacaagggcaggatgtggacccctttccttcctctctgttcagcactctggtcacagctgcctgaaccgggagctttgggttggatgggtgatgaaagaagagagaacttgtcaagacccagcactgcatccaggtggggttttattctaatgctgcttccctagcaccgagcacagccctgcagtgagctctgtcatgagaagaaagtgactggccctgccccatgcgcttacagtctaagtcaatcaacagatcaacagcaaaccaggcagggaacatggggagcaggaggtgaaaagtagagagagcaggatttgcttttcttcatttctccttagagatgtggggctgtcttcctgagtttcttcatcaggtgctgcctcagctgattcaacctaggaggagcctacacagggacacattagtgatcttctgcgagccaggaaagcttcccaccttgcaccaggtgaggacccagggttagtgcggaggccatgctttgcaccatactatctccaccagggtctgagtccccatgacacgcatgccctgtgtgtggccatcacggcccacgctgtctttgcccctccacctccaactcaggcacaaacacacagtgaaacagcagctctattggatgcagcctattgaaacagcagatgttgtacccgtgttcccctagcgcaccatcagccactctgtcccagaggtcagcagggtgactgctagccagctgggtgtggggaggggagtggggaggaaggggcaaaagcccaagggaagaacaggaggccttagcataaggtgccaagagcagggctagtgtggaaagcacgtcctttgcgggcagggcaggtgggtgaagcagggatggtttgaacacatggttcaggctgcagctgagcggctgcagagccactgcccaccctcacaaccctggcctccaagccctagggagaagcagggcctccagagggtgcccagaagtcaaagaacaaagtccaaaggccttatccaaagattaacacatagggctgggcacggtggctcacaactgtaatcccagaactttgggaggccaaggtgggtggatcacttgagcctaggagctcgagaccagcctgggcaacatggtgagaccctgtctctacaaaaacattttttaaaaattagccaggcatggtggtgcatgcctgtggtcccagctactaagaaggctgaggtgagaggatcacttgagcccgggaggcggaggttgtgatgagcagagatcgtgccactacactccaacctggggaacagagcaaggccctgtctcaaaaaaacacacaaaatagcaccaaaaaattacataaaatgacccagctcagggaggataagctggaggaggttgggccaaggcagcccttcaccttacctgggtagttctggcagcccccagctgtggagccccgggtccagtggccgttgaacaggaccaggttccatttgtgcacctcctcgctactcagagagtccggggacaggttgcagatctccaaccgagagaactgcctcacgaaatctgaaagtgacatcctggggcagaggcaccagagggctctcagtgaagagggctgggttgtgattaaaggcacgcatactgagcacgggaaggagccctgtggcacaggccctagaggccgtgggctagcttgatctttcctacagcacactgatacaaacacgcagagacaacagtccacattcttcactagcgctagcttcttggctcttacagggagccccacacacatatcttaacaaccaagcaaaggatctgaactgtaaactgcaaaagaccccaggaggtcatctcaacaaagcctctgcctctagattgggttaagtctaagctcacaagaggtttctttttgtttaattcggagtgatgtccagctaagccgtaccatattcaaggagtatccttattatcttccttagctcactagcaaaggaagttctcccatattgatggtaggtaaatcttagcttaaagagatagaagcagtgctctcagttcattggaaagataatagaactgagaaagacaggctgatagctaagccaggttgagggcctagatatcatggtttcagtgctttagacgtgctggtatagaggtggaattataccaggacaaaaggagaagaatgaattcaccatgatcaggaaccatgtcgccttcctggaagacccagagacctagagttcacatcagaactgaaaatggacccatcaccaatgggacagcgcttcagcagaaaactctctcaccagaattctccatcctcaactttcttgtccagttcttccttccgccgggggtctatgtgattccactctggtgcactgaggggaaaacaagcagagatgctcgctcctgagaggttctacaagcagggcaagctgtttactgcagctaagcttccccctaagagccagaaacaaaataccaaaagcactgcaggcagacagaaaggcagaatggacagtgtggcgcgagcacactgtctggggaagggacacagacccaggacacggactccatgggcactagcacgatggccttggacatgtgccaggaacattatgactcaaacattatgctctaatttttactctctagggcaaatttgacatttctaattaagactcccaggcccctgtttgcaggaatggggaggcccaggagagaacgtggatgagttctcgtcactggaaaggcaggcactccagtacccattagtcacttatcactctggcttatccagcagtctagggtgaatatgctgacagagtctaaccagctctggggacatggacatggttcacttccttacacccacgagaatgatcatccagcccagttttacggcaatttcccagaagaaacgtcaccctgtgagacctcctgctggtggcctttcaagggcaatatctatgcactttgtttgaatgccatctccagcttcctgacctttacgaagttaggttttcctgaaatatgtatgtgacatctaagtaacagagcagtatcaagatccatctttaaaaaaaaaaaaatccctgcctgaataccttcagcaaaacctaagcaccttctctccccagcataagagctggggcacactccagcgcagcctcttcctccaagccaggctttaagaccccgggggtcagcacgacaattcccagagcctcttcaattcattgaaacattaatttgattaaaaccaaatctcagaatgtgcttgttataaacaaagattagggcaggagttggaaaattccagatctgacctactgctccaatttcttttttttactttttttttttttttttaagtaaaatctcactaatccctgggctgagcttagggatgttgccttagagattcggcaccctcctcctccaatagctgatatatataattatcccaggttgcatctccagctggtagggcctccaggacttgacagtcaccacctcccgcctgccagggagcgggtgctcagggaaaggagagaaagtcaaacaagccctttggacagctcggtagtgacttttggtaagaatggcccacattcagggtttcaatttcacgtggccctgtcatccttttagggaagttggcggaactgaggttttgggttttgctcaatcttacacagtagaatgaaaaatccttcctacaggaggctcatgtgtggccctagagacacgtgtttcttcgtgacacaacctgaagggagttactgcccctctgcgtggtcatgacatgagcagtcatgatgctgtgattaaacttggcgatgtccccttcgaaagccctggtggcatcacagagtaccgacagcacttgaggattaaggacgtattgggagggggcattattgtgaccattttcatttctggtggttctttgtccatgagactggctaattattttttttttttaaatggagtcttgctctgttgcccaagctggaatgcagtggcccaatctcggctcactgcaacctccaactcctgggttcaagcgatttccagctaatttttgtacttttagtagagacggggtttcaccatgttggtcaggctggtctcgaactcctgagctcaagtgatccacccgcctaggcctcccaaagtgttaggattacaggcctgagccactgtacccagctgagactggctaattctaattcctcccccacactaacctgcctctgccaggccagctgtgctcactggacagaaaccaccccatgctttccaccctcctgcatgatggggacatggattccagggcccagctgtcctgggacatcaccacctctgactgactttccctcatcagcagagaggcctgcccaagaggagtctctccagtcagtgatcaaacgtgcctagggtaggagcgagtgccgctgcctcattcatcactgctgccagggcccggggctcctagggtcaaatttcattttctcagcatccttgtttcttcttggtgctgaggggtttggcctttgtcagtgtccagtgtttgtggagtggaaagaaacagactgtgagtgatcgatttgacctttggaccagcacggtgcgtcaggtaaaaaacacaaaaacctttcagcgcaaagcaaaattccacagagccgccaaactttcaaatgccaaagcagaaagccagaatcgaagactacagcccagtggtttttattttgcttttcccagcctggatccatttaatactcttttctgaacacactgtgtgatctgcagacaggacgtgctgctgaactcactgtgacatcgatctcattgttgtgtgttttacacgacacccttccgcagagggagagatgactggagaagcgggggaaaaaaacctactcatcgctccaggctcccgaccactccacttcaccccatggattcctgagtctgatcagcttctctggatggccctggaaattcacctgcaaattccatacacagaaaagcgactgaattactatgctcctgttgccttgcaggcatgtctgcacctgacaggatctgcattaaatttttcaaatgtccctaaaggaccacacttttattttcctttaatgcatcttttcaggcttgggccaagtgttttcataatttgtttgaataaatgaggtatttttcataatttgtttgaataaatgaagagtgagtctagcccaaaaacaagcttatgtctgctttaactcagatttagattttatagttgactaagattgactgagcttttaatacatgagacctaatgataataaacgccctccaaacaaacaccaaagcacggcagttaacatttatcgagcaggtactacagatgaggtgtagtgctaagcattttaggtgctttattgcctcatttaacactcacgacaatcctgagaagataaagaattatcttcatttcatagctcaaaaatctgagacttaaagaagttacattatccgagattatctagttagtaagtggtgaacgcaggccaggaactcaggcagtccgtctccaaagcccatactcctaaatccacatatactgctttcccctatttattgaacactcaagcataagccccttgggcccctgcacacacactggcattcacatatacacacaccaactgtgtaggctgttaggtcctcattgtcttcatttcctgtgtatcccccaactcacctagcccaatgtttgcatgtacatgttcaattcccatttatgagattaacttcattaaagagcatatttgggccaggcgcagtggctcacgcctgtgatcccagcactttgggaggccgaggtgggcagatcatgaggtcaggagatcaagaccatcctagccaacatggtgaaaccccatctctactaaaaatacaaaaaaaataattagctgggcgtggtggcgcgtgcctgtaatcccagctactcgggaggctgaggcaggaaaatcacttgaaccagggagtcagaggttgcagtgagccgagatcgtgcccctgcactccagcctggtgatagagcaagactccacctgaaaaaaaaaaaaaagaaaaaagaaaagcatatttatgaaacacaaacacatgtaaagaacatctgtttcatttaactctatttatttatttatttttgagacagggcctctctctgccacctaggcaggagtgaagtggtgcaatcactgcaggctctcaagcgcctgcccgggctcaagcgatcctcccacctcagcctcccgagtagctggaactacaggcacaccctactatgcctggcctatttcagttaaataaataacaagaggtgggacattcattgcatttccctttctgccttggccattgggaagcccaaagcaaaattaatttctcaattatagcactgtcttcagcgtggattgatgtattttacttagttgtgtggttttatcatgtctgttcttttaatggtaaaccactagctgggtatggtggctcacacctgtaatttcagcactttgggaggccgaggcaggaggatggcttgaacccaggagttcaagaccagcctgggcaacacagacagactctgtctctacaaaaatttttaaaaaattaataattagccaggcatgatggcacttgcctgtagtcccagctacttgggaggctgaagcaggagggtcacttgagcccaggaggttgaggctgcagtgagccaagatcatgcaactgcagtcccacctgggcaatggagcaagaccctgtctctaaataaataaataaataaataaataaataaaatcattgtaagccaccttaaatcccttttgaaagaagacacaatgtaggaaataaaaataatgaataggccgggtgcggtggctcacacctgtaatcccagcactttgggaggtcgaggcgggcagatcatgaggtcaggaaatcgagaccatcctggctgacacagtgaaaccccgtctctactaaaaatacaaaaattagctgggcgtggtggcgggcgcctgtagtcccagctactcaggaggctgaggcaggagaatggcgtgaacccgagaggcggagcttgcagtgagccgagattgcatcactgcactccagcctgggcgacagagcgagactccgtctcaaaaaataaaaaataaaaataaaaaaaaataatgactagtatagcccatgttttttcctcgggttggagagtgaggaatacttacatgcctttccatgactctaccccaccctaaaagctgggactactgccccttttcctgttttgggattttgtgagttcccactgttttgcccacacaaacatattttttggaagatctgtagaatctaactgacaatctctacagctttcctggctgcatctaaggagagggcttgcatttagttagaacctattgagcaaaagctcagagaggttacgttgtccatcttcaagtgagtaagagtcagaagaaccttcttttattttttttgttttagaaaaaaaatttttaattttttcgtagcgatgaggtcttactatgttgcccaggaatggtcttgaactcctggcctcaagtaatcttcccacttcagcctcccaaagtgctgggattacaggtgtgagccaccacacctggccggaagagctgttctaatgagcaaaagctaatgctcatctgtggtgtcaggggttctgtacaggcagagtgcatcccaatatggcagtgaagctcaaaagccaattccgaaccttctagtagtaatcacctctttcctcctgtcgagatggcttggattcatggaaatattatcacacgttaccttccccaccttccacacaattttacctcttcgactccagtgacagagtacgcatgactcttaaccagcttctggctggtgatggcttcggcttcggctgcactggagacctgcgtagagaagaaagtccactcagtggctgaccctgacctctcaggggccggccgtagaatgctttccaaggacacactacacagccactgggggcttcagtgtgggactaggggtgtaggcatggctatgaacctcaggtaaagagtcatctccatccagactccctctttaattaggcctgtagttccgggccagtgcaggtgcctgccaagcctggaagacaatttaccagccttcaaaatgccaccaagaaactgggaagtcatttattctctgagagtgacccccagctgcctgaagaaggctaattctccatgctgatggctctggacaggtcccagtcctccaaggttctccctgagtggactcctcattacccttcccatttcctcagcaccccctctcccatgccccataccacccctccaccaaaaaccacatctcctgctggggtttgcagagagaggaaaaagggaggatcttctcactttgtcgttcacatttctaaaatcaccaggtaaggacaagagaggaagacagggcagccagagggcagctggtcacaggagcccgaggtggtgacaggacctcagggctgggggcctccagcctctgtttccacagccaccttggaaatccacacagctcagcctcctgtccagccacagcctctggtttcagaacttgtcttttcttcagggatctcaagatccatcaggtatcatcaatcatcacatttgttttccaaaacctcaagattatttagcaaaaaggaggtagcaaatggggggcctaggatccagggatcctagactatgttcttagggccactccagcagtactgaaggggctctaacaacgagagggaaattggggctcctgcaatgcaactaaccccagttcctacccactaattaggtcttcaccagcccctatatgttcaggcctttgtgtcactagacttgcccactaagctccagactctgctctgacccaaagccttcctaggcctctctcccgctgtctcatcccttccctaccacacaaggggtggcggtggggggaggtggggcagtagagaagccatatgcctcacatcaatggagcagcccagcagagaccccgcacagagggccttccggatgatctgatatagattggctggtggtttcttcaggtcataaaactcagagatgccacctgtgaaatcctcaaacccctccactgtggaacctccagcgagagcctcataacaaccattaagcctattggaaaagaaagaacacatgctccattagcaccctcagcaaggagacccggggattggggaccgggacagtgctaggacatactgtggcctggaagataaaggaaggctctttgcctattttgcctatgggccaggaaggtgcttaggccactgtttcatgtgcccagctcagcacttcactaggaactgacctcagccaacctctctccagccaccccctcctttacaaagccaagggcaacccctccagagttggccccagctgcctgggtttctgggggctgggggcacagatggggagaaggagaactttccctcaaggctgagaggcatctgctgaggcttgctgggaaatagaactggaaaggaactggggttgcagaaaagggtatcagtaaacaaaactaattaaaagaaccccaaagaaggttttgaacatcaaacgctggtgagaagaactcctgaggaaagagcagacactttgttgagtttggtatctagtacatttgttttattattcttcatcattcttttaaacgtttacattgccccaggaacctaccttgggatttgaaagaggaaaagctcaggcccagaggggcagggaggctggccccaccacatacacattcacccgaggcagagctgagatgctaaactccccgcccagatttctgtttctcttagttactgaaaaatgctctctctccggctcatgggggtctggatgctgggaaagacgccatgacgccctgagtttggggtggggaggcagacgtgggagggacaggtgagagctttcagggaggctctggcgtctcccagctcctggcttcccccacttacttggcataggctttctccagcagggcactccagaattcattgccttgttccgagtgtaggaagagcagctgtccattcttggtgggcagcctgtcgtcaatgaccacctccacccactctccgtactgccagaactggggaggggggacacagcggctgctcacatgaataagcagatgtgtaaagggagtccctccaggggacctcacgtggggactctgtgccatcagtgttcgagtcttggctccttaggagcaggacatgtgtctgccttatctgtgcacataggagatgccagatgaacccgggaacatctagtccagggtctgcgtttgtgcatcagagaacttgcccagcgccacctagtggcagcaggaagtgattcagacccacacctcctgaccctcagtccacagggctttcctgaaggccacgtggcctaggggagctgggaagaggatggatgtgtggatatctggatggatgcattaaagcagaggttctcagactgaagtgtgcatcagagtcacctagagggattattaagacataggtcactgtgccccaaacccagaatttctgacgcagtggacctgcagtgagccctaagaatacggaaaacagcaacaaagggccagagcagagcacagtacctgaaagtgaaagattcccgcatagttctcctggaagtcctggtccctggggaccacccggtaaagcagctcttcattcagggtcagggaggcaatggcagccagaagccagcagtcacctgcacagtgtcacaggggacacagattggtcaggcccagcctgcaggggccctgctttctctgaccctgtcccattcaacccagagtccacgttgccacattcccttctgagtcaggtagagtttcctcctccggtgctggaaatgcacccgcagccatcagcttcttctgcctccttgggatttgtttactcgggagtggatcctctgctcctccctgtggctgccccctcccccacatgctgatcatttccccactcctacacattcagccagtggagtggaaaagaaaagaagaggagaggagagaaaagaaaagaaaattagtccctttggtcccttattagcagctctgattaagttggttgagggaaacattgaagctgttaatccaatctatgatgtgtacgtgtaagagtgtgtgtgtgtgtgtgtgtgtgtgtgtgtgtgtttatgttccttgcccctcctgaccttggataatgaagagctggctctgcgtggtctgtttacagtattgccttttcttgtttcagagttcaccaggagagccttgatgccttattgcttaaagttcccttgagatactgcttagcattaaatcatcataatttgaggcagaagaaataaaagtcaagagaggttacaaatcctgggttttggtgttcgtcacattggagattcaaggaaatgcagaagaaaacagaaaacccctttctgtgcaagttgggacccaccacactgatgccactgagtggcacttccctgggaggcatcgttgtcccttgcagtgtcaacttcaaaagaagtagcacgggccccaggcaccactgcctaccttagcatcctatggcgaatctatcatcctagaagtgacgtaactttgctcacctctacttatttgcttattccacaccagctgctgaggtctcagtgtcctcaagcgtgctttacatcatgtgaaggctattgcatctttctggcctggtactgcttctttccaccttcattgtagatctctagctctaggagtctaagatttggtgaacaagtccctgtttctcctattcattccattcaaacagctccaaagtcctacctgtgcatcttagcctttatcttttccatatcaaagatctgaatcttttcaatgtgtgttcagatggaaggcccttcaaccttttagagaccatctgtggaccttgtctcactctaagttttcttttaacactgtggccagagctatatacatattctaggtgtgaacacattatggttttctcagaaaacctgttgcctgagcaagcagtaagccaggaacccacatctgaggagccaacatctccatcatcactcagaattgctccatcaccaggtcatcctagaaagccctggcctctgtctgcctggatctttcccaacaaagtcattcatgatctgaccccaaattaattaattcctctctctctctctccctctctttttgtctgtctgtctctctctctctcccgctcactcgctctctctctctgtctcacacacacacatactcatttactttctttttcttttaagagacagggtcttgctctgttgcccaggctggagtacagtagcgccatcatggctcactgcagccccaacctcctagtctcaagcaattctcccacctcagcctcctgagtcactagaactacaggtgcatgccatcatgcctggttaattttttttttttcatagagacaggatcctactatgttgcccaggctggttttgaattcctggactcaagtgatcctcccatcttagcctcccaaagtgctgggattacaggtgtaagccaccatgcctggccatattactttttgaagagcttttctgatccaggaggcaacctgcttcctgcctcactctctcaccaggctctgtttcacagacaaacactatcttcctaatggcaacagggctcctaggtgagactagacctggtagtcgagggaaacagagttgatgtggatgggctggcatgagttatgttacttctcaccaaagaagcctcaagcagggcagtctctcattaaaaggcaacttccaaaggttgagcaaaataacacagtgtcctcctcccacccagctcctctcagcccatttttcttctatgaacacctgtgatcatgtcacacccctgctcgcaactgtcctccattgctcaccaatgaaatacaacctaacagggcatcaacacccttcacaatatgactccaacctacttctccagtctttttcctattacactctccgctatgaatctaatctcccaatcgaacttggatatgtacaaaacataccctggtcgttttcattgatgtgatttttcttgtttgttccctctgcttgcaaacttcttgatgaatcttaccccttctccatgaagctttctctgataccgcctaccctccagccagaagtcaccgcttttttggtatgtgtcctaaagaccttatttacgcttctcttgcagagttatcacaagctgcctcagatcatgatttgcacccagactggcctcaaaactccattcatgcatcaactccttggcagagctttccttacccctatccctggcctgtcttaccagcaccaagcccttcctcctcacacctccccagcaagttctaaggccacttgattacatctgtttttctctctccctcatccctctctgacctcttcttgcaaagcagcaatgtggattcactcatctcggcatccccagcaggtggctgacacacagaagcagctcaacggatgtttgatgaataaaaacaaataagcagatgactacatgaatcaatgaatcatattttgttcttctgcaaatctccaacagcatcttacatatatttgcacctcagcctcccaagtctgtggggaagtggcattcaacaagaatctgcatcaaacctgacagatttcactttcaccagcatcaggcagagggagataaacaaggtagggcaagcacagaagcccagtcctctggggagtgaagggggagactgctctgcaacacctctaaagctagtggcttctcaaagagatcagagcagccacatagccctcattactgggcatggtcctggttgccttccgatgtgaaggttctggctcccggtctaagcttcttccgacagcccacccagagcactccctagatattacaattcaagtcacggcaacaaaatgtccctccgttgctgacatcaaatgaggtggcccagctggaggagagtttaattttctcttcatctacctcactcctgacatttcacagggtctacccagctcttgcaagcaagcacagaggctcgaagggatgctgtgggtttggaggcttttggatccttgccagtcactgcatgaagtgtgaatggattgtcatgacgagaatgcgttttcaaaggaatatatccaaatgtgcttcccttcagagtcctctggaagatggacatttactctgctgttcacatttagaaacttgtttggggaactgccagcaaaaaaacagctttgatcttggagcataggttttgttttgttttgttttgttttgagacaaggtctcgctctgttgcccagatgagtgcagtagtgcaaccatggctcactgcagccttgacctcctgggctcaagcagtcctcccacctcagcctcccaaattgctgggactacagtcatgtgccaccatgccgagctattttttttaaatacagagctggggtctcactatgttgcccatgctgatcctgaactcctggcctcaagcaatcctcccaccttggcctctctaagtgctgggattataagcatgagctaccacacctgactaattttcaattttttaattttcaaaagcagtcaggaggctttgacatactagttaggtggtgaataaggcagacaaaaacactgggaaataccttgatagacaagtccctcctggccaccttcgagctagggctgctcaggagttagtgctcactcatgcgctttaagcagaggtgcacttcatgggaatttagggaaggtttccatgtcctgatgaagtggggcagacttggctggcagagacttttttgcccattgcccttcctccttcttcccatctggaaagtccacactgtgcttggaggtgcagagccagcttgcaatcccaaggctgcaggtgcaagatgaaggtcagcataggagagtgcagagcagagcacagtgtgagtctagctctccaagggcattattaaagttacactagccctgggctgtctgcctctagttttcttattataaaagaagaacttgccccctatttatgcttcttgtagcccaaggtttttctaactgatattagaagcatgactacagagtgatttggtatgccccataaattggctctgaaaaaagaattccacaaaaggaattccaaaataaagttgggaatagcctttcaaatacacacattgcactgggttgaatctattctagggagactggaagacctggatggtaatgcctgtgtctggtcccaaaacggagactataacaaatgctctcttaaaaaaaaaaaaaagaaatgtatttgagaggccaaggcaggtggatcacttgaggtcaggagttcaagaccagcctggtcaacatggtgaaaccctgtctctaccaaaaatgcaaaaattagccaggcgtggtggcaggcacctgtagtaccagctactcaggaggctgaggcaagagaatcacttgagcccaggaggcagaggttgcagtgagccaagatcacaccactgcactccagcctggacggcagagcaaggcgccgcctcaaaaagaaaaaaaataaaataaaatccaccaggagataataatcctgaatcagacattgttaaaaaagaatcccttaattcaaaaattccctttacacattaaaatcaaagcttaaaggtcgggatgtctaatgttattataaactgtaggtagcaagaactcgagctatagcttaatggaatttctcaaacaccaagggaagaaatggagatacttctggactgcaggtagaaagaaagaggaaggaaagaagaaaggtcagacatcagaaaccctacagtagcccctacattaccttgaggttgaacaatggctgaagtggaaacaagagtaaagcctcaggtagtttgaagcagaagccaaagcagggaacatgtatgccctgctgcccattcaggaatccagaagcagagtaaagatggcatcatggagcacttacacagaagatgagagacaacggaagtgcccccaagtctccctcgggtattatgtaagattgagctgagggcagggaggaaaaagtcagctcaatcctattgcagaggttgtggggtggacctctgggtcaggcactgaacggaggctgtgatgtgtcatgtctgcagcagtaaggagcactcaggtggggctgagtcagccaggaaaggtccactggaccctgaggaaatcagaagagaccccacaacatgccagtcacatctccaggaggccagcaaggacccataagtcagcactagggtacgtaaggactagcgggcttctctcattggtgggaggacattgtttggccttccttatacccacgtgccatcctaggatggtgggggaggaaccagactttacaaagtgagaaaccacctgttttagtccattcgtgctgctataacaaaataccatacacttgatgccttagaaacaacaacacaagtctagaggctgggaagtccaagatcaaagcaccagcagagttgatatgtggcaagagcccacttccttgttcataaatggctgtcttccagttgtgtcctcaaacggcagaaggggtgagggagctctctagggcgtcttttataaaggcactaatcccattgatgagggctttgttctcatgacctaatcacctcccaaaggccctacctcctaataccatcatattggatgttaggattgcaagatatgaatggcgggagcggggacagatacaaacattcagtgtatagcaccactcaaatagagtaattgaaagcaatatttatccaagagaggtaagaacttgaaacagacagaggcataatacctttaatcggctagtttatgtttccctcccactcatggtccatggaaactggggctcctcagcaagctgagaatagttgagcaaaataatgaatgctgtgctgattgcacatctgagtataatgtaaagattttgaccctgctaatatatgcttgttttttaaaaatctgtcttcaatattttatcacagctgaggcatccttagcctactcttccacagaaggctgctctaaatgtttttatacacagggagctatttcagctctgtacattaccacgaagcagtcacagagcctcccttcccccacttggtgaacacgccttttgaagcccttggcgtttgattcatgccattttgactaccttaaaacacacacacacaaacacacacatacacacactgattttttttttaaccactccttgcagagcagggctaattcatagtcagtgtgcccagaatcgacccacacattgacttttgactctatttgctttgttgacaattcccatctctctggctagacttggaagctgcctggaggcagacagtgggcctggtggttctcacagaccccagcataaaattcttactgactgaattcacctcagtgtaattgtatcaaaggttatttgaaaattcagaccttgagtagtctatcactagtaaagctaaaattcttactgactgaattcacctcagtgtaattgtatcaaaggttatttgaaaactcagaccttgagtagtcaatcactagtaaagctaaaattcttactgactgaattcacctcagtgtaattgtatcaaaggttatttgaaaactcagaccttgagtagtcaatcactagtaaagctaaaattcttactgactgaattcacctcagtgtaattgtatcaaaggttatttgaaaactcagaccttgagtagtctatcactagtaaagctaaaattcttactgactgaattcacctcagtgtaattgtatcaaaggttatttgaaaactcagaccttgagtagtcaatcactagtaaagctaaaattcttactgactgaattcacctcagtgtaattgtatcaaaggttatttgaaaactcagaccttgagtagtctatcactagtaaagctaaaattcttactgactgaattcacctcagtgtaattgtatcaaaggttatttgaaaactcagaccttgagtagtcaatcactagtaaagctaaaattcttactgactgaattcacctcagtgtaattgcatcaaaggttatttgaaaactcagaccttgagtagtcaatcactagtaaagctaaaattcttactgactgaattcacctcagtgtaattgtatcaaaggttatttgaaaactcagaccttgagtagtcaatcactagtaaagctaaaattcttactgactgaattcacctcagtgtaattgtatcaaaggttatttgaaaactcagaccttgagtagtcaatcactagtaaagctaaaattcttactgactgaattcacctcagtgtaattgtatcaaaggttatttgaaaactcagaccttgagtagtcaatcactagtaaagctaaaattcttactgactgaattcacctcagtgtaattgtatcaaaggttatttgaaaactcagaccttgagtagtcaatcactagtaaagctaaaattcttactgactgaattcacctcagtgtaattgtatcaaaggttatttgaaaactcagaccttgagtagtcaatcactagtaaagctaaaattcttactgactgaattcacctcagtgtaattgtatcaaaggttatttgaaaactcagaccttgagtagtcgatcactagtaaagctaaaattcttactgactgaattcacctcagtgtaattgtatcaaaggttatttgaaaactcagaccttgagtagtctatcactagtaaagctttctgggacccgctttctgtttcccccctttttctcccacttctgccttctctggctaaaatcaaattttggcattcaaaggaaggctctgacttgcttctcaagtttgttccccatgcctcaagtagagcctcatctccccgaccttctgacactcacctctctgaagacttcgcgtatatcatggttagactcaggtctacctggatttgagagactgactttttgacctcccacaagccatataattataccattcttcattccctccaaatgatacagatgccaacccactgtgaccagaggtaatctagacttttctgaacctggcagacagcagcttgactgggtctccagtgcccccatcctgcagccctagcactatctgtagccacactccacctctgccctttcccccagcctagccctggagcacagatgcctaccagccctggtaacgcctggctccagctctgccatgacttcttagcatcctcagtactcctgtttgctcctgtcacctgctcccctgattcccatcaccatccagcagcagcacctgggcaggctgaccaggtggcacatgggactggggagtgaatgagtcagccaggttcctactcctgagcaccctagcaggatcctctgtttaagttcccgtcctcttagaatcacttagtaaatctcccccatcttgcaccagcctccaaccctcctggagttcctctcccttccggcttaaggggtagctcctgtatgccatcatcactcaccagcacttgccaagcatcaccatgtgcggggccatctgcaggacactgggacaagagagacctaaagatcaccatctctgcccttgagaaggctacaaacttagtagagtagaaatagcacaggttttgaactcagaaatcctgtgttcaaagccctggacccttacttgcctgctgagtgtctggcagcaatcacttgactcctaggattctcagttttctaatctgtaaaatgagtttggacctcacagtttattgtgcaagatcatctgatactgagcaaaaaggacttacttgtaacaagcgaaatgtttagggatatctgtatatatctccagttggccttctgtatccatgggtaccatatccatgggttcaaccaactgcaggttgaaaatatttgaaaaaaatggatggctttgtctgtactgaacatgtacagacttttttcttatcatgattccctgaatgataccatataacaactatttacataacatttacactgtattaagtattataagtaatccagaggtgatttaaagtatatgggaggatatgcatgggctatctgcaaatactacatcattcatatcagggacttgagcatctgtggattttggtattcctggggatcctggaaccagtaccccacagataccgagggaagactgtatggggtgtgtgtgtgtgtgtgtatgtggtctccagttggctagagaggacatcaggatataaaagatatcaaagatacacatgactgtatatgtaacagcaggtatgatatttttagagtgcctctggagtatcttgtttaatgttcccccgtgggtaagccagcttctctctccccgcctgagtataatctctcccaataagcaactgcttctttgctgataaggaacaattccctggcctttccatattcaggacaaaagaggaccttcagtgcctccgggaatcgtaggcaggggcttctgctgacaccccaggctctgtggtccctactctccctcaaacaaacaacatagaaccgaaggaaataatgtcaggcagaagcccacacacacagttagaacatgagtccctatgctggggccctgctctgtcctaatccattcaccccgttaccacctgcctgcgctgagtcagatttaaagcactcgttctctgcaccttctttgaacctacaaatgtacctcagcctaatggaccttgcacatctggaagttgcccacaataaatcctgctaatgtagaattaaagtaggttaatctggccaggtgaggtggctcatgcctgtaatcccaacactttgggaggccaaggtgggtggatcacctgaggtcaggagtttgagaccagcctggccaacatggtggaaccctgtctctattaaaaatacaaaaattagctggacgtggtggcccacacctgtaatctcagctactcgggaggctgaggcaggagaattgcttgaacctgggaggcagaggttgcagtgagccgagatagtgcccctgcactccaacctggttcacagagcaagattccatctcaaaaaataaaaaaataaaataaaataaagtagattaacaagatggcttttggacagggtaagttcctagaaaatgcagatgagaaaaaaatgtactataggctcagcccttcaccctccaagagttgaaatcacataagccacaccctcatcagtgtattgcacaaggagagtgccttctgttacaatcattttaatcgggaagccatcaggctggggaagctacaccactgtaagtttttacctaagcaagccaaagcccaatgcaaacagtaaaatgaaactagaaactttactgatcagaaaccacaaactaacctctaaaaccagtctttccactgtaatcaatcaaatgtgttgtatttgtcttacttccatattcagcctctaaaagcccacgctgctgcagtggagctctctgaacctcttctggttttgagggctgcccaaatcatgaatccttctttgctcaaataaactttgtcacatttattttgtctaaagtttttcctttaacatttcctgtatttgaatctgcctgtgctttgcacaagacaaagtggctatttaatgcccatttgccagacaagtaaagctgaggccctgagttcaagtgaccccccaaggccaggcagtgtcagagccaggactagttctagcaagatgatgagttttctgccttcctaaatcttgcagtgccatgtggaagctgaagtaaatacattcacatcatttgaaatacatgccttagatctctgtacaaaggtagcaagaaatttcgggaagagtccctcctcctgtcaacctacacatagcttctcatcagccccttttcatcctcactttccaattgccacaaaccaccctctctccccaccccttgctagcattttttcaccctctgacctacctcataagatagcatctccttacattgcaataacataaaacagcctgacttcttaagagttcttataaagataaaaatgagataagatacgcaaggtgcctagcttagggcctgccacatagaaagccctcaataaacctccttattattcactgttatcccccaacatacaattaacccaaacaccagggaacccaaacaagtgaatcaacaaatgtttattgagcgtctactgcctataggaaaacaaaaactgaaatgataccaggaagttgctggtgtccttccctatccacccctctgtttggtataggactcaggactgctatctcactcccaccacctgccttcttgtccaggtttcccatctcaggcatcagagccactagtttgtcagttgctgaagcccagaagccattctgattccttttcctcactccattcatatcgaattgcttcccaagtgcttttgattttattcctaaatagctctcaaatcccatcctcctccctaacattgctgccatcgcctccactcccagtaagactataaaggaccctctttctccaaatagtcatcatccaggagcagtaattaggaggttgcaaaaagaagcaaaattgtcatgatgtggaaatattcatgagttttcacccaaccatccctccccacctaacactagaaacattaaaactaccaaccatgccaacctcacatgcagatacaatgcaaggtggttgcaaagtaacactgaacattttgctcaattcgatggatttcatgaagttgatgaaagtaatactggagatctgcttcagtaccactgaccaagaagaagttggcagagctaaagcatttgcagctgaggaaggaaaactgctgaggttcaaggcaggactggtccttgaaaagggaatggtttgagcgtcaaagtattgaaggacggccttggagaaactaatgaactctttgaaagttttcatgattcttcctcaaaactcaagcaggaagcaaaaagtgttgcttcctgctgtcttgtcatcttttcagcatgagttctccctcaaaaagtcaacaactgattcattccttgttcaaagagctagcgcaaaactgcaactattacataagtatcatgaaatacaaagtcacatgaaaactttttcataattttttgtattatctttcaaagtaagatactgatcaagcctttttttaaaaaaaaaaaaactgtttactaagaaatgtggacctccattttactttcagtggtccctttccaataccagttatctgcaaataatgagggtttcctatcttgcaattgtctcttcctggtgtctgcactctccacactgcagcaaatctggctataagcagccctgctttaaaatcttacatgattccccattgcccttaggaataaagtccagaattcttcacacagtgccagagccctgcgtgatctggccactgcctccctctccactctcagcctttgcactaactgttccctgtttgcaccagtcctaccactactttgcaagtccccgccccagtgctatgcacttcctagccaaaggacctttattcatctccttcctgcagcctggaaccctcttccccgccttctttcccacaagaggaaggagtgcctatttgttctccgctgtttcctggcatgaagaagacatttgataaatatttaaatgagtaaataggctgtgaaagttcttcctgattctgacaaatgagtatgtcagataagccacgtgttccctcactcctgtaagcatccacaaccaacggtacttcaatccaccaccattcaacaccgtgggcccacctcctactgtacttgtaaattaagaacctggcacaccttactagaacatcgtcctccttttagagtggatgatggcaagctaccagtgttctagaagcaagattatagagaacatcaatccagggcatgacagatacccagaaaactcaaaaggccccaggtactgtgttctcagcagacggtggggtattggggtcacccaagaaagaaagtcactaagagtttcaaagattagccccaagtctggtatttttctgaaacaaagagtttcgaagattagccccaagcactggtgtttttctgaacaatggtaacgtgactcatttatggcaactataatttttatagcctcaaaataacactttggagtcatgctacatataataaggcacactaatccacttctgctgccccccataggtttcccggcacctccactcctggttcccatgacgacccagaaggggcctctcagacctgatagcagcgtagaggcagctcctcagggaggggcagctatcacacatcactacatttggcatttggccgaggactattctgggccaggggggtcttcggcttccaggagctacagagcaccccagagagttaatgtacttcaaaacagaggaaagaacaggaaaggctgacgggtcatctttgaatcagaagccatttttgccttaccttctaagttttcagtggagaggaaaaggaaaaagaaaaagaaaaaaaagcaagcaaactcttcacagctgaagaaacttgttcagattatttcagagttcctcctagttgcttctgaagcccaccaggccaattctcatccatctcgtttctgtgattgtggaaggaataagactcaatggcatgaaacagcttcaggactttctgcctcacctccagctttaaatcagacctttaatgctacttagagggaaacatttttcttagtaaattataaaagtggaattgattcaccagagggagaaaaacccactgagtaaatatatttgaggcttatgtaaacacatctcagagcgtgtttcaagggaaagcggcttgcttactgagtttaattataatgctctttggtttcaaaaataagacaaaaatgctagaagccaggtgtaatggggaaagaaatgaaaagatgagcactgagatgcaattgttagctccagccatggctgaaatacacgggatgagatacaaaaatggcacatcaccgttattgctagggacagccctgacacactgtcaagtgtcccctccgaaaatgatcctaaatggcccggcagttccaactccgggctaggtatcctgaggtttccaaatatacatagatctttaaagtgcatcaaatattcaacagaggataatggcatctcctagcaagatgagggtggtcttccaggctcaaatatactgacatgaggtgaactgaactcaaatgttaaaatgccaaggaacccagtggggtgttgtgagcagaaaacgagatactttgaggctgggaaaatatcctgagtacaatgcccaagagcaaaaatatgtgaaaagagatagaaaggaagcaaaactcttaaagggagtagtagaggggacactggccaggctggtgggcagggcaactgcagagaaagcctttcaatcagaagccactgagtgcacagaagcctggagcacatctacagaagcacagagtttctccaaacagtttgtccaaagtgaggacagctagcagaagctcaacgcacatcacaggtgaaagccgactggcatgcagaaagtccccagggtccgcaccataattcaggcccggtgggggcttgatgtagactgaagacggtaaacccgtcctaacctgcttgccgatctagtctgtccagcgcgtacagtactggccagcataatgatttctagaaaatctagacttctgatttccttttaaaaaaaatttttttaatacaaacaatcccacagtacttattgtcatcttgtaataacataagggtaatcaaaacaatatgaataaatgttcgtattggacaaaggacacctaaaaacaaactatatccttctcaacaatttctcacttcattgatcatttctagttggagacactatgtacccgagtaatattatctccttttagcatgatccaacccagttgttttaactctgttttagaataaatctcttctgcatcaactaatacaaggttcatatactcatcaaaaccaatgatacagccttctatccacatattctctgcttatagagccatacctgaatctgggatctattttgtaagaatctgtaggtgaggttgatgggctccatcatagctttttgcactttctggccctgaccacggtataccatgatggaaattcctagatttctgatttcttataaaaactgcaaaatctggccaaaatttctctctctacttattctacagatatttactgagcattcattctgtgccaagtattccagaccctaaggatacaacagtggggaaaaacagagtcctcgatgttatggagtatacatgctagtgagaaagacaaacaataaataaacgcatgtgacaggtggtggtaaatcctgtaaagaaaccagagcagggtgaggggagtgagagtttctaggggagcgctaggaaacgcaaggcagtctgggaaggtctcccggctcctgcatggcaacatccagctcgagctaggtgatggcttcctcctcacacagggcaggttctctggtttgccacagtccctgctactctctcttgttacctcctcctggcctactttactcatttatgtggcctctgtaggcatcagagttgtggcccccagagttaatccttccctagatccctctgtattagtcagggttctctagagggacaggactaatagagatgtatatatgaaagggagtttattaaggagtattgattcacacggtcacaaggtaaaattccacaataagccgtctgcaagctgaggagcaaggaagccagtccgagtcccaaaaccccaaaagcagggaagccaacagcgcagccttcagtctgtggccaaaggcccgagagaccctggcaaaccacgggtgtaagtccaagagtccaaaagctgaagaacttggtgtctgatgttcaagggcaggaagcatccagcgcagaagaaagatgaaggccggaagactcggcaagtctagtccttccatattcctcagcctgcttttatcctggccacgctggcagctgattagatggtgcccacccagattgagggtgggtctgcctctcccagcccactgactcaaatgttaatctcctttggcaacacccacacagacacacccaggaacagtactttgtatccttcaatccaatcaagttgacactcggtattaaccatcaggccctccaactctggatacccaagatccagcagagaaaggagacactgctcccaagcagacacgcaaaacaagtcagagaaaatgggatttgaggaaatacgagcctaagccaagtctgaagggggtggggggaccactccaggcattgccctgttaaatgatggagaaacagtttttgagtcctgaacacatgtacagaaggggctccagatgcaactgggaaaggatccccagatctctctcccactatagggcacaaggctgggggccacaggtggcagagcatcagggaccaaggttgagcaagaatgcagaccaaagtaacaaggtactgggtcatgaagcctgggaacacatcccagggctgcttagctaccctatgggacccctgagggaggcacaaagagtcctcctggagcagaagggagagggtaaactgaagtgcaaagtaaagggagagggtaaaccaaagtgctccactttctaggagcaggtttggggcaaggtatggagtggcttcattccattccctaagccagcaagaaatgccacctgtaactttacgaggtgactatgggggagcactgtggggaaaatagactgcactctgtacagggaagatccaatccacttctgccagctggtgagggattgcccagccagaaatcagcaagaacagctgagacaacaagagggcggtgacacagcaaccacagggccaagagaaagcactagagaaagaacagtgtctgcaaaggacttgttagatgggacttgtttccattcctcaggttcatggcctcttagaagaagggtatcacctgtcctttctctcgtgagtaggtggtgtggatttgcttccagaaggaccagccttttctgggatcatcctgctctattccttggatggcgggagccagcctactgaagaactgagggtgtacatctcccagccagtcccagatgctgatgccagggcttccagtaaatgcccagagctgccctgaaggtgacagaggccttaacacagcctgtaacctcacccttcctgcttctgcgccagcctgcctccacctttttctcttcaaccacatccccaagagagcatgcataggctcccttgagccttggggactgggacattgcattactgatgcttgagcaaccgcgttgtcttcagatctcttttagttatgccctttaagaaccatccacatgtgctggaactaatggctgaggcgggacagcagggtacccctcgtaagtcagagagagctgaagaagcccaagactcacagccagtctgtgatagagaaattgtccttaggccctgggacgatgtctgcaaaactgaagccacaggcagagagcagagctggtaggtgtgaagtcaagtcctaacactggggtctgtgaaaggtgttaaaataattatcgcctagaacgcagaacagattcattttaacaagcaacactctaaataggaatcagcaacactctaggacttgatcttcagacccaaacctcaggcagctcagccaagcgggagctcagagagcaccccctggcctggcaccacctgccacctctcataaggttcagggggtgtcttcctggggactcaggctcactggcaattttgcacttttcttacaaagtgaggaatagtcaggtcacctctgagtaggtgacactggagaacactgacaaaattatcttctggcaaaaagaagtctcccctggtggaaggagcccagcattcctgtaaggcaggattcttaacctttcctgtgcattgtgatagaaaagtagaatcttgggaccccaaactcattatgctaaaggaaaagttaagcttgggaattgagtcgcccaaaaactacctttcttttgttcccagatagttgtaatttcacaggcttgctttatcctatgtaaaatgcagatttactaagcacaagaaaaatgcataaatgatttttcctctacccacttcttttcacatgtaaaatgtagattcactgagcactaatcagagcctcacaggaatgtaaccacttgccttattgcctaccctcctttctttcttccctcctgcttgctcttcctctttaaatattgaagttcctaaaaccctctttggaaaaagaacaggtcacagattccactgtgacttgtgtttctttttcccagatgtgtcctcaaccttagcaaaataaaacctcgaattgatcgacacctgctgcagtcatatttttggtttacaggaaggacccctttggcaaatgcttcagacaaaaaatagggccataaaaaaacaattatactgaaagttatcaaaatatgttttttaaaaattataataatgctgtgcttttctattaatgtcatgaacaaaagatttggagaggggcctgatagacaacataattatgaaatggcagtgagcagacgtggggttttggatatttgtagcaactgtcatgtgatatgaaaatcacccctgatttccatgactgtacttcatctcctgcagtcatacagaaaggagctaagttagtgagggttcatggaactctccacgcaaagcagaattctttcgtgctcctgaaataatgcgcaatatgcaaatcctcctgtaatccacggcctcaaactctcattaaagtggaaggggttgtcctggggaccctttgttcagagtagaaaggagagtggtgttagtggaacaaaaccagagggcgatgagcaccaggacccaagattgagggaaacgatgcgccgatgcgccgcggagtagaggagccaccacgggtagcaaagtgaacttcccccgaatcacggttaagccccctgggccacatggagctgtcatctgcagtttttcccacctcggaggcctgaccctgtgctctccataatcaatgagtagatttggccctttatgttccctgaggcttccctgactgctcattaaaaggatctgctcagtcctagtgaattgatttactttgccacagtccttgaaggatgctacagatcaaaaggtgtccaggaaagtgatcttaaagatgctgacactactcccagttactgactagcggtgtgcatgccaggcccctgttccaggagcccaggcctcgctccatgggggagcgtggactcacagaggaaaatcaatgtgcaggatgcagaagagaaggcaactggatttaggttgttgctgttggttccttgtttgcctttagagacatatgaaaaggtccagtcattctctttacaaaacagaaatacagaatataaaactcaataaatgcaacaaaaatgaaaaagacatccatttcatagaggtgaagagaaaaatcaggtcaatagagaaaagggggttagaagagaaaagcacacacaggcacaaacacacggagtataagacagagtgaaaaatagatggggaaggcaggagacagagaaagaaaccccagcacttatcaaacccttaaggtaaagctcatctcactcatgaatcctgctcccaatggaaaataagccacccactagattcaaagtttggataaacctagtagcatgtgttattcaaaaagcactctaatttctttccacattctggaagtctctggtcctcatttaggaaagaagaaagtatcttgctccccattcctgaaagcagcaagcatcaaatttcatttttcagagaccaaggtctacttttatacagtagcatcgctcatgtggcctctgggactatttacacatagagacgattcaagtcctgttgcattttcacaaccataggcacaaatgataccacaccttagtgtttcctgcctgtggatgcactcaggtaagaactggatggagcttgcatggcaggtagagttagcagttactgctgagcctgtgagaaacaggcttactctgagagtcctgctggggtccccaggatgcagtgagcactgtgttcctttttccacagccaccagcaggggctagggacagtctccttcatgacctgcttccaggacatccttccactgttaaggatcagtcagcacctccaacccccttaatgtacccacccagcagtgtcggcaagctggggacagacatgcagacaagctggtttgcatgaaattctgaaatcttttgaaaatagagacacataggcaacctcaggatggaatttttattctaaatgcctgatccatcttaattgccaaaagtgatactggcaaaggaaaatgaaaaatacaaaaaggcttggatttaggctatctgtgttttcaaatgatttaataacgatgataggcagggatttacaccaacagatcaaaagtgcaacaaacatttatggagccctgctaggtaccaggcaccgtggatatattgatgtgtaagacagtctcatggagcacacagtcaggactcccagagttattaccatccccctccacccacggtagcccccacttcctagaggacaaggaaccaagtgtcaactctctatccatcacaaccacctgaccagctggctttgattatatccccactttacagctgtgaaaactgaggtggagaggccagaggtgcaccaagaagactacccgtgcatgctgaattaggcactgctagtggtagatcaagagagagagaggaggggcccttggcaaaggcatttccaggagcattgcagagtgatagatttaggagagggggaaagatgccagggtcatggggctcagagggcagaggtggccttggagagggagagtgcaggctgggccagacctgggatccccctccatttacatgttggggtgtacctgccttattctttctgcccagagccatggccatgcccccttcttttggatagttctccctgtggttttagaggaggttcccagtcacaagaggctcccagcagctagagtggggccctgacccaggctgggcccacggctgtggctgcagtaactggctcaaggagtgggagaagacccaaaccataacatcacagtccttttctgagatctgtaaaaccaaagctggtttacaattatactgagggaaagtctggaatcattagtcgtcctgtttcctgccagatggatcctgtctgccatggaagagaatgaagccaacctgtagataccaacagagaagagagatgggcagagagtgtgccaggaacatttagatccctggaaccaggctccaaagccaacaatgccgttccccttccatgatctagttggatgagccaataaataatccttttccttaagctattaatagttgggttggactttgaaagccagtgaccaaaggagttctggttgatatatgggtatgacttactataagggggtgcacaaagccagaaatggatgctatattcattggacaaagtctatttcagtggccacagagacctcaagatgctctgagacgtgcataggccaaaatgcaagggagagagactgtgctggaacgagcagtggagggactggctgggtcgctgaagtttcctgagtgatgtgcacccttgagagtccactggaaaaagcacacacagacatgacccacaggggactgcacattataacttattccatcaccacatggggcgaccctgagactccttccactccagtaggacactgagtgtgggtggcccttgctaggcctggtgagaacaggctccactgagaagacggagcaaggaaaggctgggattgccaggaacagcaactttgaagaactctctttctcagtgtgccaggaggcctgagcgttgtgggagggctttcgtttgagggctgtttcaacaaaggatttactcatttaattacttaaatggaggtaaaatcatactgtcctccttcagggactgagctgcccaaagaaaagtcatattctacaggaaaaattacttgaaacaattggatccttggcattcagcttcctcaatctttattttcctaaaatatgtcttcaagaaaagccagctcctgggctctaagtaagcataagctctgatggtagccaagagactcatacatttaggatgaaaatctggcttagcaaggacagtagggaggaagggacaacacacagcccaccctgacagaagcagccagactttggacgtgctggcaaatagcctaacacacccaatatgaagtgcgaacaaggagatccactgccatgtgttttataagagtgcaagagaaaataactcaaatgtccatcctttggaggcaggataaatccgacagagtgtaacacttggaatggttcacagagaacgaagttctttatagactgttatggaaagatcccccaaatactttattaagtgaaatgacaccaaataatggcaaggtgccaaacagtgttgatagtgtgctgccttcaatacaagaagggatattcagaatatgtacttagatttgcttgaatttgcacaaagaaacacggagggaatttttcgcatggctgcaaggcagtgagcaacggagtcagtggcgtcaactggagacagtgggaaacagacttcaccgggtgcctttcagttgctttaatttttatactgtgtgtattcaaaataatgatgaaataatcacacagaactctatgaaaaagacatcattttcattatacaaatcaactgttttaaaaaaatcccagcctggacgacatggcaaaaccctgtctctacaaaaaactacaaaaaaattagctgggtgtggtggtgcatgcctgctgtctcagctgctcaggaggttgaggtgggaggatcacttgagcccaggagaaggaggttgcagtgagccgatatcgggccactgcactccagcctgggagacagagccaggccctgtctcaaatatatatatatataaacatcttttttagaaacccttagagcagatgacacagatgacaatctgtgttgtactctgaaaaaccaacagaacatttaacaaacattaatccatatcaggccccaattcaacaagtgctgtgtgctgctcccttgttctttgggactacacacggtatgtcgagtggggaatctctcctcttaatctctcacaattcacccactgttcaggaccagccctgactcagatccctcaggccacagaggctgttgcaactcagcccctggctccccaccctgacgctctgggttatagccttggcgctgtgaatctcctcttctactggcaaaggctcagtctgcacctggctcctttcaggagattggactccccagcccctttccgctctgttcattaaaaaccaccactgcagcggctgggctccccggggcagccaccacagaggctgctgcgtttgttctgatgtgagctggattcggagagctggttgggttcatttcctgtgcttccagcctccttctccattggcagcacgcactcaccatggtaacgctcaggccgctttttggaaaccctcacttctccttgcttaaaactattcaaagaaaaatccatccaagcccgtcaaggaaaaggtacttattaaatacctttcccaaagttaaaacatctccaacaaggagctgtctgaggcgccttcgaagttgtgtgtccctgagacacatgcataattaggttaaacatggagctggaagtaaaaaggcaccacacttacccagaacaagaaaaggtcagaacgctacccctctgtgagccctcacacaaaagctcgggaaatggaggctgtggttttcaggcaacggggcacgcgcttgggtgcggcaccccgaatcgttcccgctgcttgatcgtcacgctctgtgagctctttctaaggtacatttgctatattcattaaaggagagaacattggaagcgtttaaaataaaatgccttgtgattttcaaaatcatgaacatttccagcaggctgaagagaaagggctttcttggctgcaataagaaagaatgagaaaaagagaaaacctcctgaaaaaaaagtggcggggggtggtgatggggtccatgtgatgctgaggtttctgtttgttttgctgattttcagtaagcaggatttgtttctttttcaccttcacttccggttctgtattttgcagctgtcactggatggtggtttggaagcccctcaaattcaattcagagccatgttgcccataaaatgtaaggattgtccaattcaacgcagaaactcccatctgtgaagccttggtatcgggagggcttatgaaatcaataaagctcatctgccaccaaggagagcctcagtttctgacaatggaggctagaacttacaaaactaaatgaaattatttcttaaaaactcaactgcccctaatttaaaaggaatatgataagttcagaaatgaaggtttttgattacaggatcccaggcctatgaaagaatgtctggctacaaaaataagattcctgttttcttactaattataaaagcacttattatgacagcccataattacttagatatggccattccaaaggacaaattatgtctacttaaaggtaactacaacaaaaacacagtatagcacagatatctactctacgcctgtaatcctggctccttgctctagcattaaagtggttaaatgaactggcaaaatctctcattagggggagccaagaggtagttccagcatttggacctacagtgaagttccagcatttggactcacagtgaagaatgcagtctcagaaacacaaacccagacggacacatcaggtacctaattcactcggtgaagtctcacagcttcatctgatgtttactcatgacacatacacacccgccctctcccaaaacaaataagactctccccagttactcacctagaccaccctgacaaatgtctgtgcgcgtggctccaccaacgataaactgagggctgggacacaactcctgaaagtaatttggaacaaaacacaagtcacaaggtgctcagtgatggcagcagcctggggaaaggaacatcagagtcccaggttgcagagctggaagaaacccaggattgtctactgcccatcacatggttttattgctgaggactctgaagcccagagaggggatgagccctggtcacagtcacacagccaggggtgaacagagcagaagctggagtccagagcccctgccaggactagtgttttcattttttatttattttttatttattttattttattttaagtttttgagacagcgtctcgctttgttgcccagcctggagtgcagtggcatgatctcggctcactgcaacctccgcctcccggattcaagtgattctcctgcctcagcctaccacatagctgggattacaggcacgtgccaccacacccggctaatttttttttttttttttttttgtatttttagtagggatggggtttcaccatgttggccaggctgatgttgaactgacctcaagtgatccatctgccttggcctcccaaagtgctgggattacaggcatgagccacagcacctggacaggactagtgttttaatactatatgtgtggtgtgggtgtgtgggtgtgtgggtgtggaaaggtggtgaggagcagggaggtaggagaaaggcaaaggctgagataatatgtgatgaaaaatgatctcacctattcagacaacacccctatttacataaagagattagaagaatatttagcaaaatgctgtgcaccctgtgggcactcgttaaagtcttgactaaatgataatgaccccatgtgctgatggacacactgaagtgtcagaagtaccatgtatcctgagatgagaattcatctctgatacattcacatatctgacctgcacttcctccactcacctatctcaactggcatctgcctacagcaatctcatggccctggtgctctgttggggcacaatgacacatgctttagtcatgctttctttgtttacccagcaaggattttttgagtgcccgttctgtatccagtaccctttgaaccatggcaggcaggggaaagagggaaacatggtgaaatgaagaaagaaaagaaataaaccacgtagttcttggcctcaaggtgcttttgctgtatatagcaaaccaagattgacattatgaaaaaagtcagagaaaaaaggctagtgcataataatagaatgtaggctatatccacaaagggagaaaaaacacaaagagagaaaaatgagaagggcccaacagggatgatggctgcaagacttagtgggtgggagatgatgcctgtccattagaaaggtaggatgcaggagcagtctacgtactggttcctaaagaagagatgggtctacctgttcaccaggcaaactgctaggggaaaagggcaggacctcgagggacaaaacggaagtcagcctacatttaatcggtggcatcctgggctgcactacatcaaagactgtctggccacagagagagagaatcatttcattcttacttcatagaggtgaagaaagggcagatcagaaaggaccaggaagcaggagggtgggctgagggcagatgcatggggtctggatgaagctggcagtggggattctgggattctgctgtgtgaggtggaaccttccaggtggcagccccatagcctctataaggtgctggctcctgctgaaatggcagaaacagctcctctgggctgactttttttttttcccaagtattaaaaaaaattttgctgggtgcggtggctcacgcctgtaatcccagcactttgggaggctgaggtgggcggatcacctgaggtcaggagtttgaaaccatcctagctaacatggtgaaactccctctctactaaaaatacaaaaattagcccggcatggtggtgcgcccccgtaatcccagctactcaggaggctgaggcaggagaacccaggaggcggaggttgcagtaagccaagatcacgccattgcactccagcttgggcaacaagagcgaaactccatctcaaaaacaacaacaacaaaaatttatttacctgtttttcattgaaaaactaatacatgaacatgagaaaaaaaacccaacagtaaataatggtgtaaaacacaaaatcccttccgcctcagagtccgcactggtagcatttcttaagtgtccctccagaagctgtcttctgatatgaaagcatatttatgtacatacacacgttttgggtttttttgttttgttttttttttttttttttttgagacggggtctcgctctttggcccaagccagaatgcagtggcgcgatctcggctcactgcaagctccgcctcccgggttcacgcccttctcctgcctcagcctcctgagtagctgggactacaggcgcccaccaccacgcccagctaattttttgtattttttagtagagatggggtttcgccttgttaaccaggatggtctccatctcctgacctcgtgatccgcccgcctcggcctcccaaagtgctgggattacaggcatgagccaccgcgcccagccacatacacacatttttatcacatatgtcttgtacgtatgtcttaggacatagagagctttgtaacttcattaaaagtaccataagttatttagctcgtttattttcttgccatttatttatttgtaaataaaggttctctagtgatggacctttagttttttgtttattcattcgctttcagtcttttgcaatctctggcggcaacttaaagagaaaagtggcaccagccaatctgggtgttctaaaagtgtgcagctgcaaatgttcaccccgggtgcccaagagctcccagtctccaagcagtcattttttggcaaataaaaggcagagagatctgatagagtaataagtaaaaagaaagagaaaaaaattttaatttaaatgttgtttttaaaaaaagaaggaaaatgttgtgtcgtcaagaggaaagaaaagacagcacactcaataggggtttggaagaatctcttttcttaaaaactctcttaaaataggttcttggctgggcatggtgactcacacctgtaatcccagcactttgagaggccaaagtgtgtggatcacttgaggtcaggagttcaagaccaacctgaccaacagggcaaaaccctgtctctactaaaaatacaaaaattagccaggcgtggtggtgagtgcctgtagtcccagctactcaggaggctgaagcaagagaatcacttgaacccgggagcagaggttgcagtgagccaagattgcgccactgcactttagcctgggcaacagagtgagactctgtctcaaaaaataaataaatagatgaatagattcctgttcttcatccgccattcatccatcggtctactgaaatctgacttctacatccatagcttcataaaactcctctcacccatgtcatcaataataactaacttctctttgcatttggtaccgttggctattccctctctgaaattgacttccatacccttactcatgcttgattttctccttgcctctctgagcatttctcctcagtctccttcatgcattcttctactgtgcttacccctaagtatcaaggaacccctggctcttggtcctcaaccctctgagattatcccatttcatacagcagtaacacccctaagcattcttctctcagtgacatcattcgacctcatggcttcaactattaactgcagaatatgctgatgcttccaaaataactccctgagctgtatcttcaattacctgtgtcacattgctcatttttcattagattcatatctaataggcctcccaagttctgctaaaatgttgagtttgggttggaagacagagtcattggcaaaggctacagacaattacaagtgaaatatacagaatggtgctaagtggtttgtaggtagatggaatgtccattttactacgtggtactcagtataattcaaaaaatgcccccaccccagaaaaacacatacacacacaccaaggaatgtcatgactgatatgttgcatgaatctttcagggaccacagaaagtccccagctttgggctgggcatggtggcttacgtctgtaatcccagcactttgggaagccaaggtgggctgatcacttgaggtcaggagtttgagaccagcccagccaacgtggtgaaatcccatctctacaaataaaaatgcaaaaactagccaggcatggtggtgtgcacctgtaatcccagctacccaggaggctgaggcataagaattgtttgaaaccaggaggcggaggttgcagtgagccaagatcgcgccaccgcactccagcctgggtgatggagtgaaattctgtctcaaaaaagaaaaagaaaaagaaaatccccagctttgcaaggagattccatctcactacgatgcccaaagaacttaccccaaatctctccattactaagttcctgttgaagcacagatcagagatacaaagtaattgggagtcagagaggttttaaagaggcaggattctgtgaagaggcagcctgccacctacccacacttagaacccttttttatctttcctaataacaatcatgtctttttagtaacactgttttctattactcaagcgaggatctcaaaacactccataaatacaaattactctaacctaggatcagcctctgatgaccaggcctaaggaaatacaggtatcagtcaagaatccaaggcagaaagtgactgaaacccacactgtctcagtgatgatggctgtttggccacactgctctcctagagcgttaaccatgtctgatagctttggtttgcactttaggagctctggtttttagaacccccagagatgctgccatcttcaccatcatcatcttcaagtatagccacattgcttgacccagcacctccatccctctgtgatctggccccactggatgtttccagctttgtctgtcagtttcccacagtgagtgattatcactctcttcccatcacagtggactcccaccttcctctgaatacacttgctcccgatgcactgccacaacccagtacctctgcccacacctgcgccttctcttcagtctctatcccgattctcttccaccaacaatcccaactcaaacgtctccggtaattaacctgccccaatgtcactgtcaaatttaactgcttcttcccctgaactcccatacattgtgttcatatttctatttatttcactctctggatattctgtcttgtaataacagctagatttccttattcaagcatcccaataaccaaagcctccaaaaaacagtgaagtgggtaatattgttatctccattttatggaagaggaaactgagtcttggggtcattagtcatggttcctcagctagcaaatggccagaggggaccagaaacctgatctacctgacgcacgagctcatgctcttaaccactctgtggcctgccagctgtccacttgtccgtatgtctctccctgatgagccaaagctccacaaagactcctctccagcacctgaacacaaccagcacgcaataaatcatggctaaactgaaaactccagattcactccagatgtagcagctgaagaaagagtggaagctccaagctgaggcctgtcaccctcatccttatcctaacctcccaacaattcatccccttgacatttctcttaaactaggtccttattatgcagctgacatcacttcattgctgtcttgctgtatttctccttaagatcaataaaccacttaattgccaaaaagtggacacttcagggaagaatatcattgactgcactgcaccagggcctgctcatgctgggcattcctcaaaccacaggacctgggctgggcattaaccaagcacagaggggaagccagaaaataaggaggcaaaaatctacctgctaagaacacccccgatctcacatagccaaccatgctgtttgtggtaggattgttcttgcccaaccctaaattgtctcaggattgtgaataaccaaaagttcatcctgagaacctatgcttgaccttgagcccttcctctgggcaaacttgtcctgaaacccttgggacaagagctcaagcaaatctttgctcaattgcttatgaataggcagaaacgcccagcaggggcaggatgtcaaatgatgtgatttcagaaaatatctaagtatcaatctttattttattattgagaggacaaaaacatgtgtacatacatgttcaacccatctcatctgctttcccccaaagggcggtagaaattaacgtctgtgtgggaaccaggatcatatgagtcacatttaggcagtggacttaaagcccccaacactgaagaagtacaaaatcaccctcaaaagcagcagtgaaataaaaaagcaaacgacacaattaaaaatgggcaaaggggctgggcacaatagctcacacctgtaatcccaacattttgggaggccgaggcaggtgggtcacttgagaccaggagtttgagaccagcctcgccaacatggcaaaacccaatctgtactaaaaacacaaaaaattagccaattggtggcaggagcctgtggtcacagttacttgggaggctgggacacgagaatcacttgattctaggaggcagaggttgcagtgagccaagattgaaccactgcagtccagcctaggcaacagagtgagaccctgtcttaaaaaaaaaaaaaaaaaggcaaagaacttggatatatgtttctccaaagatgatctacaaatggtcaataagcacatgaaaagatgctcaccatcactgatctttggggaaatgcaaatcaaaaccacaatgaaatgtcacctcacacccattagaatggctactatcaaaaaacagaaaatggctgagtgcagtggctcacacctgtaatcctagcactttgggaggccaaggtgggcagatcaactgaggtcaggagttcaagaccagcctggccaacatggcaaaaccctgtctctactaaaaatataaaaatttgttgggcattgttacgagtgcctgtaatcccagctactcgggagtctgaagcaggagaatcacttgaacccgaggggcagaggttacagtgagccgaattcgcaccattgtactccggcctgggtgacaagacaagagtgaaactccatctcaaaaaagaaaaaaaatgaaagaaaataacaaacattggcaaggatgtggagaaataggaaccctgtgcactgctggtgggaatgcaaaatggtgcaaccactatataaaacagcactgtggttcctcaaaaacttgaacgtagaactgccatatgatccagccatgggtcatatcttttgggtatataacaaaaagaactggaagcagggtctcaaagagaagtttgtatgcccatgtttgtagcagcatgattcacaataaccaaaagtggaagcaacccaagaccaacaatggacaaatgaataaacaaaatgtggtctatagacaccacagaatactattcaacctttgaaaggaaggaaattttgacatatgccacaacatggatgaatcttgaggatattatgctaagtgagttatgccagtcacaaaaggacaaatactgtataattccacttatatgaggtacccaacataatcaaattcaaagagacagaaaggagaacagttgtcagaaactggggagaagggccaggcgcagtggctcacacctgtaatcccagcactttgggaggccgaggtgattgaatcacttgaggtcaggagttccagaccatcctggccaacatggcaacacccgatctctactaaaagtacaaaaaattagccaggcttggtggcaggtgcctgtaatcccagctactcaggaggctgaggcaggagaatcgcttgaactggggaggcagaggttgcagggagccaagatcgcgccactgcactccagcctgggcaacagagaaagactctatctcaaacaaaaaaaaagaaagaaagaaaaagaaaaaagaaaagaaaggaaacgaaattcggggaagaatgaatggggagtttttaaatgtgtatttagtttctgttttgcaagataaaaacaattctggtgatggagggtggtgatggttgcatagcaatgggaatgtacttaatgccactgaactgtgcatttagaaggggttaagatggcaaattttatgttatgtgtatcataccacaatttaaaaataaatgagtaaatgcaacaaatgaacttacaatgcaccacatttctggataccctgatctctttgcaaacccttgaaaggcctcttgggaggaaaaaataataatgaagcatttaggatcaggctaattttctcagcattcaatgcatgttcctcatagagataggatcagaatctttactgattcaggagtctattcaataactgtaagatcttagaggataagtctgccttctctaatgtacccttgtggtatgtgagcatgagcctgcccaaaagcagctgtgtgataatttttcactgatgattagggaaggagaggttaaattttgacacgcatttatttactcaacacgcacttgaaaactccaaataggagtccttcaattgcaccttccgcattactcaggttctactgcctcatgctctgaattttacttcctcctttgacagccacaaatcagcacatccagtctacaattaccgcatttccacagaccacgaggacaggtgaagacatagtttggggaagaacaggctatgtggttaaggaggtaaagtctctaaggatttcaaagaaaggagaaaaactaagcaaaggttaactgatacctgactttggtctctaaaggaaaattttctccccctccttcctctcccccaagacccttgggatctgcaatggtacccctccctaaggcttttcaccacccagttgtgacaacccaggttcccatggcccatcatttatgcctctgtagagttcttacttcattctgccttgggcatctgtcctttattcacacctgtgtctccccacactttccatcagagctgagaccacagctccttcctcagcttctccctgaccacctttccaatcagtgcagagcccatgcctggcacaaaatggaagctcaaaaaaactgtctgttgaaatgaaatgtggctgtcttgaaattagaataaaaaccattactcccaatctggattttatcaacataccagggtaaccctataggtttcagaggggaatgggaagatgaaccacggtgggcgggagggcagcatggccaaggagttattctcagagatgaaaactgttaggcaaaatcagcaggatcaaagtaaaaagggtagaggtagctagctggagttaaatagtgattttgaccattttagaagaagtactctccctttgtcttcctgtttcaaccactgccaagaaaataggaaccctgacttaatttccctatcatggtttagaagacaaaaggtgcccaggtcatttcatagcccctctcctgagacgttgttatgagctctgttgaacagagcactttgtatggatgagctcaattctcacaaccactctgtatgggagaggttctcatccctgaggaatcacttgacaagggtcacatagtgataggtcatgggtctaggttttgggaggactgttctccatcccttgcccttgagctttgggtagtatcagtaaccgcatccaggagcctctgccttccgtctgcatccacagagccccagctcccacctctccactcaccagccctgatggaataatgtcaattcatgaccttgcgcaaccgtgcacctttcagcaatgatgttgtcacaatttacctgccagctgattgcatccagcactgagttgttccattgtgcactggcccagggaccatatgcagtaataacaactacgtattctgcatctattatgttctgggcactatgctctgagatttatctctaattctcataccaaccctgaaaaataaggtgccagtaaatgccattttacagatgagaaaactaaggttcacagagtttaccggcccaaaacaacacaggcagagctaggattcaaatctatcttacctagttccaaagctcatccatgctcttctctctatacctcaccatctctgaacaagagttcaggctgggtgtagtggctcacatctgtaatcctaacactttgggaggctgaggtgggcagatggcttaagcccaggagtccaagaccaccctgggcaacacagcacaaccctgtctctacaaaaatatgtaaacattagctgggtgtggtggcacgtgcctataatcccagctacttgggaggttaaggtaggaaaatcacctgagcccaggaaggttgaggttgcagtgcactgtgatcgcaccactgcactccagtctgggtgacagagtgagactctgcctcaaaaaaaataagagttcaaaaggtgatgggggggccagatgcagtggctcatgcctgctatcccagcactttggaaggctgaggcagatggatcacctgaggttgggagtttgagaccagcctgaccaacatggagaaaccccatctctactaaaaatacaaaattagccagacatggtggcacatgcctgtaatcccagctactcgggaggctgaggcaggagaatcactcaaacccaggaggtagaggttgcagtgagctgagatcatgccattgcactccagcctgggtgacagagcaagactccatctcaaaaaaataaaattaaaaaaggtggtggtggagggatctgaaatatgagatccagacacttagggtccacagcctcaacttctccctcagttcctcctgatcagatgtaaggcccctccaccttgtatgtcactcaacagcaagcccgcttccttaccgtgggccgcttccagatgatgccttgagtttgcggagagcctggtccaagatccttgtagcccaaagctgatggacatgctgggaactcagggtccttaaataggacccctgagtccaagcactgttgcctcagggtcttgaaatcctggcccaagtacttcaaagcgttttggttggagccaagaccttgagtggctgcccgctgcctagatacaccagctgcctgggctgccatggccgtgggctctgtagggtggacagaagggcagggctgcactgtactctcagacacctgctccactgggaggggagctataaggcac

SEQ ID NO: 722 - DNA, 74426 bp, Homo sapiens
actcagactctgatggctctgtagctaactggcccatcctcagagactaacgcaaaggaacgaatttccaggatgttcgactatgtggagaaaacaaaaaaaaagcaaagaaaaaaatatttttaaagaaagaaagaaggccaggtgcagtggttcacgcctgtaatcccaacactttgggaggccgaggcagacagatcacctgaggtcaggagttcaagaccagcctggccaacatggtgagtcaatactaaaaatacaaaaattagccaggtgtggtggtgcacacctgtaatcccagctactcaggaggtagagacaggagaatcacttgaacccaggaggtggaggttgcagtgagctgagatcgtgtcactgcactccattctgggcaacagactccgtctcaaaaaaaaaaaaaaaaaaagagagggaaggaagggagggagggagggaagaaggaaggaaggaagggagggagggagggagggagggagggaggaaagaaggaaagaaggaaggaaggaaggaaggaaggaaggaaagaaggaggctgggcgccgtggctcacgcctgtaatcccagcactttgggaggccgaggtgggtggatgatttgaggtcaggagttcaagaccagcctggctaacatggtaaaaccctgtctctactaaaaatacaaaaattagctgggccgtaatggtgcacacctgtaatcccagctactagggaggctaaggcaggagaattgcttgagcctggaaggtagaggttgcggtaagctgagatcgcaccactgcactccagcctggttgacagagtgagaccctgtctaaaaaaacaaaaaaaaagaaaaggaaaggaaaagaaagaaaaagatgggaagaaacaaaggaaggaaaataaactacattatatggagaattatttggacaccatcaaacttccactagctgtccctgaaaaccgaaattaatatgctaaaaaattactatctctaagtccatagaaaagtctcctctgtatatacatcaagaagagagcaaaacggggaggataggacataacccacctcccagagagagaagcagcccggccagtggaagtgtcctggtgatattcccccaagcactgctacatttccaagtggcccctgtgactggaaattagaagcataggagttattgacctaggtagattttgaggcaaaaaaatccacaaaggtacaagaagaggaaggagaggaaggagctggtgaaggagattgagaaagaacagccaggaaggtggaagaaaaaccaggagaaggaggggtccatggaagcagagggaagaaagtaagggaatggcaacagtggcagtggcagctgctggacacagagagtaagaactgagaaggtttccctggatttcgaatcaaggaagtcattggggactgtgaccactgcacttcgcagggtgctgacaagtaaggcttagaatgttcattttctcccccatttgctctgcaaaccacattgcccctgtctaggacagaggttcccaaaagcagttttgcattcaaatgccaactccactacccactgactgtataaccctgggtgactcattgagtatcttggtgtctcagttttctcatctgtaaacatggaaacaatgacaagacctatcttatagggctattctgaggattaaatgagtaaatatgtgcaaagcatttgattttttttttttttagatgggggtctctctatgttgtgcaggctggtctcaaacccctgggctcaagtagtcctctcacctctgcctcccattgtgccgtgcctggccatttgcaaagcacctgagatgaggatgtgttctctccaggctgctccagccaatgacaacacagtagaggtactgggctggccatttctgcccaatgcagacttctattggcccagctttgccccagaatccccactgggttggccaaggctttctcagagtggcactgcagtctatggatcctcctaccacaccgcctttccttccccatctcttttcataggtgtaaggcttatgttatgggctgaaggcttttctggactactcctgttctctctcccctccagttacacaggacttacccccaataagtctcttgcatgtctaacttcgttttggcatttgcttcccagaggactcaagttgacacacttggttaaacagaattctctgctacaggacttgtcagagcctttaatattaaaatatacacattataactcatcaagagggaaaagtataaagcatttcccaaattcatttgatcactaaaaaccacacactcacatccacacatgccacagaccctctcatgaacatctcatgaaacatgttttgctgagtaaagtttgtttaacattgaactaggccagccgtggtggctcacacctgtaatccgagcactttgtgaggccagggcaggcagatcacttgaggtcaggagttggagaccagcccggccaacatggtgaaaccccgtctctactaaaaatacaaaaattagcagggcatggtggcgcatgcctgtaatcccagctactcaggaggctaagacacaagaatcacttgaatccagtgggtagaggtcgcggtgagtcgagatcacgccactgcactccagcctgggcaacagagcaagactctatctcaaaacaacaccaaaaaacattgaactgaagacccctaaagttccatccaaccctgagattctttcatatgaatctcaaagtgtgaaacgcctcagtcgcctagggccttattctacagaagggaagtccaaaggctcatttgaattgcattagcaactcgagctatatttgtaagtctcctcccatctgagaatttctttgtcagcaacgttttccctattctacagatggagaaattgaggtctaggaagaccaagacacttgtctcagacccacagttgaggtcttagtttgccactgagtcacggtccgtgtgacacaaggatggaaaaccaaagggagccatagctgagggaagggaaatgagaagggtatctgaaatgtcggccctgcaataaggtgggccacagcaataatgagatgtcactgggctcagccctgtgcctggaaggagggaggtggtcaaggatatcaacaaaaaaatagttgctgatcccaggagaaatacaacactgaattgaggggaaaacacagaaacacatctagactgtcattaaacaaatgtaaccgaggcaggggaaatgtggagccccaacgtgagtaggtgatggagttgggtgactgtcatatgtcacagcaggatgggtagttggctgcccccagccccctcctgccgctccctgttccagcaccctggcccaccagccccttcctggcaactcccatactcccccagttcatccactaaaggattaatagctcactcaggggaggcttcctgcccctcggccaacaccaacttccctttcagcaagccagtgtcggcactacagtggtttggaatactttcaatatcactccctgttaacaagcctatccttggactggctgagaaaagaaatggaacggggcaaagtaacaaaacaaagaggcaagacagagccaaatgtctcctatggttacctaaatcacaatttagacaagcactggtgattcttgcacatagagaaccaccactgaactgtacaggggaaactggtttctgccccagagatgtgttggggaaatgacatactgaccaccatgactacatcctcggaagactgagtggcagagtgctactttggctttcttaccaggtgaacttgagcatatatctgggcagttctagaatttcgatgtgggagggacttagggatgaaaaaaataaaatgtggatggtagatggcatttggggcaggggattggaggcttgtcttgtagctgtttctgcttagtaagctccctgttctggcttagagacatatttattggggagcttgctgatgggaattatggacggggccaactcctctcccagcaccctgtggtgctgacatctgaggtgatcacttcccatggagtggagaaaagcatgctgctctatatttgttccctacaacaggaagcgtgaaaacaggatttgctgccacatgtcaagtactcatgtgcctgtagaagaaaggggccattgctgctgatgataacaatgatagcatctaaggttttatagttccccaaataatttcacatacactgtgatttgatgcttataacaaccgtgtgaactatgcaaagtaggtattatttccccattttaagagatgggagaatggatagttagtattttgaaaattgccagaccccacacttataagactacatgtattattagtaaaattactactaggggaccccagctatgaaaacctctctgggagatagcactggtgggtgaggggcagcagcttcggctcttgcctcctggcaagggtgggatgtaataccctaagctccaacagactggggaaagagaaggggcttagaaaactgtctgggctgctggatttctttccggagtttccctctctccttctactgtcagcacgtcccatcttttgcaacaccagggagaagcctttccatgcctcttcagctcttggaatccctccagaagccccctccctcctgagtggcatctaacaggcctgtccaatactcatgctacagctatgaggaaagaataaaccctgcagctgcttcagaagagaaagaaatctcttttcaaatgaaaccgttttttgcagccctgtggaattcatattctctgtgatctcctttggattcaaatcacggacctgaaagagggaggggaagaaaacaggttcttttcctctgcctgggcctgccgttccctctgccctcctacactgggtatggacagaccccaagggaccatggtctaggtgttggcagccaggctggctctacaacacaacatgtcagctgctctgctgggcctctgtttactcatccattaaatgaggagataagatctcccttgactggctgtgaagattaagtgcacaaatatgtgtaaagtgcacaaatatgtcaaataaaaactgagactgacacgtggaggtgcaaaattaaaaaggaagctttggttagtatctccagaacctggctaggcacggtggctcacatctgtaatctcagcgctttgggaggccgagatgggtggatcacctgaggtcaggagttcaagaccagcctggacaacatggcgaaaccccgtctctattaaaaatacaaaaattagctgggcatggcagtgagcccctgtaatcccagctactcaagaggctgaggcaggagaattgcttgaacccgggaggcggaggttgcagtgagccgagatcacgccactgcactccagcctgggtgacagagtgagactccacctcaaaaaaaaaaaaaaaaaaatccagaacctgcagattgtgcctctgatgcatctcaaacatccagggccagggagaaaataatctaaagaaaaatactactgaaaaagattccattgccatggccctctgagacacacacattcttattctcttattttctctctctctctctcttcttctctctctctctctttctatctctctctctcactccctctctcatttactcacaaggtcagtggcccagacccaggcagttctggataatcccagctgtttctgactcaccaccatcctcagggctggctgactcactccaggaaggttttccaccatgaagtgtttgtctatgtccttgtgttcccgtgaaaaggattgtgtggtcagagaaagagaagactttgctgggtcagtgagatagcatagtgtgagaggctttgggaagtagaaaaagcaacattaactcaggtttaaaaactagactttgtccaaatggttggggaaagtagtcattgtatgtgtttgcaattaaatttgggtggcataggacagcctaaagccctttgtaagcagagctctatgtgcgcagcgatccctagaaggctggcaaggggagtggccagggctgcaccaaagagggtgttgcctagctggggaagaggaacttcaggtgagccaggaggctcttctgctcccaggctgtgcaaagcttctgagttgactggaatgataggtctgatctgcccatttgttgctaaaatgacttaggagggaaatgacctccacctgcctgggaggagtcacttcctccagagatgagctgtccttgaggagatcagtgggaggagaagcctgcgctctgccccactgggcagaaggacaagctttctcccaagagcctcgagcccagaagaagtcggggtggggccaatggaaatcagacagtggaacaaatgaacagcttccaggacagggctgtcgctttcctctgttttcaattgtgatggcttcatgaaacccttgcaccagaaacccatgagctagaaatgaatgcctgtatccccatctctggactcagagtccagagtgccaaccattacacaatggaacctgtgtccccgccttattcaagagtaaagaaagcaaagcctggtggtggacggtggtacctgcccatcaggcagcatgcccagacttgcaaaccagagatggaggatgtcaaataaaaacaaaaccatgggagactgaggcaggagaatcacttgaaccgggaggcggaggttgcaatgagccaagatcgcgccattgcactccagcccgggcaacaagagtgaaactctgtttaaaaaaaaaaaaaaatccagacttttataaagggacacttcaatagaaagaaagactattgcaggccaggcgcagtggctcacacctgtaatcctagcactttgggaggccaaagcaggtggatcacctgaggtcaggagttcaagaccagcctggccaacatgaggaaaccccgtctctactaaaaatacaaaaaaattagctgcacatggcggctggtacctgtaatcccagctactcaggaggctgaggcaggagaatcacttgcacccgggaggcgaaggttgcagtgagtggagattgcaccactgcactccagcctgggcaacaagagtgaaacaagaaagaaagagcgaaagagagagagagagagaaagagagaaggagagaaggagaggaagggaagaagggagggagaaagaaagaaaaaatagagaaaaagagaaggaaggaaggaaaagaaagaaaagagaagagaaaagaaaaaaaaagagagaaagacaattccaattcagagaatctgcaagcagctcaaaatcaaacagaaaaagattcttcttttctagggtaaaggaggagcaagtggagataagcagactcttgggaggggaagctggacaagtgaggggaaatgaccagtgggagctgacaggaaaagggtcttgctgtgttcagtcaattcccaggagaagctgggcagggaagtgacttggcagggacactccactttgtttgtgcttgttcaggcttgggggcaagcagcattcagggatctgtaggaaagagagaagtctgaccaaagttttgtcaagcaaagggggtaagcaatgggtgtcagagacaagaatagatgggggcagaggaataatagtgacaaaaatacttgctttaagaaaaggtaacatcatggctctcatattagtataaaataaacacattttaaagattccatttcggcagggtgcagtggctcacacctgtaatcccagcactttgggaggcagaggtgggcagatcacctgaggtcaggagttcgagaccagcctagccaacgtggagaaaccctgtccctactaaaaatacaaaattagccaggcatggtggcaggcacctgtaatcccaactactcgggaggctgagataggagaatcacttgaacctgggaggtggaggttgtggtgagccgaaattgtgccattgcactccagcctgggccaacaagagtgaaactccatctcaaaaaaaaaaaagagtccatttaacttgattaaacgaggcaatctggtggatgttataactggttcaaaggagaaaccaaagcagcacaatttacatgacgtgaagagtactgaaatggaatatgcaactagacaaaaaactggtctctctacagggggactgtagtgcctctactggacagaatgcatttgcatatctataggaaaaattattttccattgctacagttatctacaacttagattacttacttagagttacttaggtaactatacattgctacagttatatacaacttagagttataaaataactcaaaaacaatgaaaggggctcgtgtggtggctcacacctgtaatcccaacactttgggaagctgaggcaggcggatcacctgaggtcaggaattcgagaccagcctggccaacacggtgaaaccccatctctacaaaaaatatagaaaattagccagatgtggtggtgtgcacctgtaatcccagctacgttggaggctgaggcaggagaatcgctggaacccgggaggcagaagatgcagttagctgagatcgtcaagatcctgtcactgcactccagcctgggtgacagggtgctacatctcaagaaaaacaaaaacaacaacaacaacaacaaaaacaatgaaaggctagacccagatcttctggaaggagatgctctaaaccagggtttctcagcctctacatgactgatgtcttggactagatcatgttttgggtggagaatgtaaaccaaaaataaaattctaagcctccccctcccctacccccgccaaccatctaaatggatggttcctccttagccgaggctcttaaaattttaacctgaaattttcaggccatgaaggaaaggcaaggtcggacatgcttcattatacctctccagcgtgaacatcaaccagagtttaggtctgataagaaacattttactgcctgttcactctgaagcctgctagctaaaagcttcatctatgtgataaaacttttgtctccacaacctcttatcgcaacccaaacattcctttctattgatcctgggcctttagacaaactcaaccaattgtcaaccagaaaatgtttaaatatttacctatatcctggaagccacccccactacccacccaccaccccccgccactttgagttgtcccgcctttctgaaccaaaccaatgtatttcttaaatgtacttgactgatggctcttgcctccctaacatgtataaaaccaagctgcaccccaaccacctcgggcacatgtcctcaggacttcctgtgtcacaggtgtgcatcttcaaccatggcaaaagaaactttctaaattaaatgagacctgtttcagattttctgggttcacaagagctatcttggacattggaagatgttcagcggcatccctggcttctacttagtaaaggccagtagcacctcatctcctagctgtgaccataaaaactatctccagacattcccaaatgtctcctggggtgggtaggggacaaaactgcccccagttgagaaccactgctgtagaccatgcacagttttccagtgaaacccaaattcttccctactactgtagagaagaagaggaggtaatttctgcccatctgcatttcttggcacgcacccatgtctctgtgtgtgagatgagaatcacaccctagctccacaacagagtggtcacagtagccaacacaggcagtattctaaatgctctctccctatagtaacccaactaatcctgccagttaaatatgagtttcaggtaaacaatgaatcatattttcttttagaataagtatgtatgcccatgcaatatttgggccctacatatactttaaaagtatctgttgtttatctgaaattcaaattaaacatttgggagggttgttgttttattggccaaatcattttattttattttatttttgatatggagtttcgctttgtcacccaggctggagcgcagtggcgcgatctcgtctcactgcaacttctccctcctgggttcaagcgtttctcctgtctcagcctcccgagtaactgagatcacaggtgcctgccacgacgtatttttagtagagacggaatttcaccatgttgaccaggctggtctcgaactcctgaccccaggtgatccgcctgcctccggcctcccaaagtgttgggattacaggtgtgaactaccgcacccagccttattggccaaatctgacaaccctatctataatcaaataaacagctgagcagtagtaattgcagcattgtgattgcaataggcctccggtggcttagagtccctgttctgcctgtgactgttgtgccacattggggacgtcatttagcgtctccgaggctcagttttctcatctgtaaaatggggacaatatcagcgccttcttcagagtcgctgggaggattaaatgagatgatgtatgcagagccgttaagacgctgtttggcacaaagttcagggcagctggtttagtttcctcgacttcactacctgaccctctgctaactccccgggtgttttccggacggccacaactatcctagccttcttccctatgggctgcaaaggtggcctcgggttccggtgggagccccaactctggaccgcgattcgcgagcctccccggcgccgggccgcgccatcccgggagctgtccgcagatggcagcaccggccccgggtcgcggcgttcccggcgctcggcaggccgcaggatggcctggtcccgggccgggagcccagcaggccgggagcggctgaggccacaccccgcgggccgggccgcttccctccggtgaatcatcgctcgcagcggcggcgcccgcagtggccgcagcagcgcgccgggccctggccgcgccccagccgagcgcagcgcggagtcgccccgacctttctctgcgcagtacggccgccgggaccgcagcatggcgggcatcgcggccaagctggcgaaggaccgggaggcggccgaggggctgggctcccacgacagggccatcaagtacctcaaccaggactacgaggcgctgcggaacgagtgcctggaggccgggacgctcttccaggacccgtccttcccggccatcccctcggccctgggcttcaaggagttggggccctactccagcaaaacccggggcatcgagtggaagcgccccacggtaggaagcgcgcggcaggacgcgggcagggcggggtgccgggcagggcggggtgcaggccggcccgcggcgcgctggggcggggggcagcccgggtgctgcagtggggaagccgcaagccaggacctcgcagtcctgcgacacctccgcgccgccagagcccgggactctgttcgagcgtggggggactcccggggccttccctctcttccacccaccacgctttcctgggcgggtcgaggcgaatcactgccctcagatcccactagcaggccactttaggacttcacaaaaactcagggtgatgcaggaggccggggtgaaactttgattggactctagcggggagctggaagggaaggggaatcgggtctgcagggaagggacggtgagaggcagcatctaccagacaaagtccgtctccaactggggttctgtctgttcatggagggggacaggccatagcctggtcattttgtgactaaggatagtctcctgcagccctggggttagatttatttttccaaaggggagccagcgatacctcctcataacattgacactggtaattaacccaggacacggaggtgtctcatggtttccctggcgggaatcacccgggaaacctccgggagccctccagacccccttatcccgtcccccagggtctctgacctcccggccctgggacaacttgtgctccccaatctacttgtccattctgtttcttggggaacccctgaggctcctcctcctttgggacacttccccaggcttcccctaccacgcctaggaaagcctgccctgaagtccaacttctagattcctgttgtgagaacaaggcttccagctctgcttccacacccagcagcctcccaggtcaccttctgttaccctaaatccagcccataggtagcaagggctgcaggaagcgccctagcccagactcagagcacttgggttcttcttcttgctaacctgctggtgaccttgaacgagccatttaacctctctgtgcctccatgtcttcatctaaaagaaaacatgctgcctaaatattttctctcttttgtggcccactaggccctgccgtcatggcctcctttcagtctctcaaagagccggttctttcctgcatgaggccttctcaccagcaaggcacgctgttacctggagtgtggctcactctcattcttcccaacttagtcacatgttcccttcctaaagaggtcttttctgacccttcttagcagccacctccccaccttgtttttctctgtcaccccactcatttccttcatagcattgtcacagtttagaatataatcacatgtatttgttcttcctactgaactgcaggaatcatgtgtatattatttaccagtatatccccagtgcctgacacataaccatgcctttcacagtattcattcattcattcattcattcatttactcactcatttgacaacactgattgagcacctgttacatgccaggcactgtcctgagagctcaggagatacaccagtgaacacaaaagaagtgactgtttgtagaatatggatgcaggattgtaatgtgcctcaaatgaaattatggttgtgaaagtgatacgctgacctgactcagtgcctcacacctgtaatcccagcactatgggaggccaaggtgggaggatcgcttgagccaggagttcaagaccagcctgggcaacacagtaagacttgtctctataaaaaagtaaaaaaaaaaaaaaaaaaagtgaaacacaaaccaagagaatgtgttcactttacatttgcatggcactttacagtttacatagtgagttcacatactcattcacttattctttcattcattcagtaagcatttctcgaatacctactatatgctgggcacaatgcatatggtttctgcttctgaagacttacttctgaggctagtgaggggacagagacaggtcccccaacagttggaaatgcctgtgggacttccagatgaggatgtagaggtctagagatgatctagcgccactgcttagggcaggcgggctgtgcactgcacaactaaggaagagtgtgacttttacgatccccatttgccagttgaagaaattgaggcttgggaaggttaaatacttgctcagagtcaagtggatatagggcatagatccaggactgtgtgtagtctgtgcatgttgagcctaccccttatggctgcgctctctgcctccttcctaccttctcaaatgctgctgaggtcaggcaaggggagcacagttgtttccgctggatttgaacactagcaagtcattggtgagtttagcagagcaatttcaatggaaaggtgagagtagaagccagattgttgtagactccagagtaaaggaactggaaattaagaacatgatcaacttatttaagaaggacccccgggaagagaggagaactgataggtagagtaggacctggactttgagagcctgtgtttttttcatatgagaacaacttgaatgtgtcatatgttgaatcaccaggaagaagggattaaagataaaggcagggagggggcagtgaaacaggatccctgaggaagtgagaatacgggttgtgggcaggggaggggagcaggttagccttgcagcaggaggagctgctcttcctcggagagaggatttcacaacactggcaagagtggctccagtgcctggagcggggattaaagcagtaagtccagtggggtccaagggccatgcaggggtacagtgaggagaaagcaggtgtgatccgggtggcacatcagatccttccagcaaccagtctgttaggagcaagggcagatgttgtgagcccctatgtttcccccaagaaaatcaaacctctgagaggtttctcacttgcttatcttcagctggccgaactcagcctcaaacccatatgtcctgtctccaagttcagtgactgttatcatcaacttcttcaacagtaataataatagatcacatttatggagtgcttgccagggcatgtttacatcattatctcatttaacactcagaacaatcctctgtggtgggtgttttcatcgttcccattttgcaggtgaaaaaactgagacttcaaaaggttaagtgacttcccagggtcctacgacctacataataagtggcagagccaggattcaaacctaggttatcagaataatgcagcaaagcccaaaccctcagccccttttcactgactggtaagacccatatttaattcgatgccctacatgccgtgcacaagtttcagttttctgaagcatcgcttagatgcttaggtgtttagcaccactctgaactctgacttttctagagaggctgctaaaggcattagaaagtttctgaagtataatggaaaaaccctgctggagtaagtgcctggcacactcaggattatcagtgtgattctttataataaacaggctcccagcaccaagcccaatctattccatcagctggataagagctctctggcaggccttgggccaagctggcttcctttgcctcagcagaagagcattctgattctctctgccatccccaaaactgacaggagcagagagaaacaaggcagaggcatgaagggaatgtcctctgcggcagatggtgcttccggaagagctcccacaatctgagctagaatgaacaggggctagatccaagtctcatataggcatacttctgcttgacagagtgggcatgccgagggccgttgggtggaggcaggcgtgtgcaacccaagcagacatgagacgcagctccttcaaggcaaggttgcctgagcccagagaggctcaaatttgtgccccaacttcctctgtggcttttgggtggggctcttcagaatcgaaacacactcagagggctgctgaaagggctaagaagtgttcaaggttggcttccatcaggctgctcatgacaatggcccctgaggttttaacacccttgaacgcttggtactaaatcaattagaggcagggcaggagcagaaagagttggcgcatttgatcagtaagttccaatgccagtgctgtctattatctgtgaactgtgttaactttggacacgtcacttcacctttttgagctgtttcctcgtctgtaaaagggggataatacccattccatgaggtaaagctttgagcacagtctctgatgtaagcaggtacagaatatatagatgctgtaagtttcatggtcccatggaagaattcaaaagggttagatcccgcctgccctcaaaagggtatgtgttaggaaatcagagtaatacctaagtagtaaattgcagagtccagagactctgggactcagacttgaagggatgagtgaggattggactaggacgacttcacggaggaggtgacaatgagcctcaaggtatgatgcaatatggaaaaggagggaagagagtgggaaaggaaggaatttcatgcaagcaaaacaacttgcatgcagtaacagaggagagaggatgctaacccagtggatagggtggctctagagtgtggatggtctccacgtctggcagaaaaggctggacttgctgctgtggcccccgggacacagcacaatgaaggaggctccaggcagtccagagtgtgcagggtccaatgcctgcccttctcagacaggaccacccatccacccatcagggcccagggagcaggggtcagaaggacctcatgacacagagttctgactgtgatgacacactttccccagaggggaggggaaggggagaaggggttagaagaccccactgagaatggaggcatcctagctgcagaagcacctggctggtaggctaacagcactttgtgggtctcgttcccaggagatctgcgctgacccccagtttatcattggaggagccacccgcacagacatctgccaaggagccctgggtaagtgatagattcagagcaagctgggggatcttgtctgtaaggctgtgggtggaagagatgagggacaacctgtggcttctctcccttcccaagcagcttggcaatttctatttgcagagaagctccatggaatttcttggccctagcgggcaatgattctaccctcagccccatgctggggcacacaaatgaggcctcctgtgtcccctgcacagggctagttgctgaggttacagagatgctgccactaggaggaccagggggcttctggatgtcagccaccccttggtatgcacctcctggagccagcattaccagtggttcacgaaatacactctgggcagaggactaggtgggaggactcccccagaccaatgacagcactgagacatcagttctgtgaggttcaggaaccagggaaggtgactcagtgtaaagaaagaggaaactctaatgctcgctgctgaaggaagttatagtaccagggcattctcagtgtttgcaagacaagctcaccatggtatcacagttgtaacgctcatttaagtaaaatgaactggagtagctgaattgtccaaaaccttgctttctggagccgagttcagatttgtttctggagatagtccttgttgaaggtttcaacccacagggttctccacctttagtatgaaaattcccaaagcttctaggaagtcccagcaatggggcctggcgctgttatctaagattctcatagaatctgccctcaatgttcttttactcataataaatgtgggcctataattactagagcagattatttgctctgataaaccaaaaatctattttctgccatcagcctcagctggctggctccccagacaagttcatcagtagcaaaatcagtcaactagagttgtacctcctgtcctcacccacctagcagaggttctgttactcatatactcctaataccagctgataacagctaatatgtatctctaaggcaccgtgattattcccattttatagatgaggatgcagaggtcttcctacagctaaagtggtggctggtacccctgaccccagggtatgtttaattcctgagctagactccctaagacgggacctggaaaattttctagccctgaggaatgtcagagcatcatgtgaatcattaggacagacagactgtgaggaagaacatgagctgggcgggaaagtttgtctgagctcaggctctgcagattcctgagatgccagagcacattcttacctgcagaaaacactcctttcatttcttttcttctcgccccacaaaagacagaagatagaggtccttgagcacccaaggcggatcctccaggaaaatctattcattagagaaaatggaattgatggaaactttgaccaaccccgggggctttagagaatccagaaacagccggcgcagtggctcacatctgtaatcccagcactttgggaggccgaggcaggcagatcacctgaggtcaggagttagagaccagcctggccaacatggtcaaaccctgtctctactaaaaatacaaaaaaattagctggacgtggtggtgggtgcctgtaatcccagctactcagaaggctgaggcaggagaattgcttgaacccaggaggcagaggttgcagtgagtagagatggcaccactgcacttcagccggggtgacagagagagaccccatctcaaaaaaaaagagagagaatccagaaacaaacacagcaactgcctaacatctgcttcagagtttaacaacaccttaagtgccaaagtgtaagcaacaaatacatgatttaagtcctgtgtaaataccactgggccaattggagaggagatagcaaaggttaacattcctgggagaaatttccctcccaggggaattataaaccaggtgaaatgtaaaccttttaaaaatttcttagtagctagtctgtaatttctcaggggtgtgtgcgtgtgtgtgtgtgtgtgtgtgtgtgtgcgcgcgcgcgcgtataatgcagtattggtcattttgttctttcagccttttattttggaggactctagttagatcacaatctgtgaaatgtggtatactgtactctcaccctgattctggcacctggccagcgggtgctgatggggccttgaccttcaccaaatcccaacagcctcacaagcaccaggaacagaggccatggcagtgacactctgtgacatggccagagatatgagcctagactcagctctgttggtagtccgaagactgggcaagtaattacctggaacttccatctggaacctccgtctcttccaaaaacggagaaggaaggagggtaaatggagtgacctcagacaccccctatgagtttgtattcagctattctaaagccattcccgggtttctaaccagctactcctcattccttgtgctagagggttagagcactacaagatcatccttattttctctctttctctctttttttttttttttttttgacagggtctcactctgttccccagggctggagtgcactggcaggatcttggctcactgcagccttggcctcctgggctcgagtgatcctcccacctcagccttctgagtacctgggactacaggcacacgccaccacacctggctaatttttgtatttttttgtatagaccgggtcttgccatgttgcgcaggctggtcttgaacttctgagctcaagtgatccacccacctcggcctcccaaagtgctgggattacaggcgtgagccactgcgcccagccaagatcattcttttattacacacagaaggagtaataacagtacccatcacctgcataacagtatgcaattcatagagcattttttcactacagtatttcatgtactcatcccaaatctaaagtaaatattctcacctcactgtacagataaaaaaaaactgagccacagagacgggagagtaagtgtaaagccacacagctagtaattgccaaaggattgaaccctggtctgattttgaatcctacactcttcctaacccatgctccctccaatttgccatagtgctgtgctgaggaaccattctcagcaaaattcatcttctctacctgcgctttctaccctgagccttactcagttcccccagggaacttgggcaggtgacattcttagacttgtgcactttgcaacgccctgccctgtttactgtgctgcccagcaatgtttaatccacaaacacccacgctccttcccagaaggctcagcttccaagcttcaccaaagtcatttaaaccatgtttacagagctgctctcaccaagagccatctccattgcagaatatagttgtgtaagaattgattcagcagagaaaaatctgcccttctggaggaagggctggagacccagctggagcctccactggctgaccctgcagctaaatatggctctgaaatcgtggggtaataaccacattcttacaggtgcttgccacttgaaatggctcccaaggacccaggaaactccaaggctgagctgctcctacctctgatgctttactttgcactgggtcaccactgagctttccccacagcctcacagctcacggatgaaggcagctaccccagccaggaaggcataggtcaccttgcaggcctctgatttcctggggtagagcccaaggctgccaaggctgttgaaacagcacacccccatttcattgtaacccagcaaatgttccctgggcccctcagaggtgggtcaacctgcctccttctcaagatgtcacatggacccccagagcacccactgggaggtgtttagctacagggtgccccaccccacagcctagctcagcagagagtggggaagggacaagaccaatgggaaaggcaagccagatggggaattttccagtcctgttccttctaccactcattagccacttatttggacccaacccctctgagcctcagtttcttcttctgtgaaatgggaataatgataaggatcccttcccagggctgtggagaaaagtgagatttatacaggcaaacacacttggcacactatagaatcccagacaaattcaagggaccaggattatcattactgattccagttatgtgaaaagtccttttgccaaattgccgaagaaaaagaggatggtggaggaagagaaaaggaggagaagaaaataagttgggttggaaaccagatccttgtccttgaaaatttcataatctaagggtggaaatgccaaaacgaggagagacaaacttgtggcctgtgtttgggtaacacacagattgaaactcagaaggagaaacatatggggagaaaatgaacacaaaggggtcagatgtgcattcctcaattttaaaaattgaatatttaagtgttttaaataatttttatttcttttcctttctttctttttctttctttcttttttttttttttttttttttttgagacagggtcttgctctgttgcccagactaaagtgcagtaacaaaaccatagctcactgcagcctcgacctcctgggctcaagcaatcctcccacctcagccttccaagtagccaggactacaggcacgcaccacctcacctggctaatttttgtgtgtgtctgtgtggagatggggtctcactgtgttgcccaggctggtctcaagttcctgggctcaagcaatccttctgccttatcctcccaagtgctgggattacaggtgcgagtcaccacacctggcaaataatttttaaattataaatttaaaaatgcatttttataataggtacctttaaaaatgttaatagacttttttttaagaacagtgttaggtttatagaaaagctgagatgataatacaggaagttccagatacctcatacccagtttcccctattattaacatgttacatcagtgtggtacacgtgttataatgaatcagcattgatgcagtattattaaagtccatgctttatgcagattctcttagttttcccctaaggttctttctctattccgggatcccatccaggaccccacgtttcatttagttgccaagtctccttcggctcctctgggctgtgacagtctctcaagtctttccttaattttgatgaccttgacagttttggggaatattgatcagagattttgtaagatgcctgtctattggaatttgtggtgcctttttaataagtatgcagtggctcacacctgtaatcccagcactttgggaggctggggcaagaggatcgcttgaacccgagtttgggaccagcttgggcaacatagcaaaactctgtctctacaaaaaaattacctgggcttggtggcacatgcctgtcgtcccagctactcgggaggctgaagcaggaggatcacttgagcccaggaggtagaagctgctgtgagccgtgcactccagcctggttctggagccactgcactccagcctgggcaacagagggaaaacttatctcaaaaagtaaataaataagtacccatgtagttaaaatgtttaaagactagcaaatagatgttggctggtttgatggagaaagtaaatccattctttttcttaaaaatgatctcttcaccaccagtcccagcaccccccttaccagcctcccagggcactgtccatggctacattgtccatgggccatcatgtcccctcggcttctcttctggttgtaaatgctcttgcacttttctcccttgtggctgccgtccacactcccagctgccttccctctgcacttaagatctaagatcttagagacgagatgagacatctcttgccttcgtgcatctaagacagctcatcaacaggtccaggtgaactgctaacactgctgtgttgcttggaggcccctgtcccaccctggctgcctcagctttggccatggtacccacggtctccagctacatcagatgcctgaagaacaaatctctccttagctctccctgccccctctccaggaataggagcagtgggacccccttcaagaatcccccatttcccatatactttcctgcaaagccacagggcgtgcaaagtgggattccagggctccagcctgctccccatgggcctctggatccaggggtgactctttgcctgtttgggtgcctctttagattttccaccagcttcctgtggccaggagccagaccacgcccctatacggccatagttgtcttatcttgtctctgagattagaaggttggaacagattttcctgatgccccactacttctgacattctgtgactttagaatgttaccttcctcgacagccccctgcaccctcacacatctggctttagctggactggtgtttgtgaggaattatatctccaccttgttcagcaccagtccccaagaagaccagccaagggacactcatctggggatttgagaaatgaaggaccgtgggttccatgaggtctgttggggtcctggctagcaacactgtctggatgattgagccccaggaggaggtggcctggccagcaggtgtgcagtgaggccacttctagaccacccctgtcccatagagcttctagtgatgatggaaaccgtgtatatctgcactgctccaaacagcagcactagccctgtgtggctgtggagcacttgaaatatgactcatgcaactgagaaactgaatttgtaattttatttaatttaaatgtaaatagccacatgttccttgtggctgctgcactgcacagcagcagactgttgcgctctggaatccagcctctcagcctttactctccaaagcgggatagtattcacatcagagccaaacaatgcacagacgtcaataaacaggcagggcatggtggcccatgcctgtaatcccaacactttgggaggctgaggtgggagggtcccttcagcccaggagttcaagaccagccaagcaacataatgagaacccatttccacaaaaaaaaatttttttaattagctgggcatggtggtgtgcacctgtagttccagctacttgggaggctgaggtgggaggatcactttgagcccaggaggtcaaggctgcagtgagtcgtgattgcaccatgacattctagcctgggtgatggagtgagaccttgtctcaaaacaaacagctaaacctacatcaataaacatctgtaaatatcagggtagcgaatgaggacttggtgtctggcagttagggactggcctcttattctgccacatactggctctgtcattttgagtggatcactatcctcttcacacctcagtttcctcatccgtgaaatgaagataataatagtgcctactatcaagaccatcctggctaacacggtgaaaacccatctctacaaaactacaatatgaaatacaaacaattagccgggcgtggtggcatgcacttgtagtcccagctactcaggaggctgaggcaggagaatcgcttgaacctgagaggtggaggttgcagtgagccatgatcgcaccactgcactccatcctgggcaatagagcgagacttcatctcaaaaaaaaaaaaattgtgtctacctcagaggactgtaaagatgaaatgaaataatagacatataaagctcagagctccagaggctggtacatagtaaaggtttaatccatgcagattgcacgttctctttggggacagtacagctggaggggagtactgtcaaatgaggtcgcgtcgctgaggtggagacacattgtggcacatcttgaatacccgactgggtcccagctttagcacttgacattggcggccacctaagttttggagaggggtatgacagaggaggtggtgtcccagggggaaggtccggaaactcagaggagtttcctgctgtaattttctttggtcacacaatggtcatggcctcctgatgtttcccacaaagggccagaggcccttcagtgccaaggaacgtggactctctcctatcccagcacatacacgtgcttccagtaccttgtgatctctagccataagtttccactcacccatctgcgaaatgggaacaatgacgatgtttgcgtcctttctttttcttttcctacaatgcagggaactttaagactatgtgacagaaaggtgccactggaacccagggcctcgtgggtttcctccgtctctcgggagaccaggatccgagtgagaaagtttcccacgttcattcttgttgggcccattctcaggatgatgtttctcctgtattttgctaccccagcccaagcaagactagtagttcagctttgtgaatcccctcaggaagtcaggaaaatagatactgtctttgggcttcctccaggagctaagaaaggagagttcctgaagagcaggaatttaagacaggaattggcagccgagggcaaggttccacctcctcctcccttcttctgtggggtctgtgatgagagcagggatggggaggaagagggtgggtttgcctgcgcctggggggagggcagccatcaggaaggagcagccacctctgctggggtactggagataaaaactctgatattgactagtgaccgtgggggcgatggcccaggagggtcagggctgcagggaacagggacacaaaaacgacaaaacatgcaacaggttatgtccttctggtccagggcacggctgagacaggcaagggactagagagaggaagagtgaatgtcaagccccagcaccctcgcctccctcccatcctcccttttagggcctcccttctggcagatagggcagggagaagggaaaggaaaggcctgggacacgtggtttggatcactggctgtggctcacagttctgatgtgtgtgcagtttagggaaggaggctgaagacttcttgttaataagggtggggcatgagtaaaatggaggatctgccccctcccctcccagcccctgatacaaatgaaggatgattgtacatgcatggggaattccactttgggggtatccttttctgggctgctgccagactctgaaatgagtaacaaagggatggcccagggtgactcatcagctaccctctcgcaggcctagcacgctggcggggtgtgcatttcctctagagaagcccctccctgccagtttcagagggatggccctgaattggcttttcagaggttccttctcctcccttccaaagcgaagacccacagctgcctgaaaatgtggctctccgccttcttgggctgcctaggaccttgagagatgtgtctctctgggacagggtgtcaggtctgctggagattgttaaaatgctgttgtctcaggaagggtgaaatttagccaggagcagtcttcagtagcttggtctgtttatcgtgtatctagctgtcagcatgcaaaacaaaagaacaaaaggtctaaagaaatataacgcaaaacaggtacgatttgagatccatcagggtttctcaaccttggcacaactgactggataattgttcattgtagggggctgtcctgtgaattataggatgtttagctgcatccttggcctctacccacacacccccgtgtgccactcaaaaatgtctgcagaccttgccaaatgtcccctgggggcttggcggagttggggggtgcatggaatgcccccagttgagaaccactggcagagcaggagtgaagggggaggtactgtgggggtcactgggcacacagaatgccatttggggagcctggtgcaagggagtggccggatgggaggtaggaatagcagtggtaatcagtaggtgagttgctgaagacaaactaaatattctttccagcattgcttcaatctaatccagccgcaagtatgagtaaatactgtaggaaaggagaaaacattgcatgtacggggtcagggcagcattgctgggatatttgagcctgtgggaggggagcttcaagcttcccactagcattgggaggaacacagcaaaggaggagaagggccctccctgcttcttggagaatggttccactggcaggccattccgtctgctcagcttcctagctcaggtgcctttccaaaccacacatcagcagggagacagtgggaacatctcaggtccagggtaccttgggaactgcagagcagctgggtggcctgacactggcatttctcagtgttggctccattctcttgctggcacccccaggtgggagactctgttagcaggtgtatcttactatccctggctccctggtatgcgttacagttcagactcccaagcacaagctccctgttttgtcacacctgtatctagtgtgtaacaatccaccccaaaacaaatggcttgaaacacaaggcattttgttctctctcatggttctgaaggatgacggggctgagctgggcaactctctcccgctctctcaagtggttgcaatcagatggggatggggacagagtcatctgtaggccccctcaaccacatgtctggtgcccgggctgaagggtggatcagcaggggtccagggatctctgtctcttttgtggtctccccatcacagggacttgaaggtagctgaacatcttacagcagctcatgtcccaagagaaagacctgggagctgtctcatctttacgacctaggcttggaagtcacatagcatcacttctgccatatcctattcattgagatcaatgaaggctcacccaggatcaaagagaagggacatggagcccacttctagatggagagtggcagggttctggaagaacatgtgaaaccagaaacattgttgccaccatttttggaagacaccacgattcctcccctttgaataatggccttcttgtcctttaccagtaataacccaagctgcttggacattagctcttcatggtttgcggggtggggaggatgtgttttctgggacttcccaaggtacacagtagtgaaggacttcacaagctgggctgatgtgccagcttcaggactccactcacccccaagcgttctgagatgcccatggggctcaggagccctgacttgcacaagccagcaactgcctttctgcttccattcagccagctttactgggcatctgttataggaagagcagtgggctgagacttcagcaaaaaagacaaaagcaaaacacaatcccttctctatacaaggttcttccctttctgtgtccaaccagtccctccattctcggtccttaactcatcaccaagccgccattttcttctattcccccattactccaaggcgggcctcagttctcacctggagtctggctcaggatgcctacaggtggccccagaattgtaatggcttgacatgcaatttttcagctttacaatggcatgaaagcaatacacatttagtagaaactgtacttgaagtacccatacaaccattctgtttttcactttcagtacagtattcaataaattacattgagttgttcagcattttattttaaaacaggctttgcctccttagataattttgcccaactgtaggctactgtaagtgttctgagcacaattaaggtaggctaggctaagctatggtgttaggcagtgtcaacaaaatagtcaaattctgtgaaatatttaaagagtttattctgagccaaatatgagtgaccaaagcctgtgacaaagcccaaggaggtcctgagaacctgtgcccaaggtggttggtttacagcttggttttatacattttaggaggacataagttacaggcagacatcaatccagaaaggcgggacaacttgaagtggatggggaaggcacaggggctggagggggctccgagtcacaggtggattcagagatttttctgattggcagttaattgaaagcattaagttactatctaaagacctggaatcaaggccgggtgcggtggctcacacctgtaattccagcactttgggaggccaaggcgggtggatcacctgaggtcaggagttcgagcctggcctggccaacatggtgaaacctcgcctctactaaaaatgcaaaaattaactgggcatggcggtgtatgcctgtagtcccagctactcagaggctgaggcaggagaatcgcttgaacccagaaagtgaaggttgcagtgagccaggattgcaccactgcactccagcctaggagacaagagcaagactcgctcccaaaaaaccaaaaaaaaaaaaaaaaaaaaaaaaacgaaaacctgaaatcagttgaaaagtgtgcctgggttgagataagaagttgttagagaccaaggtttttattatgtagatgaagtctcacagagggccactctcaaaggcaatagatggcaaatgttttctattcagacctttaaaaggtgctactagatgctcagctaatctcttcaggatcagaaaaagacctgaagggaaggtgattctctacatcaagcttgtccaaccctcgtgctgcccaggatggctttgaatgtggcccaacacaaatttgtgaactttctcaaaatattatgagattttttttttttttagctcatcatctatcattagtgtcagtgtattttatgtgtggcccaagacaattcttcttcttccagtgtggcccagggaagccaaaagattggacacccctgctatagaatgtagattttcccacaagagacagctttcagagacatttcaaaatctgtcagaaaaatatattttgggctaaaatactttgatttctttcagggcctgctatctgtcatgtgatgctctactagagtgtggttggaatttggtatcttattgctaggaagagtctgttttgtgagtcttaagatctctgttttcagttaaggctggtcagctgtgcctgaattcctaaaggaggaggataaaatgaggcatgacggacctcccttcccatcgtggcctgaacttgtttttcaggtttaccttggaatccccttgactaagggggcacccattcagttagttaaggggcttagactttgatttttagtttacagtaggctgaggtgtattaaatgcattttcgacttgcaatattttcaacttctgatggatttgttcagatgtaaccccgttgtaagttaaggagcatgtatacttgtatctaatccactttgggcattgctgccagaaaacctgtcctcagggagctatggaagtagtggaggcaaattattaaatggatggattaattccaagttcagatcatgttgggagtcagctgggagtcagtgtgaggatctgggaggggaacagtaaggggttaagagagataccccaaaggatgattaaggagggagagttggaaggaaggtttcccacaaagaggaagcagggagtgattcattctgaaaaaggcaaatattttattatgcttggagggtctggtgcagaaggggaaaggaagagaaggaagtttggcttaaattcccttaggagccagttcagattcctaagctggcccggacatccaacccaatccgcctagccccagccctctccagttcccaatgcccagccccacaatgcccgtcctgctgcctgcctgttctggactctgcacttgaccttccctctccctgaaagtgcccctgctcttcctcacccagctccccgctctaagccttcctcgcccaccccagccctcctacagtcccagtctgccctgttcagactcaaagcctcatgctcaccaccatcatccacaaccagtttccacgtctgtctcctgccggctgtgagctcactgcctcagaaccagcgccagtctcctctagactgagtacaggcctggcacggagccaggaatgcaccaacaaggagcctgagactagattggaggggaaagagacatgtcctccagagttgacttacgcgaggacagaggtgtgcagaggcacggcaagctgggccccaggcgagaagcatggagtgagggatgtggaggcagcggaaggcatctgggagtctgggctgccccgtagcagctctgtgttctgcctgctcttcctccaagatgagctcccttggccagtgtgtgaaacgtgtgtgtgagtgtgtcaccggtaagctgagttctttccctacttggtatcagttgcaaagaaagaacactcagttggaaaaaaaggcaagagggttttattcctgaccaggagaaagagaaggagggggctcttgctctaaagacaccttcaccccgagccatggaaactggggagttgtaaggagataggtgtggggcagggaggtgtgtaagcaggtgtggggtcacggtgtgggggtggagacctctagacgctcaggcccaggtcataaacatgcctctccatacaatgcaagatgtgttaccagaaaggggtcctgatctagaactaagaaagggttcttggatcccgctcaagaaagaattcagggtgagtccatacagtaaagtgaaagcaaatttattatgaaaataaaggaataaaagaaaatctacttcatagagcagccctgagggctgatgattgcccatttttatggttatttcttgattatatgctaaacttcttgattatatgctaaacaaggggtggattattcatgcctcctctttttagatcacgtagggtaacttcctgatgttgccatggcatctgtaaactgtcatggctctggtgggagtgtagcagtgaggacgagcagaggtcactcttgtcaccatcttggttttggtaggttttggccggcttctttactgcaactgttttatcagcaaggtctttatgacctgtatcttgtgccgacttcctatctcatcctgtgacttagaatgccttaactgtctgggaatgcagcccagtaggtctcagcctcattttactcagctcttattcaagatggagttgctctagttcacacgcctctgacacatgttcagaaataatggtgattttcttctacaggtggggacgttagcattataatgacatggtaaagttctgaaggtaacaaggggttgcctgttccagtttctgccagttttgggggtcttatctccctctggtatctgggcagaggtcaagaagctctggcaccatcaggggccagcttgtttctttaagcagctgtgcctacaaataaagggactaaagaaaacaataagaaaacccagttatttcctgggggttgctctggtatccagcgtgttttacttcaccaagcgcaattcttcccagtgcaggcactgggtgtaactgtgacagccagcaccaacctgcccacacacctcctgtcctgcaggactgtcagcagcctctgcactatagtgtgacagagccacaggtagctcaggtgtgcctcagcccagcctctcctgcactccccctcccctggctccccaactctgcctcacttctgtttgtgaaggaaagacagcagtagcggaagggaaagaaggagaaaatgcagagcaaatattatgctttcctcttggaaaacctccaggagctgcaaatattagtaatccagctgcatcccaccccccaggatgggctgggcctgtcacacagccaaccttcaggatgcagacacccaggctggggagcacagctctggaaatttactgacatggccctgaatgaatttatcttttcagtagaaggccctggagtttaaaggagtcattcataaggtctgtctgggagtgccttgtcctcagaggagggtctgggtgggttggagtggaaggaagggctggctacctggtgtgctctccgtgggtccccaagaaaggcagccctgctgggggcagtgaagcccttatccaggtcacgtgagtcttggaaggggaaggctgctgtgcttaacgattcaaaaacacaaatcaaacctcctttcccaaacaaattagaaggtgtggaggaagcttgaattcagagaggatttcccagagacccataggcaaaagtggcttaactgagcccagtgggtgtcccagaatgggccagagagaatgacactaaaaagtctttgaacaaatgagcaaatgaatacaggaatgctcatctgccataggcacaaacgtggtaaacgttccctgagagaactgacagcccaggggtgcagggagagaaacggtcccaactgcagactgggtcccaactgcagactcggtcccaactgcagactcaggaggagggaggctgttaaggggccgtctttccttctgttatgtgaggagaaaagcagggaagggacctcaaggccagcctctcccaggagctgctgttctcagccccgggatccagcgctacagggaagtgcaggggaggctccacagtcccggctggagacccggtcaggcctgggtggccactcttctttgtagtggccaccctcgtgtcaccagcaaatgcttttgtatctacacccttctcagtgctccccctcttttaaaaaatgtactttctttttttaaaaagagttgggtcttgccttgtcacctatgctggagtgcagtgttgctgtcacagctcactgcaaactccacctcctgggctcaacccatcctcccacctcagcctcccaggtagctgggaccacaggcacacaccaggacacctcgcccagtgctcactatttacctttatttcttccttattcggacaccccttgcttccaaagaagagtttcggaaggctcaagacggtgagacagacaccttatgcactgcttcactctcccccgcagctcccctccctcctcactgacccccggccacaaccctctctccttgcccctcaccagccggcacccttggcaaccctggcaccctttcgaggacaagactgccaaatgtggccaaggtctggcacaccatgtaccaatcgaaactccacttcccttgagtttcagtttccacgcctataaaattagcaaatgaaaagagcaaacacttggagacactgttctcaatgctttgcatatttttttcatttaattctcagtgccatgagacagtctattattattaaacctatgttatatatgaggaaactgaggcacagagggagtagtttccccaggtcacagtcaggatttgaactccatggtctggctctagtgtttcccaaccattcggggtgggagtgggagagaaaccagactgctctccctagaaaacagcatgtgtttgcatgtgtgccaaatttgcacaaaacatttggggttccaggtctctaaagcccatccatggaaccccggtttcccttctctcacgtgatcctaacaacctgccgaggatacacctcatcatgatcctcctttcacagctgagaacacaccagcttagagaaattaagaagtgtatccaagctcacacaatcttaagtggccagatcaggaccaaaatccaggtcctctggctgggcgcagtggctcatgcatgtaatcccagctctttgggtggccaaggcgggtggatcacctgaggtcaggagttcaagaccagcttggccaacatggtgaaaccccatctctactaaaaatacaaaaattagctgggcatggtggtgggcgcctgtaatcccagctactcaggaggctgaggcaggagaattgcttgaacccaggaagcagaggttgcagtgagctaagatggagccattgcactccagcctgggcaacagagtgagactctatctaaaaaaaaaaaaaaaaaaatttgtggtcttctaaccacaaatctagtgcccctccccaaccacctctggtccagcctcttagatctatctgggatgtctttccaccatactcctttctggtttgagaaccacctgaaggctcaacgtggctgtggggtgctccgtggagccatttggcctgtgcccagcagcgagggggacagccagcaaaggtacccccgcccctgccagcctgccacctacttgggacgtttcttttctttttttttttgagacggagtctcgatctgttgcccaggctggagtgaagtgacgtaatctcagctcactacaacccccacctcctggattcaagtgattctcctgcctcagcctccctagtagctgggactacaggcgcatgccaccatgctcagctaatttttgtatctttagtagtgacggggtttcactatgttggccaggctggtcttgaactcctgatctcgtgatctgcccaccttggtctcccaaagtgctgagattacagggtgagccaccgcacccagcctactcgggacctttcaccacccaagtgaccagcacccctgcccagagtgccccggttctgtccactaggccagcagggaccccgcctctgggattgtttgctggaggggtcctggacaacgtagaaagggcagcacacagccctgggcaggaagggaggcaggaagagagatcctcaggggctgggctggaggagcaaagccagccaaaggggagtgagagggcagtcaagcgcctagaagccaaggaaccccaggaggatggcatcgggcaggtgcctcctggtgcccagagacaaaaagatgtgtgggaaggtgacagaatcaagcggtaaggtcagtgctttgagggagcaggcaaccaccagcctccagtgacacttgcctttcacagggatcctggaggtccccatttgggaaggtggaaaatctcagttccaacctaaccaaaagatacaggggcaagtttggccttgaaaccctggaccatctgccctgggtgatttcctttcaacagtgctgggtccagactcccagaaccctacctctcccatcttccccagtaagcctgctttcagtccttttcacacgagagcatttaaatccaagggttcccttccccctgggtatttgcagcccatctgatctctaaatgtagagtgagagccacttgtagaaattaagtctaggctggtcacggtggctcacgcctgtaatcccaatacttcgggaggctgagtcaggaggatcacttgagaccaggagtttgagactagcctgggcaacatagcaagacacctctacaaaaaaagttttttaattagctgggcatggtggtatgtgcttgtaatcccagctacaaggtgaggtgggaggatcacttgagcccgggaggtcaaggctgcagtgagctgtgattgcaccactgcactctagcctgggtgacagagtgagaacctgtctcaaaaaaaaataaaaataagaataaagaaattaagaccagatgtaggggagatttgtggaggaagggacaggaggcccctaaaatcccatcctgtaggcagcccctgcttgactaagcataaggctcgtggggcacccaggtgggctttttctggagaggaagcaaggcagaaaacccctccattttccatccccagcctctcaggtctgtgccagttgagtgtcttccaggacagaagcatggctgggtatggaggcagcctggatatagggatggccggtctgtcaagcccgtggtcaggaccttcacggggcagcttaggaacctccaggcagggcctcatctgctgccgttagtaataaacatggccagcaacagccagggccctgctagcgggagatgtcatcggtagccaccttccttctctgcagagacaccgtctgtcccatggatgagcagagtcccctggggacccagctctgacacttgtccttgctcatgtccagggtgctggacagactgaggcaggtgtcaggctcctgggatgagaaaggcagatgagagatgggagtgggagctttacagtgacttaggcagaattgcttagtatttacatatgccttacctcattccacagagaatttaaggcctgaccaaaagagacggggcggggggtgggggggagagaatacaataacaccatgtactgtaaagaaaaacagtcagttctaaaagaaaaacaacccagaaagaagggaatgtgtcaaaaccgggagaggggaaaaaaaaaggcatgcatgctttcaaaagcaccttaggggctacagatgggccctatacttagtgttgacacccaacagccataaaagaatctcactgtgcccccaggggagcacagggaaggtctgattctagattttttctgtgccatttatttatctatatcctcatgcacaagttctatactgttttaattgctgtagctttttatgtgtttaaacatctaatagaggtagacttccttctcttagatttttttctagctatgcttcatatttaatttttaaataaacttatcagaatcagctaagttcaaaaacaatttttaatcttattacctttttttttcttttttgtgagacggggtcttgttctgtcacccaggctggagtacagtggtacaatcatagctcactgcagccttgacctcccaggttcaaagtgattctcctgcctcagcctcccaagttgctgggacgatagaagcatgacaccacacctggctaattttttaaaaataatttttatagagacagggtctcacagtatagtgagatttcagggtggtcttgaaatcctgagggctcaagaaatcctccagccctggcctcccaagagctagaattacaggcatgagccaccgtacctagccctattgctatttttattagcattacattaagtttataggctaacttaagaggacatggcatttttatgataatgagtttttgcagtcaagaacgcaggccagttttttttaaatggggtaaatgattgtccaagcgcctccaggcaggctcacgtgcacactctggagtcagtgaagaaggtgaacagctgacaggagcagcctcccagtcagagaagccctgcacactgttgcaaacagacagcttgcatctggagtcttctgtgatccgaggaggaagcgtggctgagtccttcccagaagagggtctggagctgtgagttggggacaattgtcagattctagcagtgaaagtggttcatgtgcaggtgcaacctgccccgcagtcacgggacacagccacatggagccgagccacgctctcagagaaggagccagggaagaaacaccctaactgcactcctcccttcttctggcccccagcagccataggccctgggcccccggtgagatacccatagagatcagctcccaggcagcaggatggagggtgtagactggacatgaagaggcagctggaatgtatcgggcactcagctccagctcaccacgatccaggcactcaagttcccaagacaatagtttctgctctcagataaatggaataattaaggatcaaaaggttatcaacaggtaaccaagcataaacagattttttttttttttttttttagacagagtctcactctgtgccccaggctggaatgcagtggtgcaatctgggctcactgcaacctccacctcccaggttcaagtgattctcatgcctcagcctctccagtagctgggactacaggcgcgtgccaacatgcctggctaatttttgtatttttagtaaagatggagtttcaccatgttggccaggctagtcttgaactcctgacctcatgtgatctgcccacctcggcctcccaaagtgatgggattacaggtgtgagtcaccatgcctggcccataagcagattttgtacctgagcaggaaggctaagagcttgtaacaactgaacattccccccggagaggaaggcaggagttttgcttgtgccaagtgcactgttcagacagtcctctgaggtacaccaaggtctgagtagccatcccaccctcccctctgccaaaatttttgtgtgactggagagcagagccctcctccaaaaataaaatgagcacaaggaaaatactatttgcagatacataatattaaaaccataggtctttctttttctagtcccatccatatggcaacattccaggagaggcctccgtcactggaaggcaccctcaggggctttcctggagctaaaaacagtttaagccaaaagttatttgtagcatctgagttaaactcttcgtctcacccttctcgagctagctggcttattttatccggaccaggatataacagctctaaacaggctttgccaggaagagacgtcatggacttcaaccagggcacctgaccaggaagaaatcactgcaggatgatctgaaagagttttcataaattattttacgtaaggtagattctgaccttgatggggacagccaaggttctggaccctcagctgggaaagatgggactaagtctacaactgctgaggttgtagaacaggcttcttgttgggaggaaccctcttgtggacatgggccgtcgaggtggagtgagagaacaccgtgccacctggacgctgaaacaccattgagtcacctctgtttgaaatgcttgttccctggtgccgtaaagaaatagcacttgaacataaatttaatttactcagcaaggacatttttatactttctgtgaaagggtacactcaccaggagttttgccacgagagtacaccaaacaaaggagacagggtcatttataacctgacgcgtccaccctactgctgtgtccagtttccattggctggaacaggacctcccattctgtatttgtcccgattggctaacaacttagaactttttaaaagaggcaaaggcagaggagaacaaaggaaggaggaagtaacttgtggaatgctgagaaaggtaaaaacacctttagataaggaagaggaacaggctatgacctaatgcttgcttggaccagtataagcatgccagggaaaatacttaggctaaattgtgggagctaagaacataaagtacattgatttctttatcatggctagcagatatttaagaatgttagcacaggtctttgaataaattttgcttctaagagaagttactatttattcctaattaaatggggaggaaggtctttgaagagaaacctttacacctcttaaggacaaaagtccccaagacctgtccaatttcgaattcaattaggtgaattcgaaattgacaccagcctctttgcagaggagactgttttggttatacatcaaaagcctgtgctttgcagatagacctgacagccactaattagctaggagcgttgggtgatccagtccacctccttaaacctcagtttcctcaactatgaaatagaatgaaaatagtacctaccttggaactgttctgtgacaaggaaatgagataacatgataatgtgcataaggcttttagctcggggcctggcacacctaagcctttgtgtaatcattgtgtagatcttgtcactgagaacgcttacacgagcagatattaaaataaaggaaagaagtcagttgggtaagggagcttcccagcttggttcaaaatattttgctgattggggtgagggaaagagtgaaggaaccagaagcaaaaaaagtaggatttcaaatgcttcccacctttttagaaatcaagacattctttagtggcctctacatctccttcaactccagaatttggaaaactgatgaaaaactttttgaatctttggctgtaaaatgtatatatatatataatgtgtatatatatatatatatatatatatatatttgagagggagtctcattcttgttgcccaggctggaatgcaatggcacaatctcggctcactgcaacctccgcttcctggattcaagcgattctcctgcctcagcctaccgaatagctgggattataggcgcatgccactatgcccagctaatttttgtatttttaatagagacgggatttcaccatgttggccaggctggtctcaaactcctgacctcaggctatctgcccgccttggcctcccaaagtgctgggattaagaggcatgagccaccatgcctggcctcttttatctttttcttttcttttcttttctttttggggggcacagagtctcactctgttgcccaggctggagtgcagtggcgtgatcttggctcactgcagactccatctcctgggtttaagcagttctcctgcctcagcctcccaagtagctgggattgcaggcgtgagctacaaggctaccaactgactgactcaggggatgtgtctccgcttaccatagatctgtcattagcgtatataggcctcaaagagctgtaagcaaccatgtctaagtgctaacaggacaagctaggtcaggaactctcaggatgctaagtcatcgactagaattcaaagaattcagtgagcttcagctggtcctgctggctcacgcctgtaataccagcactttgggagtctgaggcaggcgatcacctgaggtcaggagttaaagatcagcctggccaacatggggaaaccctgtctctactgaaaatacaaaaaattagccaagcatggtggcaggtgcctataatcccatctacttgggaggctgaggcaggagaatcacttgaacccaggaggcagaggttgcagtgagccaagatgacaccattgcactccagcctgggtgacaagagcgagactgtctcaaaaaacaaaacaaaaccaaagaattcagtgaacttcaataacatatatatatgttactgatatatataacaatattacatatattacatattttatatatatgtgtgtatatatatatatatatatatttttttttttttttttgagacagggtcttgctcttctgtcacccaggctgagtgcagtggcatgatcacatctcactgcagcctccacctcctgagctcaaatagtcctcccacctcagcctcccaagtagctgggactacaggtgtctaccaccacacctggcaaatttttgtatttttttgtcgagacaaagttttaccatgttgccgaggccagtgtcgagctcctgtgctcaaacaacccactgaccttggcctcccaaagtgttgggattacaggcgtgagccgctgcgcctagtcttcagtaacatttttaataaacctgtcaattggcgaaaataaatccaacagtgaattaaactcctttgaggctacttcccattattgtcatgggaaattgtaggaaagtgcacattccttaagaatggagtaaacttcctcatcctcttcccaggccccctcccctttgtttgtgttttgtggtgaagatgacccctccctgcaaaccatctgggtgctgttgctggcatcagcttgcttctaactgcatgaaatgattgtggtgcctgctgtgctgagaacctagcactggcaccaaatgggtgccgagtgcttacacacctgctctcattatgcctcacacttatccatgtcatgggggagggttctgaggctcagagagggaccaggctgcctggccagctgcccacctcgttgtgcccatccttgtctaccccttgaagtgacctctgcccctccgcacagaaacccttcgggacagtccagccttctgcctctgactcagggcttttccatctgcactgctccgtacttacttcctgcgactgtactccctgccagagcctcttttcctggctctgaccttcctcctaggaggcgtgcaacgtttgtccccttcccatctagcactacgttttctttctctcactcaaactcccctttatatatttgtttgtttatttatttagagatgagggtctccctctgttgcccaggctggagtgcagtggtgcaatcatggctcactgcagccttgaaatcctgggctcaagggatcctcctgccgcagcctcccaagtattcgtattatagctgggactccaggtgtacgccaccacacccagcccaaactcccattcaaagcctgtgtgctcagaagcctctgcagctgcgctggtttcattctctcactgtggagcatctgctgcgaatcaggtgcaaggctgggctctgagggcacagttcagccaccagagttctgggtctttcagggaatgaaatttcccatctctgcccaaccacaacacagcaaaaacatttctccctttgcatttccctcaaaatactaggttggtgcaaaaatcacaattacttttacaccaacctaatagcccccaaaccctctgacccaaccctcatatgggggactgcctgaaacttcactctgtctattcacaggttgtcttaggctttaagcccctggaggtggagacaagatttttaacatcctcctggttctaagaccctctgataagagctccttgtgctgtgttcacaggtgactgctggctgctggcagccattgcctccctcaccttgaatgaagaaatcctggctcgagtcgtccccctaaaccagagcttccaggaaaactatgcagggatctttcacttccaggtaacttaatggttggctcaggtggttcctcaacaggtccagggggctaggaacagtcttctggcttggctgggttcatcagtccctggtgtttgcagactcccaagaccaatactgttctacaaaggacattgggcgagagcaggaagcttcctggcttacccgtggccaggatgtgagacccggctgggatggccctgggtggtttcttgggacatgtaaaagggaggtagagcaaggtgttcaggaactaattcccaagtttaaaaaaaaaaactgtattatttgatgtttgagacaaaaacgttgaagttctcctccttttatgccggtaaatgagaaataatacttgaaaaagctggctgggcacggtagctcatgcccgtaatctcagcactttgggaggccgaggtgggcagatcatttgaggtcaggagttcgagaccagcctggccaacatgatgaaaccccatctctactaaaagtacaaaaatcagttgggcgtagtagtgcaggcctgtaatcccagctacttgggaggctgaggcaggagaatcactttaacctgggaggcagaggttgggaggccaaggtgggtggatcacttgagcccaggagttcgagaccagctggggcaacatgctgaaactccgtctctactaaaaacacaaaaaaaattagccgggtgtggtggcacgtgcccttaatcccagctactcgggaggctgaggcaagagaatcacttgcatccaggaggcagaggttgcagtgagccgagatcgtgccactgcactccagcctgggcagagcaagacttggtctcaaaaaaaaaaaaaaacagcctaaggtacagggcagaatgctaaagaggcgggtgtggatttgaaaggatggacatgcgcctctgtcttcgcttttttagtgaggacttggcctgcataggagagttaagggagcacctcctcccaggatgcgctcatggaacctatcccaggggatcagggcaaggggagccagaggcagctgaggctcagagtcccagtgctgccaccagctcctcctgcagcccacctctcttgttctgcagttctggcaatacggcgagtgggtggaggtggtggtggatgacaggctgcccaccaaggacggggagctgctctttgtgcattcagccgaagggagcgagttctggagcgccctgctggagaaggcatacgccaagtaagttgccatcctcccctggccccatggccttcccccaatgccctggattccaaaaaattcactcatgcctgtaatctcagcactttgggaggccgaggtgggtggatcatttgaggtcaggagttcgagaccagcctggccaacatgatgaaaccccgtctctactaaaaatataaaaatcagtagaactactccaggactactttgagtgggaagtccttttctatagaaggacttctttggccaaaattaggctctaaatgcaaggagatagtgcatgcagggtgcctggctgcactgtacgctgataaatgatgtctatcaccatctttaaccaaatgcacaggaacaagttatggtactgattgtgctggacttgagaaggagctctacttccttgacaggacacatttgtatcaacttaaaaaagcagaatttttgccaatgggcagaactattcattgcagaggtaggaaacttgcccagaatagatgatgtcactgattagcaatggcttccccatctccgcacagctgcttcccacccaggttgcccacagttgagtttgtccagtgctcagggctgcccactctcagtaagaagccccacaccagcccctctccacaatggccccatgttggctgtgccgcccggctccttccattaaagtgaccccactttagagcagcaagtggatttctgtttcttacagtcccaatccaggaaggaggagtcagctgtgagaacctggagcctgacggatgcttctaagtcccactgctcaatactggggtcagggaagccaccggactccagcatcagcagtcaggagcactaagcccttgccaacaccgtgcctgtttctcagagaaactgcttccattattgaatggttgtccttttttaagctatcaatgccaaacgacccattagtagacctcccctttcttgtcaggatgtagaaggaatcaatacaggaggttcatccagaaaatcactaaggtccttccgactctaaggttctacgagaatctttttttttttttttttttttaatacggagcctcattctgtcacccaggctggagtgagcggcatgatctcagctcactgcaatttccacgttctgagtttcagcaattcttttgcctcagcctcccaagtagctgggactacaggcatgcaccaccatgcccagctaatttttttgtatttttagtagagatggtgttttgccatgttggccaggctggtcttgaactcctgacctcaagtgatccgcccacctcggcctcccagagtgctgggattacaggcatgagctaccgcgcccggcctgagattttctttaaaacacaaaataccagggaaatggtaactgtggacattataccttgccttcctgagcaccccgagctgggaacaaggccaaggagaatgtgagcagggggtccctggagcatcaaatctagacggtactagggggtggctgtttgagagattatagcatcagtagtgtcaagggtagcggcagcgtctaatcccctcttgtaggatcaacggatgctatgaagcgctatcagggggtgccaccactgagggcttcgaagacttcaccggaggcattgctgagtggtatgagttgaagaagccccctcccaacctgttcaagatcatccagaaagctctgcaaaaaggctctctccttggctgctccatcgacgtaagtccaggctgccttccctagcctcaccccatctgctcttgctgaagggaggctcccacagtgcccaagggaacccactgctcctgtgtacaacgtaatgcagccctcgtccacgtaggggccaaaggaaaacctccctccaccctctgaaggtccgctgaaaatcaactggcaaaaggaagactaatacaagaaatggcatacaaatgtatgaatgtggacaggggagaatcacaagagatttccctaccacgcattgggatacagagggttatattcccttcctcttaggggaagggagatggggaggtgcggatgattttagggatgtcgtaaatgatttttaggggaattcattgggcttaaagaacataaatggtctgggataaagtctgttgggcctgcagagcagacagtggtttgtgacaagtctgtctagccatgttgacagacttgtctttcttcctgcaatatgagttcagttcataataactcatggaaaggaccagacgtcattgttttcatctttggcaggtccagactttaggcaggtgagggaacttcagagaatagcttcctcctgtgctttgggggagagtggatcgagagacagaaggaaaggggaggtcagagagatcttgaggcttcttcagtttagcatttcaaagtgccatctcttagaggtattggtttctgagcaccccagtgtctaccattattgctcatcacctggaagccaagggttgctaggcaaaagtcaagctgtctggggtgtaatggatggggtgatggtgcctccagcccttctgtcttcagtccacttcccactcttagcctgctctgaatcacccccacccctctgaccacaggttccctgggagcccctgccacctgctgcccctgccaccttcccctccatctgcagtgctgtgcagccttcccctgcactcttgcagagctaataggcccgtgggagacttcggaaggaagaggaggaaagatttcctcataatagccttgctggcaacgctcaccaggggatgggaggtgggcactgtgcccaggagccttggagcaaaggctgtgcccaacctctgagccctgtcccatccaggttctggtctctgcgggggacagagataagaagccctggcttttggagccaaaatctaggtcagactccctaggcaggaattctcaaagtttatcagcagaacacgttgaggcagaagaccctttctgctccagcccttcttcccaggctcaaccttcatcagaatagataggggaaaggagaggctgtgaggcgttcttaaaacagaagcaaattctgactcagaccggaataaacaaccgtcctagtataaaccctacagctgggctgggccagaccacggagcatgggctggtggtggggcgagggtgtgctcagtgtccctgggccactcaaggctgtctgggtatcagccctgcgccatcgaggaccccctccggccctctctcggccgtgcgccctttccctgcgccatcgaggaccccctccagccctctctcggccgtgcgccctttcccgcccttcccagcctgcagaaatccgtggatgcgctattcacacgggaatgcctgtgctcgttccgcgagagggttgcattccgccttttctctggtattctcggcgttcaagcatttgaacggggtaggaaaggttctccaagtgcaagaaagcgcagccctgagcctcccaccccaggcctcggccgctgcgctagtgcgtccggcggtcccgcccggcagtaggacagagggagcgagggagtccgggaggaagggagagcgggtgcggccagtctgacggttgctgtgtttgcagatcaccagcgccgcggactcggaggccatcacgtttcagaagctggtgaaggggcacgcgtactcggtcaccggagccgaggaggtaacggccggcgcggatgtgcaggggtcctgctgtcctgacacgatggccacaggcacagtttgtggtgatgcccaggggcccgcgcggccccacggtggtccagtttacactcgggccccgcactcctgaagttccgcgcgggaggagaagggcgtccctttcgcagctcgggcgccgggtgcgccgcgctgccacctggtggccgcagtggccggcgccaggggccctggttttacttgttttagatgttaccctgttttacagttacaaccttactattttgataagctaaaaataataaaacaatgcatcttcatagtgttttatactctataaggtgctttctcttttgatctcgtaaaagtattcgtgcccatgttcaaatctgactgcctcttaccagctgtgtggcctgggccaattactggaactctctgtcccttagtttcctcatttaaaaaatggaaataatgataatatccattggaaggtcgtggcgattcaatcaagttaatatatgtaaagtgctcagaggtgactcacacatcatatataaggaggtagctgtccttgctgttgtgatcactgttgttattgaaaatattatgggctgacatggtggctcacacctgaaatcccaacactttgggagaccgaggtgggaggatcactcgagcctaggagttcaagaccagcctgggcaacgtagcaagaacctgtctctacaaaaaaaagttagctgggcatggtggcatgccactgtcgtcccagctactcgggaggctgaggtgggaggatcacttgagcccaggaggtcgaggctgtagtgagccatgatcatgccattgcaccccagcctcagcgacaaagtaagaccatgtctcaaaaaaaaaattatcaagcaactcaagttcactgttaattacagaacccagtctagaccgcagatcttctgcatgtccagtgttctttttttaaccttgatttttttaactaccccctcacacacacacgtctttttatttgaaaattttcacgtatacagaaaagttgaaagactaacataataactatccaattgccactcccctagattcaccgattgctaacatttgccatgtctgctttatctatgtgtgcactttttttgagccatatgaaagtaagttgcagacgttatgacacttccctcctcaatacttcagcatttattccctatgaataaggacattctgttacataattcctctactgttgccacacctaagaaaataacattaattcagtagtgtcatctattataaagtctatactaacattttcccagttgcccaaaatgtcctttctggcgacccaccccaaccccatccaggactcaatccagattcactcactgcatgtgcctgttatcaccagtgatctttcaacaaatggtaaagcttctctgagctcctttaccaaaagcgcatcctgtcagttaagctgaagttcagagatgaagcaccaacagccccatcctcgagagccggatcctgggagctttaaatctcattttccaaagctaggcagcagtgagaggtctgggtgccaagccccctctagctcttgtgatcctccctcatacatggactcaacccccaaatcctccccaccgtcctcagccccatacctcctggctcatgcggaagggggttggaggcccaagccttcatagccctgacttgaactcaacctcttactcctcccttttatctaatcctgcaggttgaaagtaacggaagcctacagaaactgatccgcatccgaaatccctggggagaagtggagtggacagggcggtggaatgacaagtgaggagggcgcaggcctcggggccccaggcgggggtgcattgtgctgggaggctctgggaagagggcgagagaagaagacatgtgcattattctgagaaatatagccaggagagcccaggccacgtggacagggacccgtggacaggggcccctcaaagggtcttttaaccaggacactcctccagcagcctgagtgccttcttccaggccccaagctgctcgtgtgaagttcattcctgccactgcctccaggttcaccccttccctagctcaaatccacccttctatggggctttcagggaaaaaaatacaccccaccttcccccaggcacttctattacagggatgtgaactttgtaccaaaggccagagaaacatccctctgttgatttccagggcttactggtaggcatgttgaaccctcaactatttggggtaaacacttgtttgtacatctgctgtggcaacctcagcctacttgctctgcctcaggttggagaggtgggcagtacagaggcctgtgtgtaattccagccaaagctcaggcagtggttagtttaccctgtgcactgcccctgtgtacagggccaggtccttctgctccgtggacagagagacacctgctgaggcttcccaggcctcagccggaggctcctcatcagatcttcagttgtctctaaaagagctgccaggcccatctcaattgggcaactgctctgagctactccatctccctctaatgaactatgttcattttctggactcttccttgccactgtcttccagcacaactcacccgctcactttgctccctggtttgcatctgtatagtgttctatactctttaaagtgctgtaagagtattaaaatgcagctgttagccagatgtgggctactttccccctttctggagcctgagccctcagaggtgagagcagatgtccctcttcctcaactctggggcctttggggagaaatcatcgtacactaacgcctctctctttactttgttttccagctgcccaagctggaacactatagacccagaggagagggaaaggctgaccagacggcatgaagatggagaattctggtaagattagtggaggcttcagggaaagctctgtctgccccaatgttctttactagaaaactgctaattagaaagagtgtcggccaaagtgagtttaccatgtcgaggacacaagcgtgtgggatcctggttttgttattttaagttcactataagagcctgaataaagaaattcttaagccccttcaacggtccatcttgacaatggggtttataagctgagcagcttcagaaaaaggctaagaggaattcctttggtaatgttcagatcccaggaaacaagggaaagatggggcctttctcccccaggttccggagactcatcccagccccttaagaaactggtcccttagtgagcagcaatggacccacatgtctgtgtgtctgcgccactctataaccacctgcacctggacacaacatgctctttatcaaatggggcccatatattgtcacatttgatgggcacggctcccatttttgcaggtgagagttctgagcttcagagaagtttaagtaacctgctcaaagtcacccagctagaaagttgcagcgccaggactggaatctgggccttctgattctgaacctggtgcccatccactcagttctaatgagctgctctgcctggctttgggtggctcctggtctggtgttggtggaaagtcaaggcttaccagtgtgtcttcttatcacctgtgatgattgtctctgcttttgccaggatgtctttcagtgacttcctgaggcactattcccgcctggagatctgtaacctgaccccagacactctcaccagcgatacctacaagaagtggaaactcaccaaaatggatgggaactggaggcggggctccaccgcgggaggttgcaggaactacccgagtaagggctgttgcatataagggctgttgcaatgcggggccaccaaaggccaaagctccccttaccccaccctgtgtaccacaccccagcctagcagccccaggaggcagctcctgctcactggaaccctctctgtcttctttctccctgagccttttcttttccctgagccttttctccccgagctctctttctcaatcccttacctcctgccctacccaggacaaacccaagagccactgtttctgtgatgtcctctccaggccctagattccccagcgcccatcatgaccttcagcctgaccttccgccatgctcacggaagcagtgctcaatcccacttcacggccatgagctgctctatgcaccccacacccaggcagccgagcctacaagggaaccttgtcccggcacccagggagccctccacatatcaggccctgtttgttgccccatactcacttcaatcagcaaatgttgactgggcgctgcccagatggggtgaagatttctcctctggtccagcctttgttgagccccttgattcttctgccttcatggcttagtccgtcagcagttgtctgaacatgatgacatctgccaattatggggcacaccttcagtgcttggaactatcctaagtgttttgtacacagggtgaggatccataatctgaaaatgtgaaatctgaaatgctccaaaatccaaaactttttcagccccaacatgataccacaggtggaaaattcgacacttgacctcaggtgacaggtcgcagtcaaaacacagtcaaaactttgtttcatgcacaaaattattttaaatatgctatagaattaccttcagcctatgtgtataaattatatatgaaacagaaatgagttttgtcattagacttgagttccatccctaagatatgttatgtatatacaaatattccaaaatccaaaaaaatccaaaataggaaacacttctggccccaggaatttcagataagggatattcagcctgcataacattctatctaaccttcccaacaaacttctgaggcaggcactttcttatcacctccatctctaagatgaggaaactgaggcttggagaggctagtgacttgctgaaggccacagagcgtgctgggatttgaacccaggccccctgactgaggagtcactgtgtaagtacagtggcagcagatcatggtcacatagtgattctctgtgacagatgaggaagctgagcctctaagtcgcataccagggccacagagcaagtagtcagactgcggctagctggcctacagttctggggctcggactccttcacctcaagtatgcagccaccaagtggcagtcccagaggcgctgggaaggccctctgccccccacaagggacccctcctacccactagatcaggagtcggaaaactccctctaaagggtcagatagtaaataattttggctttgtgggccactcagtctctataacaacaactctattgctataacccaaaggcagccatacttaagcgaatggccgtggctacgttccaataaaacgttatttacaaaaacaggcagcggccttcggagccatagctgccaacccctacacaagatggtgcctgtaatttcacagttagggttttatcccattaggtatggaaaggcaattagcataattccccttaaacatgaatgaatcttagattttttaaataaataggttttggaagtaaagagggcagagacatcaggagcagggcaagggaataggcctgagaggacaagggacgcagaacaagaaagagtctggaattatacacaggatgttcttggcctccgggctcaccgagggggcggcgaccggcaagtgcagggagcagatcccggagtcccccaggccagccgagccccgccccaggctccccatcagagcccagtgaagagaaggtaccatgaggggaagccacagctctaaccaccctgcgttccagagtgacagaccagtccccaagacaagccagcctggagccagagagagaactgcaagagaaagtttctaatttaggttcctgttagattcagacaagtgcaggtcatcctctctccacagctaccgtcacccgtctccagcctaacaaagcctgcagtccacactccaaccctggtgtctcccacctcctagcctctcccaacatcgcctgccgtctctgaccatcttctgccatcctctgccatctcccaccatctcccactgtctcccacagcctcccaccgcctcttgccaactcccaccatctcccgccattttctgacatctcccgctgtctcccaccatcttctgccatactctgccatctcccaccatcccccaccacctcttaccatctcccaccacctcccaccatctccctttatctccatccctctcagaagcctccaagcctgagaccagggccaccccccacccccatgcattcctgctcagggctgggctcctctgcccctttctggctgcagacacattctggatgaaccctcagtacctgatcaagctggaggaggaggatgaggacgaggaggatggggagagcggctgcaccttcctggtggggctcattcagaagcaccgacggcggcagaggaagatgggcgaggacatgcacaccatcggctttggcatctatgaggtgcagagcgcaggggctcctgccctcccttccccatgtgttcatctcagcccctgcatggaaagctgaccccagaggcagaactggggatgggatcccagaccgggagcttggccaaggaaaaacaaaactaccagcctggccaggctcaggagtagcccccgtagggaggcccctgcagtggctctgggttgtggggccttctaagcccttcacgggccccccacagccagcctgcagggagttccactctcaaatggcctccacatcccttctcacatcctccaggcctggcattctggtcagcctacccatcttcaaagaacagaatatactgggccacatcaggcaatactgtgagggcaggactgagtccatgggtgcagctgctcagagctcggcaaagtcattggcctggatggtggagagcttggggacaggggaacattggtcatgatgctccccccagggctctgatggctggagcccagatccctacacagactcctgctgtatgcgtgttttcctttcactctgagccacagccagagggcagccgcattgcagtctcctctccgccctcaggctggggctggggcactgagaactcacccaacacgctgggcccctgggctctccccactcccttctgcaaaacaagaaagagctttcgtgggctgcaggtagccatgcgaggagagggatgaaaggaaggctttagggcactgactggggatgcatttcggtttgatgggctggagctggctcctcccggctcccaaagcccatctcttttctctgacccatgtctgctgaggtccttcagcagcctgaaaaatggccctggcagggacctgtttacaccatggaaagtggcaaatagtacaaatcagagcttccaccctctcccaagagccagtttcccagcacacccctgggagaatccagacgaggtgtcaggagaggaggctctgtgctcaccactggcaacgttgccacccatggaacactgacttctacctgctcacccacctgagaaaggcagctgggcaaataccatcagttgtaaaaatgcacataggcctaaacccctccgtctctgaaacaggagctgaggacttcggatctgggacagaatcgatccaaggacaatgcaaatggaattgtgatacacagcttccctcccaccggcttatgggcttggaaatgcagccacgggctttcagagttgggacggaccttggggatcactgggtcctatttttgagacaagaaaactgaggccagagaggagaggggacttgctcaaggaaatgcagaccggaccactggacctggctgacagaggccggcactgctggctcctagccccaggtgtatttcacctcgcctgctgcctcctccaacagggcccgcctggccctctttccctgcgtgggaggccgatatgggctttgccaccttagacaagtctcttcacatctccatgcctgagatttatactctaagttaggaagggaggtgagggcttatcaacataagaggattttcttcagtgttggagaggctttgagttccttggaaaacagttactcggttgaattagttgatattgctaatgctacagagaaaacgggggcagcggaagagaagagcacagtgatgcattttcttacactgcttttccggcatctgaattgcatctcctttattttgcaggttccagaggaggtacgtctggcccatgtcccggggtgctcaggtcaccaaaaaagcgagaggcttagactgctggagctcagggagcgtcgtgaagcccgggcaggggctggtggtcatgaaggatgagtcctggccacccctggggccctgctgaagttgcccaggctctagatcccactggtctaagctctgggcaaggtttctggaaagtccttgtgggacccgctgcctccctgtgacctggcagagcccatacagggtttggttctgggcagaaaatccatgatcctgagactgcaggaggcttttcacaaagttctttgtcactcttaggagaagactgagtcagggaaaaggtgaaccctgcagactgtactagaagacaacgcgggagcacagaggagaccaggacccaattcccaggctgtgtgaccttggacacgttacagctcctctctgcatttcagggttttgttttttttttttttgatttttggtttgtttgtttgttttttgtctcgctctttcacccaggatgaagtgcagtggcatgatctcgactcactgcaacctctacctcctgggttcaagtgattctcctgcttcagcctccccagtagctgggactacaggcacgcaccaggatgccaggccaatttttgtatttttagtagagacggggtttcaccatggtggccaggctggtcttgaactcctgacctcaggtgatccacccccttcagcctcccaaagtgctaggattacaggtgtagccaccgtgcctggctgcatttcagtttatttttcagtaaaactggtcaaccatccacctcactgcactaccgtggaatgacttaaattttgcgagagcatttgggcccacagtcaccgcttgctgaagcagatgggatgcctggtccaaggtcacgattattaaagtagacacacggggcactttgacccacctgtagtacatttctttcacagcaaggcagtgcaaccggtagcacatcgggctcttttagatgctgctccagccttggtccggtggatcatgcttggtttagaagctgggttgtctttctcctgcccccagtcctgtctttgcttttatagtgcatcatacaccacgtagaaccgagccaggttcctgccatgtggacgctgttcctgcctgagagtctcttagaggaaggctgggaacactgtggaaagactgggcatctctgcaggcggagctgaatggatgtgaaacccctgtgggcatgtgcttccgagttcctcagcaggcatttgtgttttttggtagaaagtttgctttttgttttttttttttttaagacaaggtctcattctgtcacccaggctagagtacagtggtgtgatcatagctcactgccgtccttgaactctcagactcacgtgagcctcctacctcagcctcctgagtagctgagactacaggcgcttgccgccacccctggctaatatttttattttttgcagagacaggggtctcactacattgcccaggctggtctcaaactcctggcctcgagcaatcctctcacagcctcccaaagtgctggtattacaggcgtgagccaccacacctaacaaaagtttgctttttatctaaaatgacccaggcattgtcactgtactgctatttttttaaaaaaattttgttgttttgttgttgttgtcgtcgttatatagatgagggcttcctgtgttgcccaggctggtttctgacgcctggcctcgcctccttatacaccaggacagcaggactgagccaccacactacccaactgcttttatctcagtgaatgaaaatgatacttgcctggaggcttcccctcatctacccccatgtttctctatttattcctcagttaagtgggcagaccaacatccacctcagcaaaaacttcttcctgacgaatcgcgccagggagcgctcagacaccttcatcaacctccgggaggtgctcaaccgcttcaagctgccgccaggagagtacattctcgtgccttccaccttcgaacccaacaaggatggggatttctgcatccgggtcttttctgaaaagaaagctgactaccagtaggcggtttggtcccttcctctccccacccttccctgtccctccccactggtctgttcctcggcccctagagggctctttcatcctctgaatgtcagttactttttctgtaacacctgcccacctcgaaggactagtgtggggatttgatggattgaggaagttctagtgttatagtaaggtaaacaatggaaaaagccactgtggatatttttggttggaaaggggtggctgtacagtgaattgcagggtctaatttcataagcgtgtctctgaattctcaagttggtactttaatgttaaactacgaatccagtctcgtcatttgaagaaagctgagcagtgctggtgtaatccttgattttccaggccacctggcctagcagagccaccaagggtgtaaggtgggaaccatctcaacggttcccacctccagaacctctccctattatagttgtcatgtcaccagctctctctccccttcctcatgggatcccacgtttgggaaccctttgtggctgacatcaccatttcctgccactgtccaggtggcctcaattcacaatggcttctgccactttgacttctgcctcaaccatgtatgttcagctgggcacttgattggcaaaggcagaatctaccctgggtgatttaagctaaagggaattcatcgaaaggccattggagactccagaactgatgggaggtagggggtcaggctaggaagaacaggagccaaggatgtgttggaggaccagggtgtgagatgaccccttggactctgggtcatgtgctgaggtctaaagatcttgtggagtgtgtctgaggtgctgggcttgggtcagccacctggcctgctggttcctgtagaggaagagccaatgggaggtagaggcagggaactgcccttgccccaagataatgcatgatgcagaaataatttcccatggcgaagggagacaaagcaatgccaggcagctgcataccaatgaatgccaccatagcacggctgtagcccccctgccactgacaggctgtcttcatttgctaaagcctaccatgggggaagggacctttcctctcagctctgaggatgcttagaggaagactggtgtgttcagtttagtcctcactgacaagaaaataggagcatgacctggtggcattagaataacagtgtcctttgtcaaactcattactctccctgccagccacaagtcactctcccagggaagcctcaacccctcaactctctctagggtgagctccctaccccaagaggacaccccacctctcaaaggtttctgacttccttgtcccaaaatattaatccttctgctccagattccaatgatcagcaccaagaggtccccttttccttctgccaggcattggccctgctgataggactcttggtcacttagttaaaatcacagtggcccaaggaagaacctcctgagcttgattaccctcactatggagcagaaggacctggccctggacacaggggcggtgcacagtataaactaaccactgcctgacctgagctttggctgaaatgacacacaggcctctgcactgcccacctctccaacctgaggcagaacaagtaggcgatgatttgcactgcatgattctcagtgtgaaagtctatgttggcaaaggatatttcaagtggaacttagaagctattccttaaggctaggacgaacaccacgctacacgcgaaggctatcctatttgataaagatcaaaaactagcaaacaaaaatctccagctgcccacgttgctttggtcatgacccttccttcagatcacttctgcctttatttttgctgtttaggggatgtgttatcacagaaacttggaatgcagagaaatgttatcacagaaacttggaatgcagaaaaatttttgctttttaggggaggtgttatcacagaaacttggaatacaaagacctccccccaccgcagccctgccccaccccacctaccccctgctggatttagcactgcacttccattttagcagtgatttccttcctttttgccctcgcctgccttccagtaacacataatttccttctatttccagagctgtcgatgatgaaatcgaggccaatcttgaagaggtatttgtaactctttgaatttcacccactctgtcctggacaatccagagagcagaggagcaaaaaaactccaagagtttttggacttcacgaacaaagcctgaaactaaggataaagccgggtactgggaatccaagagtcgactacctgcatcagctctggcctctgtgctgggggcatgggccagtcccttgcctattgggctgtgctagccactgtcaaaatccatccacaacattccagctagtctttattcttctgagtccccactagaatagatcctaaaaggccattttaattggatgctagagaagatacctctgtgagaaattagaatattactccttcccacataatttacattccttcttgtgttttaattagaaaaaaaaaaccttatattaattcttcacactatacctgatcttaacccaaatcaccgtagaatttgggccccagggaggggtagagaaggggagtgggaggtggctgccatggaagggcgggcagacacttggtgtcatgcctcgctctgatgcattctcatgtctctgcctcaccttccagttcgacatcagcgaggatgacattgatgatggattcaggagactgtttgcccagttggcaggagaggtaaatgttcccaaaaacgatgttatgcactctggttgatgcaaaggaagagacagtgtgtgtccccaaggggactttagtttaaaggggagaggaaacaaactgaacaaaagcaaagagaaattgcaaatggcacttgggttccagctcagccctcttgcgtgtgtcctccctaagacctccgcatgctgccgggggcttccatttgcatggtcagccctgactctgtgttcctccttccttaggattcctgggctcaccttgtgactgttttattttctctgttctacaccaattgaggcatgaaacttggccccttatccttgatttccacaaaggatttggagagatggaagggtttcaagtctcaagaatgcaggccacctgcaacagagtgtttgaattaggcttttctgttctcttttcttttttctttttttctttttagagacagggtctctctctgtcacccaggctggagtgcagtggcatgatcatagctcactgcagcctccacttcctgggctcaagagatcttgccaccttagtctcccaagtagctgggactataggtgcacaccaccatgtctagctaatttttattttatttttatttttgtagagatggagttttgccatgttgcccaggctgctctggaactcctgggctcaacaatcctccaaccttggtctgccaaagtgttgggattacagatgcataccaccatgcccagctaatttttaaattttttttagagacagggtctcactttgttgtccaggctggtcttaaacccctgagctcaagcagtcctcccacctcagcctcccaaagtgctggaattacgggtgtgagccaccatacctggccacttccctgttcttaaaaaaatccctcagccatttagtcccatcacaaagttatttagccctctttcttcccaacaactccaaaaaaaaaaaaaaagtcctctttcttcactatgtggaggaactttccaatcattgagctcatctggtactcccttcgctgacctaaagacccatcaaagtactaagccaggcatcgtctgctctgcgcctccaccggcctctcaccctctgctccctcccagattcccaaggaaaggggccatgagagtcttctttcccctctgattgaatcccacacatacacaccccaaaaggcaaacatgactgcaatcaatcttggttttaaacaaaggagtttatccatgagttacacaaatatgtgtaagtggatagagacatctgagcccatgaggggccctggcatgatgggcatagaggagggccggctaggtcttggagacagctggttttcaccagttttacaggaagtctgagctttgagttttaaagaatgaagaaaacatgccagataagaggaatggtataagagaattaagaaagaccacaaacatgggtagaggggagtatttattatttatattctctacagcaaagaaatggtgagtgaactctccctactgcatccgtacattaaaacaccgtatctaggctgggcacagtggctcacacctgtaatcccagcactttgggaggctgaggctggaggatcgtttgagcctaggagtttgaggtttcagtgagctaggatcattccactgcagtccagcccagcctgggtgttctaaaaagaaccaaaccaaaaacactgtatctaaaatccagaatggggcagtactactcaaagtgtggtctggggacagcagccccaacatggctcgggggcttgttagaaatgcacattcataggccccaccgcaggcctacctaatgcactggtgtcctgccctgtgctcatccagctcccacggggggccaataactatgctctggttatgtgtccacaggatgcggagatctctgcctttgagctgcagaccatcctgagaagggttctagcaaagcgtgagtatcccctcattgcaaaacctcatcctgctctttcccctgtggatgggagggaacatggaaatctttccccctccatgtctggctgctgtgactaaaccaccaccctccatcccctccaagaagtggatgaaggatttgtatgatgtgatgaaaaagaacaagtgtttgtagcatccacagatcaaagatcaaatccaggtttccactacatactagctttgtgtgatctatttttttaatttattttattttatttttgagacagagtctcactctgtcgcccaggctggagtaaagtggcacaatctcagctcactgcaatctctacctcccaaattcaagcgattctcctgcctcagcctcccaagtagctggaatcacaggcaagtgccaccacagccagctgacttttgtatttttagtaaagacagggtttcaccatattggccaggctggtcttgaactcctgacctcaagtgatccacctgccttggcctcccaaaatgctgggattacaggcatgcactaccacatccagctaatttttgtattttcctagagatggggtttctccatgttggccaggctggtcttgaacccctggcctcaagtgatctgcccacctcggcctcccaaagtgctgggattacaggtgtgagccaccgtgcccggccacatcttgtaactaactatttcttaagcaaaaaaatgtcagaggattgattgttcaaccccttactgtggatcaccagcagggaggagcgggaaacacaacacagagacattttttcccctcaaattatcaaaagaatcacgctgcatttgttaagagagcaactggcaatccaggaagcagagttttgaacatatcagaagttaggaatctgcatcagagacaaatgcagtcatggttgtttgctgcataccagccctagggatcatctcgagaagcctcatggacttcaagggacatcattccctctgacaagatggcctctagcctaactccatgagataaaataaatctgcctttcagagccaaagaagagtccagggccagctgggtcttccctcccagtgtgaaccaagagggctgggccagtcaggttacggtcagtccagtgcagggcctccccagaggagacccagtctgcacccgccctcctctaattttcagggaaggcaagaagattgtgtttaccctggaggccaccaggcacaagtgaggtcacagagctcttcagatatgcagtcctcatgagctgaggagactaaagcctcattgtttctgcacagatggagggtggggctgggaggtggggaagaagcgggccttgcctggattcagcccgctccttgctgggggagcagcattcgctccgcgcgtgcctctgagcttactaccctacccctagctgcctgctgactccagccttctggagggctccacaccagagtctgcatgcacagctgctgggccagagccttatgaccatctaaggggttggtgcccagagtggcagctttgaggcaggtcaggctctaacctctttcggggacataacaaaaaggctgggcttttcgtgaagtctgtggggagccaggttcacattggtgactagggagggtctcatgccacctgccaaacaccaagtggacaggactcacttagtgcagcacaaatagctcgtggatcgatcccagttcctcaggtttctcagtcagctggggacacagtccataaatgtctgcagatggacagttcaagtaaacctctttctctcacgggtcatagcctagaattaacacacctgctctctgttttctttttccctgcccaacaactacaggtgactttatatcctgtgggcacctaaggcccaaccattgatcattctgttatttatttgttcaaaaagcactttttaaagccctgtttgcccacggcaaatatacagagacatcaggacaatgtggacatcatctgcactgtcccagtctggtagtcactagccacatgtggctatttaatataatggaagtggcttctgtatgtgaagggcacagataaagaatatctccatgattgtggaaagttcagttggacatcaccgctcagagatttttcctgtcacactgattttgtcttttaggccaagatatcaagtcagatggcttcagcatcgagacatgcaaaattatggttgacatgctagatgtatcctttaatgtgctccagggaatagagactgggggagtttaaaatctcactccagaaagattcaaacacatggccttctcccttttcaaaatagccagttgttcccaacttgctgagttgctgtcggacagtcagcagcgctgacctcccttactagggaaatgcgagaaccctctgatgagggaaagcaaatgctacaccccccctcccacctaccctgaaaggcttagaatgcaggcccatggcgggcggtggctcatgcctgtaatcccagcactttggaaggccaaggtgggcctcctgactcacgaggtcaggagttcgagaccagcctgaccaacatggtgaaaccttgtctctactaaaaatacaaaaattagctgggtgtggtggcgggcacctgtaatcccagctactcaggaggctgaggcaggagaatcacttgaacctgggaggcggaggttgcagtgagctgagatcgcgccactgcactccagcctgggtgacagagcgtgactcatcgccaaaaaaaaaaaaagaaaaagaatgtaggcccaccagtccattcctggggctggtgcgggaaattcctgacaatatgcccatcacttctttgcacaaagcagctcgaatttgtttcctcagtgatgtgtttccattacttcctctaggaaaatattccctaaccacagtatttctgatgtgaatctgttttgtctgatcaagatcgtcgtcttctttatttatttatttatttattttttattattatactttaagttttagggtacatgtgcacaatgtgcaggttagttacatatgtatacatgtgccatgctggtgctttgcacccactaactcgtcatctagcattaggtatatctcccaatgccatccctcccccctccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgagccacattttcttaatccagtctatcgttgttggacatttgggttggttccaagtctttgctattgtgaataatgccgcaataaacatacgtgtgcatgtgtctttatagcagcatgatttatagtcctttgggtatatacccagtaatgggatggctgggtcaaatgatatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattatggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaatttgttggagttcattgtagattctggatattagccctttgtcagataagcaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggttttgatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttatcaaagatcagatagttgtagatacggcgttatttctgagggctctgttctgttccattgatctatatctgttttggtaccagtaccatgctgttttggttactgtagccttgtagtatagtttgaagtcaggtagtgtgatgcctccagctttgttcttttggctcaggattgacttggcgatgcgggctcttttttggttccatatgaactttaaagtagttttttccaattctgtgaagaaagtcattggtagcttgatggggatggcattgaatctgtaaattaccttgggcagtatggccattttcacaatattgattcttcctacccatgagcatggaatgttcttccatttgtttgtatcctcttttatttccttgagcagtggtttgtagttctccttgaagaggtccttcacatcccttgtaagttggataagatcgtcttcttgatttagataagggctactttcatgaggatcctacttcccttttgctctagctccttcccaggccacccacctttccccaaggcaaactagtcatccatttcccccttgtttccaatgcttagtgagaagtggtggtaaggggcagcctaagcttctgtgaagttttttctgtttgtttgtttagttggttggttggttttttgagacggggtctcactgtgtcacccaggctggagggcagtggcatgatctcagctcactcgaacctccgcctcccaggttcaggtgattctcccccctccagcctccctagtagctaggactacaggtgcgcgccaccatgcccagctgatttttctatttttagtagagacagggtttcaccgtgttggccaggctggtgtcgaattcctgaccacaggtgatctgcccaccttggcctcccaaagtgctgggattagaggtgtgagccaccatgcctggccacttctgtgaagttttatctagtggattcatggtgtacacctgctagctcccttcaccaaaggcctcttagatatactccacatactttaaaaaaaacagcaagggcctagccactagaagccatccaaagccctctgcatgtcatccaatacctcatttttagtagtatctggggcctccacagcacccctagatcaaaacagcaaccagattcggcagggagccagcaggtctttctcgcccttcctccaatcctttaaatggaggtttagccagtgggaaaagcaggaaaaggatccttctgcaaaccctccttgtgtatatgctatgatattcaaaagatccagttgagaagacaaactaggtgacactatgtgcaaatggacccacactcaagggctttccttgactgaaggcagtcggacgggagtggcaagctggggctgaaggagttctacattctctggacgaagattcaaaaataccaagtaagatcccagagatgcgggtggatctgtgttgggaaacattctgttcatatgctttaagatgcagcaactcctgcacagagtggagaaacatttccaaggggattgggattttacccataatgaagctcagagtgagtaaagatggggctgaggaaatgcaaacaaaaaaccaaccaggacttcgcaggtgaaatggcctattcccttcctcctgattattgggatcatctaaaggccaccatcaagggtttcctgaaaagggtttttgacagctaaagtacaaaaattatataagacaagaacatggacctatgggcgttggctggctgatttgatgggcatatttacaaaccagctcacagacagaagcaaaatactattagttatttaaggcagaaacataagtgattcttccacggccaaactagaggcacagagctggaaaaacttcatccccactcagcacatactagggaggtaacttgccagctttgctttgggtcatagttcttacagctaacttatgtgttccagaaaatttaccgagaaatcgacgttgacaggtctggtaccatgaattcctatgaaatgcggaaggcattagaagaagcaggtaaccctttataactgcattttcgttcctagtttaatctgtctgtagaatatgtgaacactcatcttataccatataacacaagatttggtaaagctataaaataaagtaggtgctggtttaatacagacacctccttttcattcccctttcaaagactaattggtaaaattaaatgcagtaggatgctctgccctctgtgccttcttgaatccaagtttcctttggagccgcctggcacagtaagcaggcaaagccaggtctcaacagcctcctccaggtgcttcctttctggtgcagggttggttaggcagaaatcaaatgtctcagctcagcccttagggtaagaccctagcagaattggatatcaataaaaggacacaagcgagtggtagaccagcaaagcaggagactgctgggctttgggaacaaatgtgtcagcatgaggctgttcattctatttgctggaatataatgctgctgcagagaccccacacaacattggtttatacgaggtatgtctttctgtcgtatagcaatcccagctccagcagtccacggctaggacggtgcctcctactatcctaccatgtcactatctgatcacgcttcccccagcctccccccatccatgatgcccaccggaccttcaagggtcaccctcatccaagggacctgggacagcctgccaccacaaacacatgccaccaacaggttgacagaagaagggccccttgcctttaagggcacacaggccatttccggtcacacatcccaccagccagactctgatcacaaggcctctgttgactgcaaggaagctgggacatgcagtcttgatgctaggtggccataggctcaataaaaattattttactctggaaggagagagaactactatgagtttaccaggaaagcttctgctcacatatatccaggaagaatctgatcttcaagacgattgagagctaaacaaaaaatcaaacagcagcagcatggttaacaacatgaagcaactgtgaccatgagaacagaaacaggcaagaaaacacttatgtgtcagcaaaggacacaggcagggtgaaggtggacagttcaaaaacaaaagaaacagcagaaggtactggctttgcaaaatcaaaccagtctcacagaagagcagccaagggacaaaagcaattatacctcatttaaatcaccacattagtttcatagcctgtgagcgcagctaaatggaacaatctaatgcttagcaatgagtttgtttgttcatgtaacttcaggtttcaagatgccctgtcaactccaccaagtcatcgttgctcggtttgcagatgaccagctcatcatcgattttgataattttgttcggtgtttggttcggctggaaacgctattcagtaagtggatatttggggaatgactcatttcagttctcttggtattaaagtggcctgcctttcacctcggtgaaatcatctaaactagagacatgtcttccaggagttgagaatgaaattccctctttactaatttgagggtgaggaagaaagcatgtatggtggtcagtgaagtcagttgctgaactgaaaagaggataatgtgatctgtttcagctcactcacttgtgacaccctctttttctccctccacagagatatttaagcagctggatcccgagaatactggaacaatagagctcgaccttatctctgtgagtcagcaggccccgccttgcttctaaggggatgggggaggcatggggcggaaagggctgttacttgagtgatctgctttttcaagttttgctttaaagagctcttggtctgtcggggccaggcctgtaaccggttgtaagatcccacaatgcacttttacttgcagttgttttccaaccacctattctcaagtccaaaatgcacgcctggctccctcttctcatgagctttgacttgagtgtagctcaaggttaaactaaggagtggctgcaggatcatgcttagaaaaatgaactcctgattagcatgcaagggagaacatgtttatataaagaaatccttcagctgaaattcaagttgggttttgggaagatccatcattcttagagtggatctacttaaaatactttaagcaaattagttttctctactccctccccgtttaagataaaaccaatactagtaaatacgtttgccatttattattgttattgcactcatgtgtctggaaccctagcaatacacatctctgaaatgatcatcaatctgaattaagtgggtatgctaatttcacaaaaagcaaagcgtaaaatgttctcgtgtcatcccaatgacaggaagttctctcactgaaagaaagaagccaggtggggtatacttccattatcacctggctccagtcagcatttcctctatactcagggaaggccacagagggccgggcgaagtggctgacactgggtgagaatggcagttgtcagtcctgtccgtgtaacagaggagtgaagtggtgaggagggcaggtctaaggcactggcagctcttttccatggattttgaactctggaggaaggcagcaactaaataactgtctcattctgctattatgcattgtattagcaaagtgaaaatatagtctatctggttacaaataacactaacttgcttaaaactttacatatcctaggaaatatctctacccctagattgcaatgtagagtcaaccccatctctaaaaaaataaaaaattaggctggccgcagtggttcatgcctgtaatcccatcactttgggaggccaaggcaggtggatcacctgaggtcaggagctcaagaccagcctggccaacatggtgaaaccgcgtctctactgaaaatacaaaaattagggctgggcgcggtggctcacatctataatcctagcactttgggaggccaaggcgggcgaatcacctgaggttgggagttcgagaccagcctgagtaacatggagaaaccccatctctactaaaaatacaaaattagccaggcgtggtgacacatgcctgttaatcccagctactcgggaggctgaagcgaaaggattgcttgaacccgggaggcggaggttgcggcgagctgagattgcaccattgtactccatccagcctgggcaacaagagcaaaactgcatctaaaaaaaaaattagctgggcgtggtggcaggtgcctgtaaatacgttactctggaggctgaggcaggagaatcacatgaacctaggaggtagaggttgcagtgaactgagatggtgccactgcactccagcctaggcaacaagagcaaaaccctgtctcagaaaaaaataaataaaaaataaaaaaatgagccaggcatggtggtgcgtgcctgtagacccagctacccaggaggctaaggtgggaggaacacctgagcccagaagtcaaggccgcagtgagccatgatctccccactacattccatcttgggtgacagagcaaggccctgtctcaaaaaatttaaaatgaaataaatagtagagtcaacacaactgtgacacgaaacatgccacatgttaagttctggaaatcctagcctgtcattcttgctggatatcctattctaccccagccacccacccccactccagggtccacctggcctgcctgctcagtccactccctccgcatctcctccgagaagcatcttcttacccactggcttttcctgccactcctaagccttaccttttgcaggttcctggagatcctcgcttctcgtagtctttgcaaggatgagccatgttcagaagctctccgttcagtctgcagggatttcaaccttggctgcagattccatcacatggggagctttgccaaagtgctggtgtcctgtctgtatcccagaccagttgaatcaatctgatttaaagtttccgtatcactacaacttagaaccaatgctgaacaccattggttgcagggatatccacatcccaaactaacttctgatgtgatactctgaggcagagatgtgaaaatgctaatttctgttgtgtgaatttcacttttcatgtgtgcaatcaaccctgtaatatgattcatggccacttaatgcaaatcacacagactactgacctgttaaaagctagactctagaaatcaggtaagaaaaatatgagttagtgcactgatattgtagccctcaatcagcttttccagtacaagttttttggaacaatctacaggtacttaaatagcctttaattttaaaagtggtcactgagctgacttttttttttccttcctcacagtggctctgtttctcagtactttgaagttataactaatctgcctgaagacttctcatgatggaaaatcagccaaggactaagcttccatagaaatacactttgtatctggacctcaaaattatgggaacatttacttaaacggatgatcatagctgaaaataatgatactgtcaatttgagatagcagaagtttcacacatcaaagtaaaagatttgcatatcattatactaaatgcaaatgagtcgcttaacccttgacaaggtcaaagaaagctttaaatctgtaaatagtatacactttttacttttacacactttcctgttcatagcaatattaaatcaggaaaaaaaaatgcagggaggtatttaacagctgagcaaaaacattgagtcgctctcaaaggacacgaggcccttggcagggaatatttaaagcaacttcaagtttaaaatgcagctgttgattctaccaaacaacagtccaagattaccatttcccatgagccaactgggaaacatggtatatcatgaagtaatcttgtcaaggcatctggagagtccaggagagaagactcacctctgtcgcttgggttaaacaagagacaggttttgtagaatattgattggtaatagtaaatcgttctccttacaatcaagttcttgaccctattcggccttatacatctggtcttacaaagaccaaagggatcctgcgcttgatcaactgaaccagtatgccaaaaccaggcatccaatttgtaaaccaattatgataaaggacaaaataagctgtttgccacctcaaaactttatgaacttcaccaccactagtgtctgtccatggagttagaggggacatcacttagaagttcttatagaaaggacacaagtttgtttcctggctttaccttgggaaaatgctagcaacattatagaaattttgccttgttgccttatcttcttccaaatgtactgttaaataaaaataaagggttaccccatgcaatcacaccatgccatgttttccttcctggagggcagccccacaggacggtttatgagcacacaattatagcttgtttctactttaacaaggtatgctgcctctgtaaattcatgtattcaaaggaaaagacaccttgcctataattaaaatgtggaactataaaattttttaaaatccaa

SEQ ID NO: 723 - DNA, 63602 bp, Homo sapiens
caggccgcaggatggcctggtcccgggccgggagcccagcaggccgggagcggctgaggccacaccccgcgggccgggccgcttccctccggtgaatcatcgctcgcagcggcggcgcccgcagtggccgcagcagcgcgccgggccctggccgcgccccagccgagcgcagcgcggagtcgccccgacctttctctgcgcagtacggccgccgggaccgcagcatggcgggcatcgcggccaagctggcgaaggaccgggaggcggccgaggggctgggctcccacgacagggccatcaagtacctcaaccaggactacgaggcgctgcggaacgagtgcctggaggccgggacgctcttccaggacccgtccttcccggccatcccctcggccctgggcttcaaggagttggggccctactccagcaaaacccggggcatcgagtggaagcgccccacggtaggaagcgcgcggcaggacgcgggcagggcggggtgccgggcagggcggggtgcaggccggcccgcggcgcgctggggcggggggcagcccgggtgctgcagtggggaagccgcaagccaggacctcgcagtcctgcgacacctccgcgccgccagagcccgggactctgttcgagcgtggggggactcccggggccttccctctcttccacccaccacgctttcctgggcgggtcgaggcgaatcactgccctcagatcccactagcaggccactttaggacttcacaaaaactcagggtgatgcaggaggccggggtgaaactttgattggactctagcggggagctggaagggaaggggaatcgggtctgcagggaagggacggtgagaggcagcatctaccagacaaagtccgtctccaactggggttctgtctgttcatggagggggacaggccatagcctggtcattttgtgactaaggatagtctcctgcagccctggggttagatttatttttccaaaggggagccagcgatacctcctcataacattgacactggtaattaacccaggacacggaggtgtctcatggtttccctggcgggaatcacccgggaaacctccgggagccctccagacccccttatcccgtcccccagggtctctgacctcccggccctgggacaacttgtgctccccaatctacttgtccattctgtttcttggggaacccctgaggctcctcctcctttgggacacttccccaggcttcccctaccacgcctaggaaagcctgccctgaagtccaacttctagattcctgttgtgagaacaaggcttccagctctgcttccacacccagcagcctcccaggtcaccttctgttaccctaaatccagcccataggtagcaagggctgcaggaagcgccctagcccagactcagagcacttgggttcttcttcttgctaacctgctggtgaccttgaacgagccatttaacctctctgtgcctccatgtcttcatctaaaagaaaacatgctgcctaaatattttctctcttttgtggcccactaggccctgccgtcatggcctcctttcagtctctcaaagagccggttctttcctgcatgaggccttctcaccagcaaggcacgctgttacctggagtgtggctcactctcattcttcccaacttagtcacatgttcccttcctaaagaggtcttttctgacccttcttagcagccacctccccaccttgtttttctctgtcaccccactcatttccttcatagcattgtcacagtttagaatataatcacatgtatttgttcttcctactgaactgcaggaatcatgtgtatattatttaccagtatatccccagtgcctgacacataaccatgcctttcacagtattcattcattcattcattcattcatttactcactcatttgacaacactgattgagcacctgttacatgccaggcactgtcctgagagctcaggagatacaccagtgaacacaaaagaagtgactgtttgtagaatatggatgcaggattgtaatgtgcctcaaatgaaattatggttgtgaaagtgatacgctgacctgactcagtgcctcacacctgtaatcccagcactatgggaggccaaggtgggaggatcgcttgagccaggagttcaagaccagcctgggcaacacagtaagacttgtctctataaaaaagtaaaaaaaaaaaaaaaaaaagtgaaacacaaaccaagagaatgtgttcactttacatttgcatggcactttacagtttacatagtgagttcacatactcattcacttattctttcattcattcagtaagcatttctcgaatacctactatatgctgggcacaatgcatatggtttctgcttctgaagacttacttctgaggctagtgaggggacagagacaggtcccccaacagttggaaatgcctgtgggacttccagatgaggatgtagaggtctagagatgatctagcgccactgcttagggcaggcgggctgtgcactgcacaactaaggaagagtgtgacttttacgatccccatttgccagttgaagaaattgaggcttgggaaggttaaatacttgctcagagtcaagtggatatagggcatagatccaggactgtgtgtagtctgtgcatgttgagcctaccccttatggctgcgctctctgcctccttcctaccttctcaaatgctgctgaggtcaggcaaggggagcacagttgtttccgctggatttgaacactagcaagtcattggtgagtttagcagagcaatttcaatggaaaggtgagagtagaagccagattgttgtagactccagagtaaaggaactggaaattaagaacatgatcaacttatttaagaaggacccccgggaagagaggagaactgataggtagagtaggacctggactttgagagcctgtgtttttttcatatgagaacaacttgaatgtgtcatatgttgaatcaccaggaagaagggattaaagataaaggcagggagggggcagtgaaacaggatccctgaggaagtgagaatacgggttgtgggcaggggaggggagcaggttagccttgcagcaggaggagctgctcttcctcggagagaggatttcacaacactggcaagagtggctccagtgcctggagcggggattaaagcagtaagtccagtggggtccaagggccatgcaggggtacagtgaggagaaagcaggtgtgatccgggtggcacatcagatccttccagcaaccagtctgttaggagcaagggcagatgttgtgagcccctatgtttcccccaagaaaatcaaacctctgagaggtttctcacttgcttatcttcagctggccgaactcagcctcaaacccatatgtcctgtctccaagttcagtgactgttatcatcaacttcttcaacagtaataataatagatcacatttatggagtgcttgccagggcatgtttacatcattatctcatttaacactcagaacaatcctctgtggtgggtgttttcatcgttcccattttgcaggtgaaaaaactgagacttcaaaaggttaagtgacttcccagggtcctacgacctacataataagtggcagagccaggattcaaacctaggttatcagaataatgcagcaaagcccaaaccctcagccccttttcactgactggtaagacccatatttaattcgatgccctacatgccgtgcacaagtttcagttttctgaagcatcgcttagatgcttaggtgtttagcaccactctgaactctgacttttctagagaggctgctaaaggcattagaaagtttctgaagtataatggaaaaaccctgctggagtaagtgcctggcacactcaggattatcagtgtgattctttataataaacaggctcccagcaccaagcccaatctattccatcagctggataagagctctctggcaggccttgggccaagctggcttcctttgcctcagcagaagagcattctgattctctctgccatccccaaaactgacaggagcagagagaaacaaggcagaggcatgaagggaatgtcctctgcggcagatggtgcttccggaagagctcccacaatctgagctagaatgaacaggggctagatccaagtctcatataggcatacttctgcttgacagagtgggcatgccgagggccgttgggtggaggcaggcgtgtgcaacccaagcagacatgagacgcagctccttcaaggcaaggttgcctgagcccagagaggctcaaatttgtgccccaacttcctctgtggcttttgggtggggctcttcagaatcgaaacacactcagagggctgctgaaagggctaagaagtgttcaaggttggcttccatcaggctgctcatgacaatggcccctgaggttttaacacccttgaacgcttggtactaaatcaattagaggcagggcaggagcagaaagagttggcgcatttgatcagtaagttccaatgccagtgctgtctattatctgtgaactgtgttaactttggacacgtcacttcacctttttgagctgtttcctcgtctgtaaaagggggataatacccattccatgaggtaaagctttgagcacagtctctgatgtaagcaggtacagaatatatagatgctgtaagtttcatggtcccatggaagaattcaaaagggttagatcccgcctgccctcaaaagggtatgtgttaggaaatcagagtaatacctaagtagtaaattgcagagtccagagactctgggactcagacttgaagggatgagtgaggattggactaggacgacttcacggaggaggtgacaatgagcctcaaggtatgatgcaatatggaaaaggagggaagagagtgggaaaggaaggaatttcatgcaagcaaaacaacttgcatgcagtaacagaggagagaggatgctaacccagtggatagggtggctctagagtgtggatggtctccacgtctggcagaaaaggctggacttgctgctgtggcccccgggacacagcacaatgaaggaggctccaggcagtccagagtgtgcagggtccaatgcctgcccttctcagacaggaccacccatccacccatcagggcccagggagcaggggtcagaaggacctcatgacacagagttctgactgtgatgacacactttccccagaggggaggggaaggggagaaggggttagaagaccccactgagaatggaggcatcctagctgcagaagcacctggctggtaggctaacagcactttgtgggtctcgttcccaggagatctgcgctgacccccagtttatcattggaggagccacccgcacagacatctgccaaggagccctgggtaagtgatagattcagagcaagctgggggatcttgtctgtaaggctgtgggtggaagagatgagggacaacctgtggcttctctcccttcccaagcagcttggcaatttctatttgcagagaagctccatggaatttcttggccctagcgggcaatgattctaccctcagccccatgctggggcacacaaatgaggcctcctgtgtcccctgcacagggctagttgctgaggttacagagatgctgccactaggaggaccagggggcttctggatgtcagccaccccttggtatgcacctcctggagccagcattaccagtggttcacgaaatacactctgggcagaggactaggtgggaggactcccccagaccaatgacagcactgagacatcagttctgtgaggttcaggaaccagggaaggtgactcagtgtaaagaaagaggaaactctaatgctcgctgctgaaggaagttatagtaccagggcattctcagtgtttgcaagacaagctcaccatggtatcacagttgtaacgctcatttaagtaaaatgaactggagtagctgaattgtccaaaaccttgctttctggagccgagttcagatttgtttctggagatagtccttgttgaaggtttcaacccacagggttctccacctttagtatgaaaattcccaaagcttctaggaagtcccagcaatggggcctggcgctgttatctaagattctcatagaatctgccctcaatgttcttttactcataataaatgtgggcctataattactagagcagattatttgctctgataaaccaaaaatctattttctgccatcagcctcagctggctggctccccagacaagttcatcagtagcaaaatcagtcaactagagttgtacctcctgtcctcacccacctagcagaggttctgttactcatatactcctaataccagctgataacagctaatatgtatctctaaggcaccgtgattattcccattttatagatgaggatgcagaggtcttcctacagctaaagtggtggctggtacccctgaccccagggtatgtttaattcctgagctagactccctaagacgggacctggaaaattttctagccctgaggaatgtcagagcatcatgtgaatcattaggacagacagactgtgaggaagaacatgagctgggcgggaaagtttgtctgagctcaggctctgcagattcctgagatgccagagcacattcttacctgcagaaaacactcctttcatttcttttcttctcgccccacaaaagacagaagatagaggtccttgagcacccaaggcggatcctccaggaaaatctattcattagagaaaatggaattgatggaaactttgaccaaccccgggggctttagagaatccagaaacagccggcgcagtggctcacatctgtaatcccagcactttgggaggccgaggcaggcagatcacctgaggtcaggagttagagaccagcctggccaacatggtcaaaccctgtctctactaaaaatacaaaaaaattagctggacgtggtggtgggtgcctgtaatcccagctactcagaaggctgaggcaggagaattgcttgaacccaggaggcagaggttgcagtgagtagagatggcaccactgcacttcagccggggtgacagagagagaccccatctcaaaaaaaaagagagagaatccagaaacaaacacagcaactgcctaacatctgcttcagagtttaacaacaccttaagtgccaaagtgtaagcaacaaatacatgatttaagtcctgtgtaaataccactgggccaattggagaggagatagcaaaggttaacattcctgggagaaatttccctcccaggggaattataaaccaggtgaaatgtaaaccttttaaaaatttcttagtagctagtctgtaatttctcaggggtgtgtgcgtgtgtgtgtgtgtgtgtgtgtgtgtgcgcgcgcgcgcgtataatgcagtattggtcattttgttctttcagccttttattttggaggactctagttagatcacaatctgtgaaatgtggtatactgtactctcaccctgattctggcacctggccagcgggtgctgatggggccttgaccttcaccaaatcccaacagcctcacaagcaccaggaacagaggccatggcagtgacactctgtgacatggccagagatatgagcctagactcagctctgttggtagtccgaagactgggcaagtaattacctggaacttccatctggaacctccgtctcttccaaaaacggagaaggaaggagggtaaatggagtgacctcagacaccccctatgagtttgtattcagctattctaaagccattcccgggtttctaaccagctactcctcattccttgtgctagagggttagagcactacaagatcatccttattttctctctttctctctttttttttttttttttttgacagggtctcactctgttccccagggctggagtgcactggcaggatcttggctcactgcagccttggcctcctgggctcgagtgatcctcccacctcagccttctgagtacctgggactacaggcacacgccaccacacctggctaatttttgtatttttttgtatagaccgggtcttgccatgttgcgcaggctggtcttgaacttctgagctcaagtgatccacccacctcggcctcccaaagtgctgggattacaggcgtgagccactgcgcccagccaagatcattcttttattacacacagaaggagtaataacagtacccatcacctgcataacagtatgcaattcatagagcattttttcactacagtatttcatgtactcatcccaaatctaaagtaaatattctcacctcactgtacagataaaaaaaaactgagccacagagacgggagagtaagtgtaaagccacacagctagtaattgccaaaggattgaaccctggtctgattttgaatcctacactcttcctaacccatgctccctccaatttgccatagtgctgtgctgaggaaccattctcagcaaaattcatcttctctacctgcgctttctaccctgagccttactcagttcccccagggaacttgggcaggtgacattcttagacttgtgcactttgcaacgccctgccctgtttactgtgctgcccagcaatgtttaatccacaaacacccacgctccttcccagaaggctcagcttccaagcttcaccaaagtcatttaaaccatgtttacagagctgctctcaccaagagccatctccattgcagaatatagttgtgtaagaattgattcagcagagaaaaatctgcccttctggaggaagggctggagacccagctggagcctccactggctgaccctgcagctaaatatggctctgaaatcgtggggtaataaccacattcttacaggtgcttgccacttgaaatggctcccaaggacccaggaaactccaaggctgagctgctcctacctctgatgctttactttgcactgggtcaccactgagctttccccacagcctcacagctcacggatgaaggcagctaccccagccaggaaggcataggtcaccttgcaggcctctgatttcctggggtagagcccaaggctgccaaggctgttgaaacagcacacccccatttcattgtaacccagcaaatgttccctgggcccctcagaggtgggtcaacctgcctccttctcaagatgtcacatggacccccagagcacccactgggaggtgtttagctacagggtgccccaccccacagcctagctcagcagagagtggggaagggacaagaccaatgggaaaggcaagccagatggggaattttccagtcctgttccttctaccactcattagccacttatttggacccaacccctctgagcctcagtttcttcttctgtgaaatgggaataatgataaggatcccttcccagggctgtggagaaaagtgagatttatacaggcaaacacacttggcacactatagaatcccagacaaattcaagggaccaggattatcattactgattccagttatgtgaaaagtccttttgccaaattgccgaagaaaaagaggatggtggaggaagagaaaaggaggagaagaaaataagttgggttggaaaccagatccttgtccttgaaaatttcataatctaagggtggaaatgccaaaacgaggagagacaaacttgtggcctgtgtttgggtaacacacagattgaaactcagaaggagaaacatatggggagaaaatgaacacaaaggggtcagatgtgcattcctcaattttaaaaattgaatatttaagtgttttaaataatttttatttcttttcctttctttctttttctttctttcttttttttttttttttttttttttgagacagggtcttgctctgttgcccagactaaagtgcagtaacaaaaccatagctcactgcagcctcgacctcctgggctcaagcaatcctcccacctcagccttccaagtagccaggactacaggcacgcaccacctcacctggctaatttttgtgtgtgtctgtgtggagatggggtctcactgtgttgcccaggctggtctcaagttcctgggctcaagcaatccttctgccttatcctcccaagtgctgggattacaggtgcgagtcaccacacctggcaaataatttttaaattataaatttaaaaatgcatttttataataggtacctttaaaaatgttaatagacttttttttaagaacagtgttaggtttatagaaaagctgagatgataatacaggaagttccagatacctcatacccagtttcccctattattaacatgttacatcagtgtggtacacgtgttataatgaatcagcattgatgcagtattattaaagtccatgctttatgcagattctcttagttttcccctaaggttctttctctattccgggatcccatccaggaccccacgtttcatttagttgccaagtctccttcggctcctctgggctgtgacagtctctcaagtctttccttaattttgatgaccttgacagttttggggaatattgatcagagattttgtaagatgcctgtctattggaatttgtggtgcctttttaataagtatgcagtggctcacacctgtaatcccagcactttgggaggctggggcaagaggatcgcttgaacccgagtttgggaccagcttgggcaacatagcaaaactctgtctctacaaaaaaattacctgggcttggtggcacatgcctgtcgtcccagctactcgggaggctgaagcaggaggatcacttgagcccaggaggtagaagctgctgtgagccgtgcactccagcctggttctggagccactgcactccagcctgggcaacagagggaaaacttatctcaaaaagtaaataaataagtacccatgtagttaaaatgtttaaagactagcaaatagatgttggctggtttgatggagaaagtaaatccattctttttcttaaaaatgatctcttcaccaccagtcccagcaccccccttaccagcctcccagggcactgtccatggctacattgtccatgggccatcatgtcccctcggcttctcttctggttgtaaatgctcttgcacttttctcccttgtggctgccgtccacactcccagctgccttccctctgcacttaagatctaagatcttagagacgagatgagacatctcttgccttcgtgcatctaagacagctcatcaacaggtccaggtgaactgctaacactgctgtgttgcttggaggcccctgtcccaccctggctgcctcagctttggccatggtacccacggtctccagctacatcagatgcctgaagaacaaatctctccttagctctccctgccccctctccaggaataggagcagtgggacccccttcaagaatcccccatttcccatatactttcctgcaaagccacagggcgtgcaaagtgggattccagggctccagcctgctccccatgggcctctggatccaggggtgactctttgcctgtttgggtgcctctttagattttccaccagcttcctgtggccaggagccagaccacgcccctatacggccatagttgtcttatcttgtctctgagattagaaggttggaacagattttcctgatgccccactacttctgacattctgtgactttagaatgttaccttcctcgacagccccctgcaccctcacacatctggctttagctggactggtgtttgtgaggaattatatctccaccttgttcagcaccagtccccaagaagaccagccaagggacactcatctggggatttgagaaatgaaggaccgtgggttccatgaggtctgttggggtcctggctagcaacactgtctggatgattgagccccaggaggaggtggcctggccagcaggtgtgcagtgaggccacttctagaccacccctgtcccatagagcttctagtgatgatggaaaccgtgtatatctgcactgctccaaacagcagcactagccctgtgtggctgtggagcacttgaaatatgactcatgcaactgagaaactgaatttgtaattttatttaatttaaatgtaaatagccacatgttccttgtggctgctgcactgcacagcagcagactgttgcgctctggaatccagcctctcagcctttactctccaaagcgggatagtattcacatcagagccaaacaatgcacagacgtcaataaacaggcagggcatggtggcccatgcctgtaatcccaacactttgggaggctgaggtgggagggtcccttcagcccaggagttcaagaccagccaagcaacataatgagaacccatttccacaaaaaaaaatttttttaattagctgggcatggtggtgtgcacctgtagttccagctacttgggaggctgaggtgggaggatcactttgagcccaggaggtcaaggctgcagtgagtcgtgattgcaccatgacattctagcctgggtgatggagtgagaccttgtctcaaaacaaacagctaaacctacatcaataaacatctgtaaatatcagggtagcgaatgaggacttggtgtctggcagttagggactggcctcttattctgccacatactggctctgtcattttgagtggatcactatcctcttcacacctcagtttcctcatccgtgaaatgaagataataatagtgcctactatcaagaccatcctggctaacacggtgaaaacccatctctacaaaactacaatatgaaatacaaacaattagccgggcgtggtggcatgcacttgtagtcccagctactcaggaggctgaggcaggagaatcgcttgaacctgagaggtggaggttgcagtgagccatgatcgcaccactgcactccatcctgggcaatagagcgagacttcatctcaaaaaaaaaaaaattgtgtctacctcagaggactgtaaagatgaaatgaaataatagacatataaagctcagagctccagaggctggtacatagtaaaggtttaatccatgcagattgcacgttctctttggggacagtacagctggaggggagtactgtcaaatgaggtcgcgtcgctgaggtggagacacattgtggcacatcttgaatacccgactgggtcccagctttagcacttgacattggcggccacctaagttttggagaggggtatgacagaggaggtggtgtcccagggggaaggtccggaaactcagaggagtttcctgctgtaattttctttggtcacacaatggtcatggcctcctgatgtttcccacaaagggccagaggcccttcagtgccaaggaacgtggactctctcctatcccagcacatacacgtgcttccagtaccttgtgatctctagccataagtttccactcacccatctgcgaaatgggaacaatgacgatgtttgcgtcctttctttttcttttcctacaatgcagggaactttaagactatgtgacagaaaggtgccactggaacccagggcctcgtgggtttcctccgtctctcgggagaccaggatccgagtgagaaagtttcccacgttcattcttgttgggcccattctcaggatgatgtttctcctgtattttgctaccccagcccaagcaagactagtagttcagctttgtgaatcccctcaggaagtcaggaaaatagatactgtctttgggcttcctccaggagctaagaaaggagagttcctgaagagcaggaatttaagacaggaattggcagccgagggcaaggttccacctcctcctcccttcttctgtggggtctgtgatgagagcagggatggggaggaagagggtgggtttgcctgcgcctggggggagggcagccatcaggaaggagcagccacctctgctggggtactggagataaaaactctgatattgactagtgaccgtgggggcgatggcccaggagggtcagggctgcagggaacagggacacaaaaacgacaaaacatgcaacaggttatgtccttctggtccagggcacggctgagacaggcaagggactagagagaggaagagtgaatgtcaagccccagcaccctcgcctccctcccatcctcccttttagggcctcccttctggcagatagggcagggagaagggaaaggaaaggcctgggacacgtggtttggatcactggctgtggctcacagttctgatgtgtgtgcagtttagggaaggaggctgaagacttcttgttaataagggtggggcatgagtaaaatggaggatctgccccctcccctcccagcccctgatacaaatgaaggatgattgtacatgcatggggaattccactttgggggtatccttttctgggctgctgccagactctgaaatgagtaacaaagggatggcccagggtgactcatcagctaccctctcgcaggcctagcacgctggcggggtgtgcatttcctctagagaagcccctccctgccagtttcagagggatggccctgaattggcttttcagaggttccttctcctcccttccaaagcgaagacccacagctgcctgaaaatgtggctctccgccttcttgggctgcctaggaccttgagagatgtgtctctctgggacagggtgtcaggtctgctggagattgttaaaatgctgttgtctcaggaagggtgaaatttagccaggagcagtcttcagtagcttggtctgtttatcgtgtatctagctgtcagcatgcaaaacaaaagaacaaaaggtctaaagaaatataacgcaaaacaggtacgatttgagatccatcagggtttctcaaccttggcacaactgactggataattgttcattgtagggggctgtcctgtgaattataggatgtttagctgcatccttggcctctacccacacacccccgtgtgccactcaaaaatgtctgcagaccttgccaaatgtcccctgggggcttggcggagttggggggtgcatggaatgcccccagttgagaaccactggcagagcaggagtgaagggggaggtactgtgggggtcactgggcacacagaatgccatttggggagcctggtgcaagggagtggccggatgggaggtaggaatagcagtggtaatcagtaggtgagttgctgaagacaaactaaatattctttccagcattgcttcaatctaatccagccgcaagtatgagtaaatactgtaggaaaggagaaaacattgcatgtacggggtcagggcagcattgctgggatatttgagcctgtgggaggggagcttcaagcttcccactagcattgggaggaacacagcaaaggaggagaagggccctccctgcttcttggagaatggttccactggcaggccattccgtctgctcagcttcctagctcaggtgcctttccaaaccacacatcagcagggagacagtgggaacatctcaggtccagggtaccttgggaactgcagagcagctgggtggcctgacactggcatttctcagtgttggctccattctcttgctggcacccccaggtgggagactctgttagcaggtgtatcttactatccctggctccctggtatgcgttacagttcagactcccaagcacaagctccctgttttgtcacacctgtatctagtgtgtaacaatccaccccaaaacaaatggcttgaaacacaaggcattttgttctctctcatggttctgaaggatgacggggctgagctgggcaactctctcccgctctctcaagtggttgcaatcagatggggatggggacagagtcatctgtaggccccctcaaccacatgtctggtgcccgggctgaagggtggatcagcaggggtccagggatctctgtctcttttgtggtctccccatcacagggacttgaaggtagctgaacatcttacagcagctcatgtcccaagagaaagacctgggagctgtctcatctttacgacctaggcttggaagtcacatagcatcacttctgccatatcctattcattgagatcaatgaaggctcacccaggatcaaagagaagggacatggagcccacttctagatggagagtggcagggttctggaagaacatgtgaaaccagaaacattgttgccaccatttttggaagacaccacgattcctcccctttgaataatggccttcttgtcctttaccagtaataacccaagctgcttggacattagctcttcatggtttgcggggtggggaggatgtgttttctgggacttcccaaggtacacagtagtgaaggacttcacaagctgggctgatgtgccagcttcaggactccactcacccccaagcgttctgagatgcccatggggctcaggagccctgacttgcacaagccagcaactgcctttctgcttccattcagccagctttactgggcatctgttataggaagagcagtgggctgagacttcagcaaaaaagacaaaagcaaaacacaatcccttctctatacaaggttcttccctttctgtgtccaaccagtccctccattctcggtccttaactcatcaccaagccgccattttcttctattcccccattactccaaggcgggcctcagttctcacctggagtctggctcaggatgcctacaggtggccccagaattgtaatggcttgacatgcaatttttcagctttacaatggcatgaaagcaatacacatttagtagaaactgtacttgaagtacccatacaaccattctgtttttcactttcagtacagtattcaataaattacattgagttgttcagcattttattttaaaacaggctttgcctccttagataattttgcccaactgtaggctactgtaagtgttctgagcacaattaaggtaggctaggctaagctatggtgttaggcagtgtcaacaaaatagtcaaattctgtgaaatatttaaagagtttattctgagccaaatatgagtgaccaaagcctgtgacaaagcccaaggaggtcctgagaacctgtgcccaaggtggttggtttacagcttggttttatacattttaggaggacataagttacaggcagacatcaatccagaaaggcgggacaacttgaagtggatggggaaggcacaggggctggagggggctccgagtcacaggtggattcagagatttttctgattggcagttaattgaaagcattaagttactatctaaagacctggaatcaaggccgggtgcggtggctcacacctgtaattccagcactttgggaggccaaggcgggtggatcacctgaggtcaggagttcgagcctggcctggccaacatggtgaaacctcgcctctactaaaaatgcaaaaattaactgggcatggcggtgtatgcctgtagtcccagctactcagaggctgaggcaggagaatcgcttgaacccagaaagtgaaggttgcagtgagccaggattgcaccactgcactccagcctaggagacaagagcaagactcgctcccaaaaaaccaaaaaaaaaaaaaaaaaaaaaaaaacgaaaacctgaaatcagttgaaaagtgtgcctgggttgagataagaagttgttagagaccaaggtttttattatgtagatgaagtctcacagagggccactctcaaaggcaatagatggcaaatgttttctattcagacctttaaaaggtgctactagatgctcagctaatctcttcaggatcagaaaaagacctgaagggaaggtgattctctacatcaagcttgtccaaccctcgtgctgcccaggatggctttgaatgtggcccaacacaaatttgtgaactttctcaaaatattatgagattttttttttttttagctcatcatctatcattagtgtcagtgtattttatgtgtggcccaagacaattcttcttcttccagtgtggcccagggaagccaaaagattggacacccctgctatagaatgtagattttcccacaagagacagctttcagagacatttcaaaatctgtcagaaaaatatattttgggctaaaatactttgatttctttcagggcctgctatctgtcatgtgatgctctactagagtgtggttggaatttggtatcttattgctaggaagagtctgttttgtgagtcttaagatctctgttttcagttaaggctggtcagctgtgcctgaattcctaaaggaggaggataaaatgaggcatgacggacctcccttcccatcgtggcctgaacttgtttttcaggtttaccttggaatccccttgactaagggggcacccattcagttagttaaggggcttagactttgatttttagtttacagtaggctgaggtgtattaaatgcattttcgacttgcaatattttcaacttctgatggatttgttcagatgtaaccccgttgtaagttaaggagcatgtatacttgtatctaatccactttgggcattgctgccagaaaacctgtcctcagggagctatggaagtagtggaggcaaattattaaatggatggattaattccaagttcagatcatgttgggagtcagctgggagtcagtgtgaggatctgggaggggaacagtaaggggttaagagagataccccaaaggatgattaaggagggagagttggaaggaaggtttcccacaaagaggaagcagggagtgattcattctgaaaaaggcaaatattttattatgcttggagggtctggtgcagaaggggaaaggaagagaaggaagtttggcttaaattcccttaggagccagttcagattcctaagctggcccggacatccaacccaatccgcctagccccagccctctccagttcccaatgcccagccccacaatgcccgtcctgctgcctgcctgttctggactctgcacttgaccttccctctccctgaaagtgcccctgctcttcctcacccagctccccgctctaagccttcctcgcccaccccagccctcctacagtcccagtctgccctgttcagactcaaagcctcatgctcaccaccatcatccacaaccagtttccacgtctgtctcctgccggctgtgagctcactgcctcagaaccagcgccagtctcctctagactgagtacaggcctggcacggagccaggaatgcaccaacaaggagcctgagactagattggaggggaaagagacatgtcctccagagttgacttacgcgaggacagaggtgtgcagaggcacggcaagctgggccccaggcgagaagcatggagtgagggatgtggaggcagcggaaggcatctgggagtctgggctgccccgtagcagctctgtgttctgcctgctcttcctccaagatgagctcccttggccagtgtgtgaaacgtgtgtgtgagtgtgtcaccggtaagctgagttctttccctacttggtatcagttgcaaagaaagaacactcagttggaaaaaaaggcaagagggttttattcctgaccaggagaaagagaaggagggggctcttgctctaaagacaccttcaccccgagccatggaaactggggagttgtaaggagataggtgtggggcagggaggtgtgtaagcaggtgtggggtcacggtgtgggggtggagacctctagacgctcaggcccaggtcataaacatgcctctccatacaatgcaagatgtgttaccagaaaggggtcctgatctagaactaagaaagggttcttggatcccgctcaagaaagaattcagggtgagtccatacagtaaagtgaaagcaaatttattatgaaaataaaggaataaaagaaaatctacttcatagagcagccctgagggctgatgattgcccatttttatggttatttcttgattatatgctaaacttcttgattatatgctaaacaaggggtggattattcatgcctcctctttttagatcacgtagggtaacttcctgatgttgccatggcatctgtaaactgtcatggctctggtgggagtgtagcagtgaggacgagcagaggtcactcttgtcaccatcttggttttggtaggttttggccggcttctttactgcaactgttttatcagcaaggtctttatgacctgtatcttgtgccgacttcctatctcatcctgtgacttagaatgccttaactgtctgggaatgcagcccagtaggtctcagcctcattttactcagctcttattcaagatggagttgctctagttcacacgcctctgacacatgttcagaaataatggtgattttcttctacaggtggggacgttagcattataatgacatggtaaagttctgaaggtaacaaggggttgcctgttccagtttctgccagttttgggggtcttatctccctctggtatctgggcagaggtcaagaagctctggcaccatcaggggccagcttgtttctttaagcagctgtgcctacaaataaagggactaaagaaaacaataagaaaacccagttatttcctgggggttgctctggtatccagcgtgttttacttcaccaagcgcaattcttcccagtgcaggcactgggtgtaactgtgacagccagcaccaacctgcccacacacctcctgtcctgcaggactgtcagcagcctctgcactatagtgtgacagagccacaggtagctcaggtgtgcctcagcccagcctctcctgcactccccctcccctggctccccaactctgcctcacttctgtttgtgaaggaaagacagcagtagcggaagggaaagaaggagaaaatgcagagcaaatattatgctttcctcttggaaaacctccaggagctgcaaatattagtaatccagctgcatcccaccccccaggatgggctgggcctgtcacacagccaaccttcaggatgcagacacccaggctggggagcacagctctggaaatttactgacatggccctgaatgaatttatcttttcagtagaaggccctggagtttaaaggagtcattcataaggtctgtctgggagtgccttgtcctcagaggagggtctgggtgggttggagtggaaggaagggctggctacctggtgtgctctccgtgggtccccaagaaaggcagccctgctgggggcagtgaagcccttatccaggtcacgtgagtcttggaaggggaaggctgctgtgcttaacgattcaaaaacacaaatcaaacctcctttcccaaacaaattagaaggtgtggaggaagcttgaattcagagaggatttcccagagacccataggcaaaagtggcttaactgagcccagtgggtgtcccagaatgggccagagagaatgacactaaaaagtctttgaacaaatgagcaaatgaatacaggaatgctcatctgccataggcacaaacgtggtaaacgttccctgagagaactgacagcccaggggtgcagggagagaaacggtcccaactgcagactgggtcccaactgcagactcggtcccaactgcagactcaggaggagggaggctgttaaggggccgtctttccttctgttatgtgaggagaaaagcagggaagggacctcaaggccagcctctcccaggagctgctgttctcagccccgggatccagcgctacagggaagtgcaggggaggctccacagtcccggctggagacccggtcaggcctgggtggccactcttctttgtagtggccaccctcgtgtcaccagcaaatgcttttgtatctacacccttctcagtgctccccctcttttaaaaaatgtactttctttttttaaaaagagttgggtcttgccttgtcacctatgctggagtgcagtgttgctgtcacagctcactgcaaactccacctcctgggctcaacccatcctcccacctcagcctcccaggtagctgggaccacaggcacacaccaggacacctcgcccagtgctcactatttacctttatttcttccttattcggacaccccttgcttccaaagaagagtttcggaaggctcaagacggtgagacagacaccttatgcactgcttcactctcccccgcagctcccctccctcctcactgacccccggccacaaccctctctccttgcccctcaccagccggcacccttggcaaccctggcaccctttcgaggacaagactgccaaatgtggccaaggtctggcacaccatgtaccaatcgaaactccacttcccttgagtttcagtttccacgcctataaaattagcaaatgaaaagagcaaacacttggagacactgttctcaatgctttgcatatttttttcatttaattctcagtgccatgagacagtctattattattaaacctatgttatatatgaggaaactgaggcacagagggagtagtttccccaggtcacagtcaggatttgaactccatggtctggctctagtgtttcccaaccattcggggtgggagtgggagagaaaccagactgctctccctagaaaacagcatgtgtttgcatgtgtgccaaatttgcacaaaacatttggggttccaggtctctaaagcccatccatggaaccccggtttcccttctctcacgtgatcctaacaacctgccgaggatacacctcatcatgatcctcctttcacagctgagaacacaccagcttagagaaattaagaagtgtatccaagctcacacaatcttaagtggccagatcaggaccaaaatccaggtcctctggctgggcgcagtggctcatgcatgtaatcccagctctttgggtggccaaggcgggtggatcacctgaggtcaggagttcaagaccagcttggccaacatggtgaaaccccatctctactaaaaatacaaaaattagctgggcatggtggtgggcgcctgtaatcccagctactcaggaggctgaggcaggagaattgcttgaacccaggaagcagaggttgcagtgagctaagatggagccattgcactccagcctgggcaacagagtgagactctatctaaaaaaaaaaaaaaaaaaatttgtggtcttctaaccacaaatctagtgcccctccccaaccacctctggtccagcctcttagatctatctgggatgtctttccaccatactcctttctggtttgagaaccacctgaaggctcaacgtggctgtggggtgctccgtggagccatttggcctgtgcccagcagcgagggggacagccagcaaaggtacccccgcccctgccagcctgccacctacttgggacgtttcttttctttttttttttgagacggagtctcgatctgttgcccaggctggagtgaagtgacgtaatctcagctcactacaacccccacctcctggattcaagtgattctcctgcctcagcctccctagtagctgggactacaggcgcatgccaccatgctcagctaatttttgtatctttagtagtgacggggtttcactatgttggccaggctggtcttgaactcctgatctcgtgatctgcccaccttggtctcccaaagtgctgagattacagggtgagccaccgcacccagcctactcgggacctttcaccacccaagtgaccagcacccctgcccagagtgccccggttctgtccactaggccagcagggaccccgcctctgggattgtttgctggaggggtcctggacaacgtagaaagggcagcacacagccctgggcaggaagggaggcaggaagagagatcctcaggggctgggctggaggagcaaagccagccaaaggggagtgagagggcagtcaagcgcctagaagccaaggaaccccaggaggatggcatcgggcaggtgcctcctggtgcccagagacaaaaagatgtgtgggaaggtgacagaatcaagcggtaaggtcagtgctttgagggagcaggcaaccaccagcctccagtgacacttgcctttcacagggatcctggaggtccccatttgggaaggtggaaaatctcagttccaacctaaccaaaagatacaggggcaagtttggccttgaaaccctggaccatctgccctgggtgatttcctttcaacagtgctgggtccagactcccagaaccctacctctcccatcttccccagtaagcctgctttcagtccttttcacacgagagcatttaaatccaagggttcccttccccctgggtatttgcagcccatctgatctctaaatgtagagtgagagccacttgtagaaattaagtctaggctggtcacggtggctcacgcctgtaatcccaatacttcgggaggctgagtcaggaggatcacttgagaccaggagtttgagactagcctgggcaacatagcaagacacctctacaaaaaaagttttttaattagctgggcatggtggtatgtgcttgtaatcccagctacaaggtgaggtgggaggatcacttgagcccgggaggtcaaggctgcagtgagctgtgattgcaccactgcactctagcctgggtgacagagtgagaacctgtctcaaaaaaaaataaaaataagaataaagaaattaagaccagatgtaggggagatttgtggaggaagggacaggaggcccctaaaatcccatcctgtaggcagcccctgcttgactaagcataaggctcgtggggcacccaggtgggctttttctggagaggaagcaaggcagaaaacccctccattttccatccccagcctctcaggtctgtgccagttgagtgtcttccaggacagaagcatggctgggtatggaggcagcctggatatagggatggccggtctgtcaagcccgtggtcaggaccttcacggggcagcttaggaacctccaggcagggcctcatctgctgccgttagtaataaacatggccagcaacagccagggccctgctagcgggagatgtcatcggtagccaccttccttctctgcagagacaccgtctgtcccatggatgagcagagtcccctggggacccagctctgacacttgtccttgctcatgtccagggtgctggacagactgaggcaggtgtcaggctcctgggatgagaaaggcagatgagagatgggagtgggagctttacagtgacttaggcagaattgcttagtatttacatatgccttacctcattccacagagaatttaaggcctgaccaaaagagacggggcggggggtgggggggagagaatacaataacaccatgtactgtaaagaaaaacagtcagttctaaaagaaaaacaacccagaaagaagggaatgtgtcaaaaccgggagaggggaaaaaaaaaggcatgcatgctttcaaaagcaccttaggggctacagatgggccctatacttagtgttgacacccaacagccataaaagaatctcactgtgcccccaggggagcacagggaaggtctgattctagattttttctgtgccatttatttatctatatcctcatgcacaagttctatactgttttaattgctgtagctttttatgtgtttaaacatctaatagaggtagacttccttctcttagatttttttctagctatgcttcatatttaatttttaaataaacttatcagaatcagctaagttcaaaaacaatttttaatcttattacctttttttttcttttttgtgagacggggtcttgttctgtcacccaggctggagtacagtggtacaatcatagctcactgcagccttgacctcccaggttcaaagtgattctcctgcctcagcctcccaagttgctgggacgatagaagcatgacaccacacctggctaattttttaaaaataatttttatagagacagggtctcacagtatagtgagatttcagggtggtcttgaaatcctgagggctcaagaaatcctccagccctggcctcccaagagctagaattacaggcatgagccaccgtacctagccctattgctatttttattagcattacattaagtttataggctaacttaagaggacatggcatttttatgataatgagtttttgcagtcaagaacgcaggccagttttttttaaatggggtaaatgattgtccaagcgcctccaggcaggctcacgtgcacactctggagtcagtgaagaaggtgaacagctgacaggagcagcctcccagtcagagaagccctgcacactgttgcaaacagacagcttgcatctggagtcttctgtgatccgaggaggaagcgtggctgagtccttcccagaagagggtctggagctgtgagttggggacaattgtcagattctagcagtgaaagtggttcatgtgcaggtgcaacctgccccgcagtcacgggacacagccacatggagccgagccacgctctcagagaaggagccagggaagaaacaccctaactgcactcctcccttcttctggcccccagcagccataggccctgggcccccggtgagatacccatagagatcagctcccaggcagcaggatggagggtgtagactggacatgaagaggcagctggaatgtatcgggcactcagctccagctcaccacgatccaggcactcaagttcccaagacaatagtttctgctctcagataaatggaataattaaggatcaaaaggttatcaacaggtaaccaagcataaacagattttttttttttttttttttagacagagtctcactctgtgccccaggctggaatgcagtggtgcaatctgggctcactgcaacctccacctcccaggttcaagtgattctcatgcctcagcctctccagtagctgggactacaggcgcgtgccaacatgcctggctaatttttgtatttttagtaaagatggagtttcaccatgttggccaggctagtcttgaactcctgacctcatgtgatctgcccacctcggcctcccaaagtgatgggattacaggtgtgagtcaccatgcctggcccataagcagattttgtacctgagcaggaaggctaagagcttgtaacaactgaacattccccccggagaggaaggcaggagttttgcttgtgccaagtgcactgttcagacagtcctctgaggtacaccaaggtctgagtagccatcccaccctcccctctgccaaaatttttgtgtgactggagagcagagccctcctccaaaaataaaatgagcacaaggaaaatactatttgcagatacataatattaaaaccataggtctttctttttctagtcccatccatatggcaacattccaggagaggcctccgtcactggaaggcaccctcaggggctttcctggagctaaaaacagtttaagccaaaagttatttgtagcatctgagttaaactcttcgtctcacccttctcgagctagctggcttattttatccggaccaggatataacagctctaaacaggctttgccaggaagagacgtcatggacttcaaccagggcacctgaccaggaagaaatcactgcaggatgatctgaaagagttttcataaattattttacgtaaggtagattctgaccttgatggggacagccaaggttctggaccctcagctgggaaagatgggactaagtctacaactgctgaggttgtagaacaggcttcttgttgggaggaaccctcttgtggacatgggccgtcgaggtggagtgagagaacaccgtgccacctggacgctgaaacaccattgagtcacctctgtttgaaatgcttgttccctggtgccgtaaagaaatagcacttgaacataaatttaatttactcagcaaggacatttttatactttctgtgaaagggtacactcaccaggagttttgccacgagagtacaccaaacaaaggagacagggtcatttataacctgacgcgtccaccctactgctgtgtccagtttccattggctggaacaggacctcccattctgtatttgtcccgattggctaacaacttagaactttttaaaagaggcaaaggcagaggagaacaaaggaaggaggaagtaacttgtggaatgctgagaaaggtaaaaacacctttagataaggaagaggaacaggctatgacctaatgcttgcttggaccagtataagcatgccagggaaaatacttaggctaaattgtgggagctaagaacataaagtacattgatttctttatcatggctagcagatatttaagaatgttagcacaggtctttgaataaattttgcttctaagagaagttactatttattcctaattaaatggggaggaaggtctttgaagagaaacctttacacctcttaaggacaaaagtccccaagacctgtccaatttcgaattcaattaggtgaattcgaaattgacaccagcctctttgcagaggagactgttttggttatacatcaaaagcctgtgctttgcagatagacctgacagccactaattagctaggagcgttgggtgatccagtccacctccttaaacctcagtttcctcaactatgaaatagaatgaaaatagtacctaccttggaactgttctgtgacaaggaaatgagataacatgataatgtgcataaggcttttagctcggggcctggcacacctaagcctttgtgtaatcattgtgtagatcttgtcactgagaacgcttacacgagcagatattaaaataaaggaaagaagtcagttgggtaagggagcttcccagcttggttcaaaatattttgctgattggggtgagggaaagagtgaaggaaccagaagcaaaaaaagtaggatttcaaatgcttcccacctttttagaaatcaagacattctttagtggcctctacatctccttcaactccagaatttggaaaactgatgaaaaactttttgaatctttggctgtaaaatgtatatatatatataatgtgtatatatatatatatatatatatatatatttgagagggagtctcattcttgttgcccaggctggaatgcaatggcacaatctcggctcactgcaacctccgcttcctggattcaagcgattctcctgcctcagcctaccgaatagctgggattataggcgcatgccactatgcccagctaatttttgtatttttaatagagacgggatttcaccatgttggccaggctggtctcaaactcctgacctcaggctatctgcccgccttggcctcccaaagtgctgggattaagaggcatgagccaccatgcctggcctcttttatctttttcttttcttttcttttctttttggggggcacagagtctcactctgttgcccaggctggagtgcagtggcgtgatcttggctcactgcagactccatctcctgggtttaagcagttctcctgcctcagcctcccaagtagctgggattgcaggcgtgagctacaaggctaccaactgactgactcaggggatgtgtctccgcttaccatagatctgtcattagcgtatataggcctcaaagagctgtaagcaaccatgtctaagtgctaacaggacaagctaggtcaggaactctcaggatgctaagtcatcgactagaattcaaagaattcagtgagcttcagctggtcctgctggctcacgcctgtaataccagcactttgggagtctgaggcaggcgatcacctgaggtcaggagttaaagatcagcctggccaacatggggaaaccctgtctctactgaaaatacaaaaaattagccaagcatggtggcaggtgcctataatcccatctacttgggaggctgaggcaggagaatcacttgaacccaggaggcagaggttgcagtgagccaagatgacaccattgcactccagcctgggtgacaagagcgagactgtctcaaaaaacaaaacaaaaccaaagaattcagtgaacttcaataacatatatatatgttactgatatatataacaatattacatatattacatattttatatatatgtgtgtatatatatatatatatatatttttttttttttttttgagacagggtcttgctcttctgtcacccaggctgagtgcagtggcatgatcacatctcactgcagcctccacctcctgagctcaaatagtcctcccacctcagcctcccaagtagctgggactacaggtgtctaccaccacacctggcaaatttttgtatttttttgtcgagacaaagttttaccatgttgccgaggccagtgtcgagctcctgtgctcaaacaacccactgaccttggcctcccaaagtgttgggattacaggcgtgagccgctgcgcctagtcttcagtaacatttttaataaacctgtcaattggcgaaaataaatccaacagtgaattaaactcctttgaggctacttcccattattgtcatgggaaattgtaggaaagtgcacattccttaagaatggagtaaacttcctcatcctcttcccaggccccctcccctttgtttgtgttttgtggtgaagatgacccctccctgcaaaccatctgggtgctgttgctggcatcagcttgcttctaactgcatgaaatgattgtggtgcctgctgtgctgagaacctagcactggcaccaaatgggtgccgagtgcttacacacctgctctcattatgcctcacacttatccatgtcatgggggagggttctgaggctcagagagggaccaggctgcctggccagctgcccacctcgttgtgcccatccttgtctaccccttgaagtgacctctgcccctccgcacagaaacccttcgggacagtccagccttctgcctctgactcagggcttttccatctgcactgctccgtacttacttcctgcgactgtactccctgccagagcctcttttcctggctctgaccttcctcctaggaggcgtgcaacgtttgtccccttcccatctagcactacgttttctttctctcactcaaactcccctttatatatttgtttgtttatttatttagagatgagggtctccctctgttgcccaggctggagtgcagtggtgcaatcatggctcactgcagccttgaaatcctgggctcaagggatcctcctgccgcagcctcccaagtattcgtattatagctgggactccaggtgtacgccaccacacccagcccaaactcccattcaaagcctgtgtgctcagaagcctctgcagctgcgctggtttcattctctcactgtggagcatctgctgcgaatcaggtgcaaggctgggctctgagggcacagttcagccaccagagttctgggtctttcagggaatgaaatttcccatctctgcccaaccacaacacagcaaaaacatttctccctttgcatttccctcaaaatactaggttggtgcaaaaatcacaattacttttacaccaacctaatagcccccaaaccctctgacccaaccctcatatgggggactgcctgaaacttcactctgtctattcacaggttgtcttaggctttaagcccctggaggtggagacaagatttttaacatcctcctggttctaagaccctctgataagagctccttgtgctgtgttcacaggtgactgctggctgctggcagccattgcctccctcaccttgaatgaagaaatcctggctcgagtcgtccccctaaaccagagcttccaggaaaactatgcagggatctttcacttccaggtaacttaatggttggctcaggtggttcctcaacaggtccagggggctaggaacagtcttctggcttggctgggttcatcagtccctggtgtttgcagactcccaagaccaatactgttctacaaaggacattgggcgagagcaggaagcttcctggcttacccgtggccaggatgtgagacccggctgggatggccctgggtggtttcttgggacatgtaaaagggaggtagagcaaggtgttcaggaactaattcccaagtttaaaaaaaaaaactgtattatttgatgtttgagacaaaaacgttgaagttctcctccttttatgccggtaaatgagaaataatacttgaaaaagctggctgggcacggtagctcatgcccgtaatctcagcactttgggaggccgaggtgggcagatcatttgaggtcaggagttcgagaccagcctggccaacatgatgaaaccccatctctactaaaagtacaaaaatcagttgggcgtagtagtgcaggcctgtaatcccagctacttgggaggctgaggcaggagaatcactttaacctgggaggcagaggttgggaggccaaggtgggtggatcacttgagcccaggagttcgagaccagctggggcaacatgctgaaactccgtctctactaaaaacacaaaaaaaattagccgggtgtggtggcacgtgcccttaatcccagctactcgggaggctgaggcaagagaatcacttgcatccaggaggcagaggttgcagtgagccgagatcgtgccactgcactccagcctgggcagagcaagacttggtctcaaaaaaaaaaaaaaacagcctaaggtacagggcagaatgctaaagaggcgggtgtggatttgaaaggatggacatgcgcctctgtcttcgcttttttagtgaggacttggcctgcataggagagttaagggagcacctcctcccaggatgcgctcatggaacctatcccaggggatcagggcaaggggagccagaggcagctgaggctcagagtcccagtgctgccaccagctcctcctgcagcccacctctcttgttctgcagttctggcaatacggcgagtgggtggaggtggtggtggatgacaggctgcccaccaaggacggggagctgctctttgtgcattcagccgaagggagcgagttctggagcgccctgctggagaaggcatacgccaagtaagttgccatcctcccctggccccatggccttcccccaatgccctggattccaaaaaattcactcatgcctgtaatctcagcactttgggaggccgaggtgggtggatcatttgaggtcaggagttcgagaccagcctggccaacatgatgaaaccccgtctctactaaaaatataaaaatcagtagaactactccaggactactttgagtgggaagtccttttctatagaaggacttctttggccaaaattaggctctaaatgcaaggagatagtgcatgcagggtgcctggctgcactgtacgctgataaatgatgtctatcaccatctttaaccaaatgcacaggaacaagttatggtactgattgtgctggacttgagaaggagctctacttccttgacaggacacatttgtatcaacttaaaaaagcagaatttttgccaatgggcagaactattcattgcagaggtaggaaacttgcccagaatagatgatgtcactgattagcaatggcttccccatctccgcacagctgcttcccacccaggttgcccacagttgagtttgtccagtgctcagggctgcccactctcagtaagaagccccacaccagcccctctccacaatggccccatgttggctgtgccgcccggctccttccattaaagtgaccccactttagagcagcaagtggatttctgtttcttacagtcccaatccaggaaggaggagtcagctgtgagaacctggagcctgacggatgcttctaagtcccactgctcaatactggggtcagggaagccaccggactccagcatcagcagtcaggagcactaagcccttgccaacaccgtgcctgtttctcagagaaactgcttccattattgaatggttgtccttttttaagctatcaatgccaaacgacccattagtagacctcccctttcttgtcaggatgtagaaggaatcaatacaggaggttcatccagaaaatcactaaggtccttccgactctaaggttctacgagaatctttttttttttttttttttttaatacggagcctcattctgtcacccaggctggagtgagcggcatgatctcagctcactgcaatttccacgttctgagtttcagcaattcttttgcctcagcctcccaagtagctgggactacaggcatgcaccaccatgcccagctaatttttttgtatttttagtagagatggtgttttgccatgttggccaggctggtcttgaactcctgacctcaagtgatccgcccacctcggcctcccagagtgctgggattacaggcatgagctaccgcgcccggcctgagattttctttaaaacacaaaataccagggaaatggtaactgtggacattataccttgccttcctgagcaccccgagctgggaacaaggccaaggagaatgtgagcagggggtccctggagcatcaaatctagacggtactagggggtggctgtttgagagattatagcatcagtagtgtcaagggtagcggcagcgtctaatcccctcttgtaggatcaacggatgctatgaagcgctatcagggggtgccaccactgagggcttcgaagacttcaccggaggcattgctgagtggtatgagttgaagaagccccctcccaacctgttcaagatcatccagaaagctctgcaaaaaggctctctccttggctgctccatcgacgtaagtccaggctgccttccctagcctcaccccatctgctcttgctgaagggaggctcccacagtgcccaagggaacccactgctcctgtgtacaacgtaatgcagccctcgtccacgtaggggccaaaggaaaacctccctccaccctctgaaggtccgctgaaaatcaactggcaaaaggaagactaatacaagaaatggcatacaaatgtatgaatgtggacaggggagaatcacaagagatttccctaccacgcattgggatacagagggttatattcccttcctcttaggggaagggagatggggaggtgcggatgattttagggatgtcgtaaatgatttttaggggaattcattgggcttaaagaacataaatggtctgggataaagtctgttgggcctgcagagcagacagtggtttgtgacaagtctgtctagccatgttgacagacttgtctttcttcctgcaatatgagttcagttcataataactcatggaaaggaccagacgtcattgttttcatctttggcaggtccagactttaggcaggtgagggaacttcagagaatagcttcctcctgtgctttgggggagagtggatcgagagacagaaggaaaggggaggtcagagagatcttgaggcttcttcagtttagcatttcaaagtgccatctcttagaggtattggtttctgagcaccccagtgtctaccattattgctcatcacctggaagccaagggttgctaggcaaaagtcaagctgtctggggtgtaatggatggggtgatggtgcctccagcccttctgtcttcagtccacttcccactcttagcctgctctgaatcacccccacccctctgaccacaggttccctgggagcccctgccacctgctgcccctgccaccttcccctccatctgcagtgctgtgcagccttcccctgcactcttgcagagctaataggcccgtgggagacttcggaaggaagaggaggaaagatttcctcataatagccttgctggcaacgctcaccaggggatgggaggtgggcactgtgcccaggagccttggagcaaaggctgtgcccaacctctgagccctgtcccatccaggttctggtctctgcgggggacagagataagaagccctggcttttggagccaaaatctaggtcagactccctaggcaggaattctcaaagtttatcagcagaacacgttgaggcagaagaccctttctgctccagcccttcttcccaggctcaaccttcatcagaatagataggggaaaggagaggctgtgaggcgttcttaaaacagaagcaaattctgactcagaccggaataaacaaccgtcctagtataaaccctacagctgggctgggccagaccacggagcatgggctggtggtggggcgagggtgtgctcagtgtccctgggccactcaaggctgtctgggtatcagccctgcgccatcgaggaccccctccggccctctctcggccgtgcgccctttccctgcgccatcgaggaccccctccagccctctctcggccgtgcgccctttcccgcccttcccagcctgcagaaatccgtggatgcgctattcacacgggaatgcctgtgctcgttccgcgagagggttgcattccgccttttctctggtattctcggcgttcaagcatttgaacggggtaggaaaggttctccaagtgcaagaaagcgcagccctgagcctcccaccccaggcctcggccgctgcgctagtgcgtccggcggtcccgcccggcagtaggacagagggagcgagggagtccgggaggaagggagagcgggtgcggccagtctgacggttgctgtgtttgcagatcaccagcgccgcggactcggaggccatcacgtttcagaagctggtgaaggggcacgcgtactcggtcaccggagccgaggaggtaacggccggcgcggatgtgcaggggtcctgctgtcctgacacgatggccacaggcacagtttgtggtgatgcccaggggcccgcgcggccccacggtggtccagtttacactcgggccccgcactcctgaagttccgcgcgggaggagaagggcgtccctttcgcagctcgggcgccgggtgcgccgcgctgccacctggtggccgcagtggccggcgccaggggccctggttttacttgttttagatgttaccctgttttacagttacaaccttactattttgataagctaaaaataataaaacaatgcatcttcatagtgttttatactctataaggtgctttctcttttgatctcgtaaaagtattcgtgcccatgttcaaatctgactgcctcttaccagctgtgtggcctgggccaattactggaactctctgtcccttagtttcctcatttaaaaaatggaaataatgataatatccattggaaggtcgtggcgattcaatcaagttaatatatgtaaagtgctcagaggtgactcacacatcatatataaggaggtagctgtccttgctgttgtgatcactgttgttattgaaaatattatgggctgacatggtggctcacacctgaaatcccaacactttgggagaccgaggtgggaggatcactcgagcctaggagttcaagaccagcctgggcaacgtagcaagaacctgtctctacaaaaaaaagttagctgggcatggtggcatgccactgtcgtcccagctactcgggaggctgaggtgggaggatcacttgagcccaggaggtcgaggctgtagtgagccatgatcatgccattgcaccccagcctcagcgacaaagtaagaccatgtctcaaaaaaaaaattatcaagcaactcaagttcactgttaattacagaacccagtctagaccgcagatcttctgcatgtccagtgttctttttttaaccttgatttttttaactaccccctcacacacacacgtctttttatttgaaaattttcacgtatacagaaaagttgaaagactaacataataactatccaattgccactcccctagattcaccgattgctaacatttgccatgtctgctttatctatgtgtgcactttttttgagccatatgaaagtaagttgcagacgttatgacacttccctcctcaatacttcagcatttattccctatgaataaggacattctgttacataattcctctactgttgccacacctaagaaaataacattaattcagtagtgtcatctattataaagtctatactaacattttcccagttgcccaaaatgtcctttctggcgacccaccccaaccccatccaggactcaatccagattcactcactgcatgtgcctgttatcaccagtgatctttcaacaaatggtaaagcttctctgagctcctttaccaaaagcgcatcctgtcagttaagctgaagttcagagatgaagcaccaacagccccatcctcgagagccggatcctgggagctttaaatctcattttccaaagctaggcagcagtgagaggtctgggtgccaagccccctctagctcttgtgatcctccctcatacatggactcaacccccaaatcctccccaccgtcctcagccccatacctcctggctcatgcggaagggggttggaggcccaagccttcatagccctgacttgaactcaacctcttactcctcccttttatctaatcctgcaggttgaaagtaacggaagcctacagaaactgatccgcatccgaaatccctggggagaagtggagtggacagggcggtggaatgacaagtgaggagggcgcaggcctcggggccccaggcgggggtgcattgtgctgggaggctctgggaagagggcgagagaagaagacatgtgcattattctgagaaatatagccaggagagcccaggccacgtggacagggacccgtggacaggggcccctcaaagggtcttttaaccaggacactcctccagcagcctgagtgccttcttccaggccccaagctgctcgtgtgaagttcattcctgccactgcctccaggttcaccccttccctagctcaaatccacccttctatggggctttcagggaaaaaaatacaccccaccttcccccaggcacttctattacagggatgtgaactttgtaccaaaggccagagaaacatccctctgttgatttccagggcttactggtaggcatgttgaaccctcaactatttggggtaaacacttgtttgtacatctgctgtggcaacctcagcctacttgctctgcctcaggttggagaggtgggcagtacagaggcctgtgtgtaattccagccaaagctcaggcagtggttagtttaccctgtgcactgcccctgtgtacagggccaggtccttctgctccgtggacagagagacacctgctgaggcttcccaggcctcagccggaggctcctcatcagatcttcagttgtctctaaaagagctgccaggcccatctcaattgggcaactgctctgagctactccatctccctctaatgaactatgttcattttctggactcttccttgccactgtcttccagcacaactcacccgctcactttgctccctggtttgcatctgtatagtgttctatactctttaaagtgctgtaagagtattaaaatgcagctgttagccagatgtgggctactttccccctttctggagcctgagccctcagaggtgagagcagatgtccctcttcctcaactctggggcctttggggagaaatcatcgtacactaacgcctctctctttactttgttttccagctgcccaagctggaacactatagacccagaggagagggaaaggctgaccagacggcatgaagatggagaattctggtaagattagtggaggcttcagggaaagctctgtctgccccaatgttctttactagaaaactgctaattagaaagagtgtcggccaaagtgagtttaccatgtcgaggacacaagcgtgtgggatcctggttttgttattttaagttcactataagagcctgaataaagaaattcttaagccccttcaacggtccatcttgacaatggggtttataagctgagcagcttcagaaaaaggctaagaggaattcctttggtaatgttcagatcccaggaaacaagggaaagatggggcctttctcccccaggttccggagactcatcccagccccttaagaaactggtcccttagtgagcagcaatggacccacatgtctgtgtgtctgcgccactctataaccacctgcacctggacacaacatgctctttatcaaatggggcccatatattgtcacatttgatgggcacggctcccatttttgcaggtgagagttctgagcttcagagaagtttaagtaacctgctcaaagtcacccagctagaaagttgcagcgccaggactggaatctgggccttctgattctgaacctggtgcccatccactcagttctaatgagctgctctgcctggctttgggtggctcctggtctggtgttggtggaaagtcaaggcttaccagtgtgtcttcttatcacctgtgatgattgtctctgcttttgccaggatgtctttcagtgacttcctgaggcactattcccgcctggagatctgtaacctgaccccagacactctcaccagcgatacctacaagaagtggaaactcaccaaaatggatgggaactggaggcggggctccaccgcgggaggttgcaggaactacccgagtaagggctgttgcatataagggctgttgcaatgcggggccaccaaaggccaaagctccccttaccccaccctgtgtaccacaccccagcctagcagccccaggaggcagctcctgctcactggaaccctctctgtcttctttctccctgagccttttcttttccctgagccttttctccccgagctctctttctcaatcccttacctcctgccctacccaggacaaacccaagagccactgtttctgtgatgtcctctccaggccctagattccccagcgcccatcatgaccttcagcctgaccttccgccatgctcacggaagcagtgctcaatcccacttcacggccatgagctgctctatgcaccccacacccaggcagccgagcctacaagggaaccttgtcccggcacccagggagccctccacatatcaggccctgtttgttgccccatactcacttcaatcagcaaatgttgactgggcgctgcccagatggggtgaagatttctcctctggtccagcctttgttgagccccttgattcttctgccttcatggcttagtccgtcagcagttgtctgaacatgatgacatctgccaattatggggcacaccttcagtgcttggaactatcctaagtgttttgtacacagggtgaggatccataatctgaaaatgtgaaatctgaaatgctccaaaatccaaaactttttcagccccaacatgataccacaggtggaaaattcgacacttgacctcaggtgacaggtcgcagtcaaaacacagtcaaaactttgtttcatgcacaaaattattttaaatatgctatagaattaccttcagcctatgtgtataaattatatatgaaacagaaatgagttttgtcattagacttgagttccatccctaagatatgttatgtatatacaaatattccaaaatccaaaaaaatccaaaataggaaacacttctggccccaggaatttcagataagggatattcagcctgcataacattctatctaaccttcccaacaaacttctgaggcaggcactttcttatcacctccatctctaagatgaggaaactgaggcttggagaggctagtgacttgctgaaggccacagagcgtgctgggatttgaacccaggccccctgactgaggagtcactgtgtaagtacagtggcagcagatcatggtcacatagtgattctctgtgacagatgaggaagctgagcctctaagtcgcataccagggccacagagcaagtagtcagactgcggctagctggcctacagttctggggctcggactccttcacctcaagtatgcagccaccaagtggcagtcccagaggcgctgggaaggccctctgccccccacaagggacccctcctacccactagatcaggagtcggaaaactccctctaaagggtcagatagtaaataattttggctttgtgggccactcagtctctataacaacaactctattgctataacccaaaggcagccatacttaagcgaatggccgtggctacgttccaataaaacgttatttacaaaaacaggcagcggccttcggagccatagctgccaacccctacacaagatggtgcctgtaatttcacagttagggttttatcccattaggtatggaaaggcaattagcataattccccttaaacatgaatgaatcttagattttttaaataaataggttttggaagtaaagagggcagagacatcaggagcagggcaagggaataggcctgagaggacaagggacgcagaacaagaaagagtctggaattatacacaggatgttcttggcctccgggctcaccgagggggcggcgaccggcaagtgcagggagcagatcccggagtcccccaggccagccgagccccgccccaggctccccatcagagcccagtgaagagaaggtaccatgaggggaagccacagctctaaccaccctgcgttccagagtgacagaccagtccccaagacaagccagcctggagccagagagagaactgcaagagaaagtttctaatttaggttcctgttagattcagacaagtgcaggtcatcctctctccacagctaccgtcacccgtctccagcctaacaaagcctgcagtccacactccaaccctggtgtctcccacctcctagcctctcccaacatcgcctgccgtctctgaccatcttctgccatcctctgccatctcccaccatctcccactgtctcccacagcctcccaccgcctcttgccaactcccaccatctcccgccattttctgacatctcccgctgtctcccaccatcttctgccatactctgccatctcccaccatcccccaccacctcttaccatctcccaccacctcccaccatctccctttatctccatccctctcagaagcctccaagcctgagaccagggccaccccccacccccatgcattcctgctcagggctgggctcctctgcccctttctggctgcagacacattctggatgaaccctcagtacctgatcaagctggaggaggaggatgaggacgaggaggatggggagagcggctgcaccttcctggtggggctcattcagaagcaccgacggcggcagaggaagatgggcgaggacatgcacaccatcggctttggcatctatgaggtgcagagcgcaggggctcctgccctcccttccccatgtgttcatctcagcccctgcatggaaagctgaccccagaggcagaactggggatgggatcccagaccgggagcttggccaaggaaaaacaaaactaccagcctggccaggctcaggagtagcccccgtagggaggcccctgcagtggctctgggttgtggggccttctaagcccttcacgggccccccacagccagcctgcagggagttccactctcaaatggcctccacatcccttctcacatcctccaggcctggcattctggtcagcctacccatcttcaaagaacagaatatactgggccacatcaggcaatactgtgagggcaggactgagtccatgggtgcagctgctcagagctcggcaaagtcattggcctggatggtggagagcttggggacaggggaacattggtcatgatgctccccccagggctctgatggctggagcccagatccctacacagactcctgctgtatgcgtgttttcctttcactctgagccacagccagagggcagccgcattgcagtctcctctccgccctcaggctggggctggggcactgagaactcacccaacacgctgggcccctgggctctccccactcccttctgcaaaacaagaaagagctttcgtgggctgcaggtagccatgcgaggagagggatgaaaggaaggctttagggcactgactggggatgcatttcggtttgatgggctggagctggctcctcccggctcccaaagcccatctcttttctctgacccatgtctgctgaggtccttcagcagcctgaaaaatggccctggcagggacctgtttacaccatggaaagtggcaaatagtacaaatcagagcttccaccctctcccaagagccagtttcccagcacacccctgggagaatccagacgaggtgtcaggagaggaggctctgtgctcaccactggcaacgttgccacccatggaacactgacttctacctgctcacccacctgagaaaggcagctgggcaaataccatcagttgtaaaaatgcacataggcctaaacccctccgtctctgaaacaggagctgaggacttcggatctgggacagaatcgatccaaggacaatgcaaatggaattgtgatacacagcttccctcccaccggcttatgggcttggaaatgcagccacgggctttcagagttgggacggaccttggggatcactgggtcctatttttgagacaagaaaactgaggccagagaggagaggggacttgctcaaggaaatgcagaccggaccactggacctggctgacagaggccggcactgctggctcctagccccaggtgtatttcacctcgcctgctgcctcctccaacagggcccgcctggccctctttccctgcgtgggaggccgatatgggctttgccaccttagacaagtctcttcacatctccatgcctgagatttatactctaagttaggaagggaggtgagggcttatcaacataagaggattttcttcagtgttggagaggctttgagttccttggaaaacagttactcggttgaattagttgatattgctaatgctacagagaaaacgggggcagcggaagagaagagcacagtgatgcattttcttacactgcttttccggcatctgaattgcatctcctttattttgcaggttccagaggaggtacgtctggcccatgtcccggggtgctcaggtcaccaaaaaagcgagaggcttagactgctggagctcagggagcgtcgtgaagcccgggcaggggctggtggtcatgaaggatgagtcctggccacccctggggccctgctgaagttgcccaggctctagatcccactggtctaagctctgggcaaggtttctggaaagtccttgtgggacccgctgcctccctgtgacctggcagagcccatacagggtttggttctgggcagaaaatccatgatcctgagactgcaggaggcttttcacaaagttctttgtcactcttaggagaagactgagtcagggaaaaggtgaaccctgcagactgtactagaagacaacgcgggagcacagaggagaccaggacccaattcccaggctgtgtgaccttggacacgttacagctcctctctgcatttcagggttttgttttttttttttttgatttttggtttgtttgtttgttttttgtctcgctctttcacccaggatgaagtgcagtggcatgatctcgactcactgcaacctctacctcctgggttcaagtgattctcctgcttcagcctccccagtagctgggactacaggcacgcaccaggatgccaggccaatttttgtatttttagtagagacggggtttcaccatggtggccaggctggtcttgaactcctgacctcaggtgatccacccccttcagcctcccaaagtgctaggattacaggtgtagccaccgtgcctggctgcatttcagtttatttttcagtaaaactggtcaaccatccacctcactgcactaccgtggaatgacttaaattttgcgagagcatttgggcccacagtcaccgcttgctgaagcagatgggatgcctggtccaaggtcacgattattaaagtagacacacggggcactttgacccacctgtagtacatttctttcacagcaaggcagtgcaaccggtagcacatcgggctcttttagatgctgctccagccttggtccggtggatcatgcttggtttagaagctgggttgtctttctcctgcccccagtcctgtctttgcttttatagtgcatcatacaccacgtagaaccgagccaggttcctgccatgtggacgctgttcctgcctgagagtctcttagaggaaggctgggaacactgtggaaagactgggcatctctgcaggcggagctgaatggatgtgaaacccctgtgggcatgtgcttccgagttcctcagcaggcatttgtgttttttggtagaaagtttgctttttgttttttttttttttaagacaaggtctcattctgtcacccaggctagagtacagtggtgtgatcatagctcactgccgtccttgaactctcagactcacgtgagcctcctacctcagcctcctgagtagctgagactacaggcgcttgccgccacccctggctaatatttttattttttgcagagacaggggtctcactacattgcccaggctggtctcaaactcctggcctcgagcaatcctctcacagcctcccaaagtgctggtattacaggcgtgagccaccacacctaacaaaagtttgctttttatctaaaatgacccaggcattgtcactgtactgctatttttttaaaaaaattttgttgttttgttgttgttgtcgtcgttatatagatgagggcttcctgtgttgcccaggctggtttctgacgcctggcctcgcctccttatacaccaggacagcaggactgagccaccacactacccaactgcttttatctcagtgaatgaaaatgatacttgcctggaggcttcccctcatctacccccatgtttctctatttattcctcagttaagtgggcagaccaacatccacctcagcaaaaacttcttcctgacgaatcgcgccagggagcgctcagacaccttcatcaacctccgggaggtgctcaaccgcttcaagctgccgccaggagagtacattctcgtgccttccaccttcgaacccaacaaggatggggatttctgcatccgggtcttttctgaaaagaaagctgactaccagtaggcggtttggtcccttcctctccccacccttccctgtccctccccactggtctgttcctcggcccctagagggctctttcatcctctgaatgtcagttactttttctgtaacacctgcccacctcgaaggactagtgtggggatttgatggattgaggaagttctagtgttatagtaaggtaaacaatggaaaaagccactgtggatatttttggttggaaaggggtggctgtacagtgaattgcagggtctaatttcataagcgtgtctctgaattctcaagttggtactttaatgttaaactacgaatccagtctcgtcatttgaagaaagctgagcagtgctggtgtaatccttgattttccaggccacctggcctagcagagccaccaagggtgtaaggtgggaaccatctcaacggttcccacctccagaacctctccctattatagttgtcatgtcaccagctctctctccccttcctcatgggatcccacgtttgggaaccctttgtggctgacatcaccatttcctgccactgtccaggtggcctcaattcacaatggcttctgccactttgacttctgcctcaaccatgtatgttcagctgggcacttgattggcaaaggcagaatctaccctgggtgatttaagctaaagggaattcatcgaaaggccattggagactccagaactgatgggaggtagggggtcaggctaggaagaacaggagccaaggatgtgttggaggaccagggtgtgagatgaccccttggactctgggtcatgtgctgaggtctaaagatcttgtggagtgtgtctgaggtgctgggcttgggtcagccacctggcctgctggttcctgtagaggaagagccaatgggaggtagaggcagggaactgcccttgccccaagataatgcatgatgcagaaataatttcccatggcgaagggagacaaagcaatgccaggcagctgcataccaatgaatgccaccatagcacggctgtagcccccctgccactgacaggctgtcttcatttgctaaagcctaccatgggggaagggacctttcctctcagctctgaggatgcttagaggaagactggtgtgttcagtttagtcctcactgacaagaaaataggagcatgacctggtggcattagaataacagtgtcctttgtcaaactcattactctccctgccagccacaagtcactctcccagggaagcctcaacccctcaactctctctagggtgagctccctaccccaagaggacaccccacctctcaaaggtttctgacttccttgtcccaaaatattaatccttctgctccagattccaatgatcagcaccaagaggtccccttttccttctgccaggcattggccctgctgataggactcttggtcacttagttaaaatcacagtggcccaaggaagaacctcctgagcttgattaccctcactatggagcagaaggacctggccctggacacaggggcggtgcacagtataaactaaccactgcctgacctgagctttggctgaaatgacacacaggcctctgcactgcccacctctccaacctgaggcagaacaagtaggcgatgatttgcactgcatgattctcagtgtgaaagtctatgttggcaaaggatatttcaagtggaacttagaagctattccttaaggctaggacgaacaccacgctacacgcgaaggctatcctatttgataaagatcaaaaactagcaaacaaaaatctccagctgcccacgttgctttggtcatgacccttccttcagatcacttctgcctttatttttgctgtttaggggatgtgttatcacagaaacttggaatgcagagaaatgttatcacagaaacttggaatgcagaaaaatttttgctttttaggggaggtgttatcacagaaacttggaatacaaagacctccccccaccgcagccctgccccaccccacctaccccctgctggatttagcactgcacttccattttagcagtgatttccttcctttttgccctcgcctgccttccagtaacacataatttccttctatttccagagctgtcgatgatgaaatcgaggccaatcttgaagaggtatttgtaactctttgaatttcacccactctgtcctggacaatccagagagcagaggagcaaaaaaactccaagagtttttggacttcacgaacaaagcctgaaactaaggataaagccgggtactgggaatccaagagtcgactacctgcatcagctctggcctctgtgctgggggcatgggccagtcccttgcctattgggctgtgctagccactgtcaaaatccatccacaacattccagctagtctttattcttctgagtccccactagaatagatcctaaaaggccattttaattggatgctagagaagatacctctgtgagaaattagaatattactccttcccacataatttacattccttcttgtgttttaattagaaaaaaaaaaccttatattaattcttcacactatacctgatcttaacccaaatcaccgtagaatttgggccccagggaggggtagagaaggggagtgggaggtggctgccatggaagggcgggcagacacttggtgtcatgcctcgctctgatgcattctcatgtctctgcctcaccttccagttcgacatcagcgaggatgacattgatgatggattcaggagactgtttgcccagttggcaggagaggtaaatgttcccaaaaacgatgttatgcactctggttgatgcaaaggaagagacagtgtgtgtccccaaggggactttagtttaaaggggagaggaaacaaactgaacaaaagcaaagagaaattgcaaatggcacttgggttccagctcagccctcttgcgtgtgtcctccctaagacctccgcatgctgccgggggcttccatttgcatggtcagccctgactctgtgttcctccttccttaggattcctgggctcaccttgtgactgttttattttctctgttctacaccaattgaggcatgaaacttggccccttatccttgatttccacaaaggatttggagagatggaagggtttcaagtctcaagaatgcaggccacctgcaacagagtgtttgaattaggcttttctgttctcttttcttttttctttttttctttttagagacagggtctctctctgtcacccaggctggagtgcagtggcatgatcatagctcactgcagcctccacttcctgggctcaagagatcttgccaccttagtctcccaagtagctgggactataggtgcacaccaccatgtctagctaatttttattttatttttatttttgtagagatggagttttgccatgttgcccaggctgctctggaactcctgggctcaacaatcctccaaccttggtctgccaaagtgttgggattacagatgcataccaccatgcccagctaatttttaaattttttttagagacagggtctcactttgttgtccaggctggtcttaaacccctgagctcaagcagtcctcccacctcagcctcccaaagtgctggaattacgggtgtgagccaccatacctggccacttccctgttcttaaaaaaatccctcagccatttagtcccatcacaaagttatttagccctctttcttcccaacaactccaaaaaaaaaaaaaaagtcctctttcttcactatgtggaggaactttccaatcattgagctcatctggtactcccttcgctgacctaaagacccatcaaagtactaagccaggcatcgtctgctctgcgcctccaccggcctctcaccctctgctccctcccagattcccaaggaaaggggccatgagagtcttctttcccctctgattgaatcccacacatacacaccccaaaaggcaaacatgactgcaatcaatcttggttttaaacaaaggagtttatccatgagttacacaaatatgtgtaagtggatagagacatctgagcccatgaggggccctggcatgatgggcatagaggagggccggctaggtcttggagacagctggttttcaccagttttacaggaagtctgagctttgagttttaaagaatgaagaaaacatgccagataagaggaatggtataagagaattaagaaagaccacaaacatgggtagaggggagtatttattatttatattctctacagcaaagaaatggtgagtgaactctccctactgcatccgtacattaaaacaccgtatctaggctgggcacagtggctcacacctgtaatcccagcactttgggaggctgaggctggaggatcgtttgagcctaggagtttgaggtttcagtgagctaggatcattccactgcagtccagcccagcctgggtgttctaaaaagaaccaaaccaaaaacactgtatctaaaatccagaatggggcagtactactcaaagtgtggtctggggacagcagccccaacatggctcgggggcttgttagaaatgcacattcataggccccaccgcaggcctacctaatgcactggtgtcctgccctgtgctcatccagctcccacggggggccaataactatgctctggttatgtgtccacaggatgcggagatctctgcctttgagctgcagaccatcctgagaagggttctagcaaagcgtgagtatcccctcattgcaaaacctcatcctgctctttcccctgtggatgggagggaacatggaaatctttccccctccatgtctggctgctgtgactaaaccaccaccctccatcccctccaagaagtggatgaaggatttgtatgatgtgatgaaaaagaacaagtgtttgtagcatccacagatcaaagatcaaatccaggtttccactacatactagctttgtgtgatctatttttttaatttattttattttatttttgagacagagtctcactctgtcgcccaggctggagtaaagtggcacaatctcagctcactgcaatctctacctcccaaattcaagcgattctcctgcctcagcctcccaagtagctggaatcacaggcaagtgccaccacagccagctgacttttgtatttttagtaaagacagggtttcaccatattggccaggctggtcttgaactcctgacctcaagtgatccacctgccttggcctcccaaaatgctgggattacaggcatgcactaccacatccagctaatttttgtattttcctagagatggggtttctccatgttggccaggctggtcttgaacccctggcctcaagtgatctgcccacctcggcctcccaaagtgctgggattacaggtgtgagccaccgtgcccggccacatcttgtaactaactatttcttaagcaaaaaaatgtcagaggattgattgttcaaccccttactgtggatcaccagcagggaggagcgggaaacacaacacagagacattttttcccctcaaattatcaaaagaatcacgctgcatttgttaagagagcaactggcaatccaggaagcagagttttgaacatatcagaagttaggaatctgcatcagagacaaatgcagtcatggttgtttgctgcataccagccctagggatcatctcgagaagcctcatggacttcaagggacatcattccctctgacaagatggcctctagcctaactccatgagataaaataaatctgcctttcagagccaaagaagagtccagggccagctgggtcttccctcccagtgtgaaccaagagggctgggccagtcaggttacggtcagtccagtgcagggcctccccagaggagacccagtctgcacccgccctcctctaattttcagggaaggcaagaagattgtgtttaccctggaggccaccaggcacaagtgaggtcacagagctcttcagatatgcagtcctcatgagctgaggagactaaagcctcattgtttctgcacagatggagggtggggctgggaggtggggaagaagcgggccttgcctggattcagcccgctccttgctgggggagcagcattcgctccgcgcgtgcctctgagcttactaccctacccctagctgcctgctgactccagccttctggagggctccacaccagagtctgcatgcacagctgctgggccagagccttatgaccatctaaggggttggtgcccagagtggcagctttgaggcaggtcaggctctaacctctttcggggacataacaaaaaggctgggcttttcgtgaagtctgtggggagccaggttcacattggtgactagggagggtctcatgccacctgccaaacaccaagtggacaggactcacttagtgcagcacaaatagctcgtggatcgatcccagttcctcaggtttctcagtcagctggggacacagtccataaatgtctgcagatggacagttcaagtaaacctctttctctcacgggtcatagcctagaattaacacacctgctctctgttttctttttccctgcccaacaactacaggtgactttatatcctgtgggcacctaaggcccaaccattgatcattctgttatttatttgttcaaaaagcactttttaaagccctgtttgcccacggcaaatatacagagacatcaggacaatgtggacatcatctgcactgtcccagtctggtagtcactagccacatgtggctatttaatataatggaagtggcttctgtatgtgaagggcacagataaagaatatctccatgattgtggaaagttcagttggacatcaccgctcagagatttttcctgtcacactgattttgtcttttaggccaagatatcaagtcagatggcttcagcatcgagacatgcaaaattatggttgacatgctagatgtatcctttaatgtgctccagggaatagagactgggggagtttaaaatctcactccagaaagattcaaacacatggccttctcccttttcaaaatagccagttgttcccaacttgctgagttgctgtcggacagtcagcagcgctgacctcccttactagggaaatgcgagaaccctctgatgagggaaagcaaatgctacaccccccctcccacctaccctgaaaggcttagaatgcaggcccatggcgggcggtggctcatgcctgtaatcccagcactttggaaggccaaggtgggcctcctgactcacgaggtcaggagttcgagaccagcctgaccaacatggtgaaaccttgtctctactaaaaatacaaaaattagctgggtgtggtggcgggcacctgtaatcccagctactcaggaggctgaggcaggagaatcacttgaacctgggaggcggaggttgcagtgagctgagatcgcgccactgcactccagcctgggtgacagagcgtgactcatcgccaaaaaaaaaaaaagaaaaagaatgtaggcccaccagtccattcctggggctggtgcgggaaattcctgacaatatgcccatcacttctttgcacaaagcagctcgaatttgtttcctcagtgatgtgtttccattacttcctctaggaaaatattccctaaccacagtatttctgatgtgaatctgttttgtctgatcaagatcgtcgtcttctttatttatttatttatttattttttattattatactttaagttttagggtacatgtgcacaatgtgcaggttagttacatatgtatacatgtgccatgctggtgctttgcacccactaactcgtcatctagcattaggtatatctcccaatgccatccctcccccctccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgagccacattttcttaatccagtctatcgttgttggacatttgggttggttccaagtctttgctattgtgaataatgccgcaataaacatacgtgtgcatgtgtctttatagcagcatgatttatagtcctttgggtatatacccagtaatgggatggctgggtcaaatgatatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattatggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaatttgttggagttcattgtagattctggatattagccctttgtcagataagcaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggttttgatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttatcaaagatcagatagttgtagatacggcgttatttctgagggctctgttctgttccattgatctatatctgttttggtaccagtaccatgctgttttggttactgtagccttgtagtatagtttgaagtcaggtagtgtgatgcctccagctttgttcttttggctcaggattgacttggcgatgcgggctcttttttggttccatatgaactttaaagtagttttttccaattctgtgaagaaagtcattggtagcttgatggggatggcattgaatctgtaaattaccttgggcagtatggccattttcacaatattgattcttcctacccatgagcatggaatgttcttccatttgtttgtatcctcttttatttccttgagcagtggtttgtagttctccttgaagaggtccttcacatcccttgtaagttggataagatcgtcttcttgatttagataagggctactttcatgaggatcctacttcccttttgctctagctccttcccaggccacccacctttccccaaggcaaactagtcatccatttcccccttgtttccaatgcttagtgagaagtggtggtaaggggcagcctaagcttctgtgaagttttttctgtttgtttgtttagttggttggttggttttttgagacggggtctcactgtgtcacccaggctggagggcagtggcatgatctcagctcactcgaacctccgcctcccaggttcaggtgattctcccccctccagcctccctagtagctaggactacaggtgcgcgccaccatgcccagctgatttttctatttttagtagagacagggtttcaccgtgttggccaggctggtgtcgaattcctgaccacaggtgatctgcccaccttggcctcccaaagtgctgggattagaggtgtgagccaccatgcctggccacttctgtgaagttttatctagtggattcatggtgtacacctgctagctcccttcaccaaaggcctcttagatatactccacatactttaaaaaaaacagcaagggcctagccactagaagccatccaaagccctctgcatgtcatccaatacctcatttttagtagtatctggggcctccacagcacccctagatcaaaacagcaaccagattcggcagggagccagcaggtctttctcgcccttcctccaatcctttaaatggaggtttagccagtgggaaaagcaggaaaaggatccttctgcaaaccctccttgtgtatatgctatgatattcaaaagatccagttgagaagacaaactaggtgacactatgtgcaaatggacccacactcaagggctttccttgactgaaggcagtcggacgggagtggcaagctggggctgaaggagttctacattctctggacgaagattcaaaaataccaagtaagatcccagagatgcgggtggatctgtgttgggaaacattctgttcatatgctttaagatgcagcaactcctgcacagagtggagaaacatttccaaggggattgggattttacccataatgaagctcagagtgagtaaagatggggctgaggaaatgcaaacaaaaaaccaaccaggacttcgcaggtgaaatggcctattcccttcctcctgattattgggatcatctaaaggccaccatcaagggtttcctgaaaagggtttttgacagctaaagtacaaaaattatataagacaagaacatggacctatgggcgttggctggctgatttgatgggcatatttacaaaccagctcacagacagaagcaaaatactattagttatttaaggcagaaacataagtgattcttccacggccaaactagaggcacagagctggaaaaacttcatccccactcagcacatactagggaggtaacttgccagctttgctttgggtcatagttcttacagctaacttatgtgttccagaaaatttaccgagaaatcgacgttgacaggtctggtaccatgaattcctatgaaatgcggaaggcattagaagaagcaggtaaccctttataactgcattttcgttcctagtttaatctgtctgtagaatatgtgaacactcatcttataccatataacacaagatttggtaaagctataaaataaagtaggtgctggtttaatacagacacctccttttcattcccctttcaaagactaattggtaaaattaaatgcagtaggatgctctgccctctgtgccttcttgaatccaagtttcctttggagccgcctggcacagtaagcaggcaaagccaggtctcaacagcctcctccaggtgcttcctttctggtgcagggttggttaggcagaaatcaaatgtctcagctcagcccttagggtaagaccctagcagaattggatatcaataaaaggacacaagcgagtggtagaccagcaaagcaggagactgctgggctttgggaacaaatgtgtcagcatgaggctgttcattctatttgctggaatataatgctgctgcagagaccccacacaacattggtttatacgaggtatgtctttctgtcgtatagcaatcccagctccagcagtccacggctaggacggtgcctcctactatcctaccatgtcactatctgatcacgcttcccccagcctccccccatccatgatgcccaccggaccttcaagggtcaccctcatccaagggacctgggacagcctgccaccacaaacacatgccaccaacaggttgacagaagaagggccccttgcctttaagggcacacaggccatttccggtcacacatcccaccagccagactctgatcacaaggcctctgttgactgcaaggaagctgggacatgcagtcttgatgctaggtggccataggctcaataaaaattattttactctggaaggagagagaactactatgagtttaccaggaaagcttctgctcacatatatccaggaagaatctgatcttcaagacgattgagagctaaacaaaaaatcaaacagcagcagcatggttaacaacatgaagcaactgtgaccatgagaacagaaacaggcaagaaaacacttatgtgtcagcaaaggacacaggcagggtgaaggtggacagttcaaaaacaaaagaaacagcagaaggtactggctttgcaaaatcaaaccagtctcacagaagagcagccaagggacaaaagcaattatacctcatttaaatcaccacattagtttcatagcctgtgagcgcagctaaatggaacaatctaatgcttagcaatgagtttgtttgttcatgtaacttcaggtttcaagatgccctgtcaactccaccaagtcatcgttgctcggtttgcagatgaccagctcatcatcgattttgataattttgttcggtgtttggttcggctggaaacgctattcagtaagtggatatttggggaatgactcatttcagttctcttggtattaaagtggcctgcctttcacctcggtgaaatcatctaaactagagacatgtcttccaggagttgagaatgaaattccctctttactaatttgagggtgaggaagaaagcatgtatggtggtcagtgaagtcagttgctgaactgaaaagaggataatgtgatctgtttcagctcactcacttgtgacaccctctttttctccctccacagagatatttaagcagctggatcccgagaatactggaacaatagagctcgaccttatctctgtgagtcagcaggccccgccttgcttctaaggggatgggggaggcatggggcggaaagggctgttacttgagtgatctgctttttcaagttttgctttaaagagctcttggtctgtcggggccaggcctgtaaccggttgtaagatcccacaatgcacttttacttgcagttgttttccaaccacctattctcaagtccaaaatgcacgcctggctccctcttctcatgagctttgacttgagtgtagctcaaggttaaactaaggagtggctgcaggatcatgcttagaaaaatgaactcctgattagcatgcaagggagaacatgtttatataaagaaatccttcagctgaaattcaagttgggttttgggaagatccatcattcttagagtggatctacttaaaatactttaagcaaattagttttctctactccctccccgtttaagataaaaccaatactagtaaatacgtttgccatttattattgttattgcactcatgtgtctggaaccctagcaatacacatctctgaaatgatcatcaatctgaattaagtgggtatgctaatttcacaaaaagcaaagcgtaaaatgttctcgtgtcatcccaatgacaggaagttctctcactgaaagaaagaagccaggtggggtatacttccattatcacctggctccagtcagcatttcctctatactcagggaaggccacagagggccgggcgaagtggctgacactgggtgagaatggcagttgtcagtcctgtccgtgtaacagaggagtgaagtggtgaggagggcaggtctaaggcactggcagctcttttccatggattttgaactctggaggaaggcagcaactaaataactgtctcattctgctattatgcattgtattagcaaagtgaaaatatagtctatctggttacaaataacactaacttgcttaaaactttacatatcctaggaaatatctctacccctagattgcaatgtagagtcaaccccatctctaaaaaaataaaaaattaggctggccgcagtggttcatgcctgtaatcccatcactttgggaggccaaggcaggtggatcacctgaggtcaggagctcaagaccagcctggccaacatggtgaaaccgcgtctctactgaaaatacaaaaattagggctgggcgcggtggctcacatctataatcctagcactttgggaggccaaggcgggcgaatcacctgaggttgggagttcgagaccagcctgagtaacatggagaaaccccatctctactaaaaatacaaaattagccaggcgtggtgacacatgcctgttaatcccagctactcgggaggctgaagcgaaaggattgcttgaacccgggaggcggaggttgcggcgagctgagattgcaccattgtactccatccagcctgggcaacaagagcaaaactgcatctaaaaaaaaaattagctgggcgtggtggcaggtgcctgtaaatacgttactctggaggctgaggcaggagaatcacatgaacctaggaggtagaggttgcagtgaactgagatggtgccactgcactccagcctaggcaacaagagcaaaaccctgtctcagaaaaaaataaataaaaaataaaaaaatgagccaggcatggtggtgcgtgcctgtagacccagctacccaggaggctaaggtgggaggaacacctgagcccagaagtcaaggccgcagtgagccatgatctccccactacattccatcttgggtgacagagcaaggccctgtctcaaaaaatttaaaatgaaataaatagtagagtcaacacaactgtgacacgaaacatgccacatgttaagttctggaaatcctagcctgtcattcttgctggatatcctattctaccccagccacccacccccactccagggtccacctggcctgcctgctcagtccactccctccgcatctcctccgagaagcatcttcttacccactggcttttcctgccactcctaagccttaccttttgcaggttcctggagatcctcgcttctcgtagtctttgcaaggatgagccatgttcagaagctctccgttcagtctgcagggatttcaaccttggctgcagattccatcacatggggagctttgccaaagtgctggtgtcctgtctgtatcccagaccagttgaatcaatctgatttaaagtttccgtatcactacaacttagaaccaatgctgaacaccattggttgcagggatatccacatcccaaactaacttctgatgtgatactctgaggcagagatgtgaaaatgctaatttctgttgtgtgaatttcacttttcatgtgtgcaatcaaccctgtaatatgattcatggccacttaatgcaaatcacacagactactgacctgttaaaagctagactctagaaatcaggtaagaaaaatatgagttagtgcactgatattgtagccctcaatcagcttttccagtacaagttttttggaacaatctacaggtacttaaatagcctttaattttaaaagtggtcactgagctgacttttttttttccttcctcacagtggctctgtttctcagtactttgaagttataactaatctgcctgaagacttctcatgatggaaaatcagccaaggactaagcttccatagaaatacactttgtatctggacctcaaaattatgggaacatttacttaaacggatgatcatagctgaaaataatgatactgtcaatttgagatagcagaagtttcacacatcaaagtaaaagatttgcatatcattatactaaatgcaaatgagtcgcttaacccttgacaaggtcaaagaaagctttaaatctgtaaatagtatacactttttacttttacacactttcctgttcatagcaatattaaatcaggaaaaaaaaatgcagggaggtatttaacagctgagcaaaaacattgagtcgctctcaaaggacacgaggcccttggcagggaatatttaaagcaacttcaagtttaaaatgcagctgttgattctaccaaacaacagtccaagattaccatttcccatgagccaactgggaaacatggtatatcatgaagtaatcttgtcaaggcatctggagagtccaggagagaagactcacctctgtcgcttgggttaaacaagagacaggttttgtagaatattgattggtaatagtaaatcgttctccttacaatcaagttcttgaccctattcggccttatacatctggtcttacaaagaccaaagggatcctgcgcttgatcaactgaaccagtatgccaaaaccaggcatccaatttgtaaaccaattatgataaaggacaaaataagctgtttgccacctcaaaactttatgaacttcaccaccactagtgtctgtccatggagttagaggggacatcacttagaagttcttatagaaaggacacaagtttgtttcctggctttaccttgggaaaatgctagcaacattatagaaattttgccttgttgccttatcttcttccaaatgtactgttaaataaaaataaagggttaccccatgcaatcacaccatgccatgttttccttcctggagggcagccccacaggacggtttatgagcacacaattatagcttgtttctactttaacaaggtatgctgcctctgtaaattcatgtattcaaaggaaaagacaccttgcctataattaaaatgtggaactataaaattttttaaaatccaa

SEQ ID NO: 724 - DNA, 94027 bp, Homo sapiens
ggcccgagccaccgactgcaggaggagaaggggttgtgctcctggccgaggaaggagaaaggggcggggccggcgggcagcgtgcggcagtgcggagctcctgagaccggcgggcacacgggggtctgtggcccccgccgtagcagtggctgccgccgtcgcttggttcccgtcggtctgcgggaggcgggttatggcggcggcggcagtgagagctgtgaatgaattctccgggtggacgagggaagaagaaaggctccggcggcgccagcaacccggtgcctcccaggcctccgcccccttgcctggcccccgcccctcccgccgccgggccggcccctccgcccgagtcgccgcataagcggaacctgtactatttctcctacccgctgtttgtaggcttcgcgctgctgcgtttggtcgccttccacctggggctcctcttcgtgtggctctgccagcgcttctcccgcgccctcatggcagccaagaggagctccggggccgcgccagcacctgcctcggcctcggccccggcgccggtgccgggcggcgaggccgagcgcgtccgagtcttccacaaacaggccttcgagtacatctccattgccctgcgcatcgatgaggatgagaaaggtaactagggggctgggggagggggcggcggcgccgggaagaaggcggtggggtcgccgggggagggcaacacctgcgtcccttttctgcgggaggggacggtgcacccccggaattgatatgccccgggagactgctttcccgtaggtcggagcctcatcttctagtattcttaaaacctctcccctttcagggcactgtagctgtcgactttgtttcagacaccagccttcccccacacttctgcatgacccaggtcactatgagacacccagacgtgttgatgacagtgacatttgtcctagagtgaccacactgatcctttctagcactgtgaagagtgtgcagcttcctctgaaccaaggtttccaaaaggttttgatattgaagaagcagtgccgccttactggcttttaatgaaagcagagtattgtagtgtcagaaaaaaagaacaaatggtgacaattttgaaagaaatagctgcatatgactgcagttgaatttgcatcattttaatcaagataatcattttatcagtacaacgattcctgaatactttttcaatgaagttatatttagcataaaacttttccccctgttgctttgattttaattaaaacagtattccaaagtagcctttaatttccaagttgaaatgtttgatgaatggattgcgtaaacttaaacataccactttacagtaaaacctaaaacaactatgtatgtttctgaatgaaagcaaggatactacatctttcgggtttcttttaagctaacttttttttttttttgagacggaatctcgccctgtcgcccaagctggagtgcaatggtgcagtctcggctcactgcaacctccgactccctggttccagcgattctcctgcctcagcctcccgagtagctgggattacaggcacgcaccaccacgcctggctaatttttgtatttttagtagagtagggatttcaccatgttggccaggatggtctccatctcctgacctcgtgatcgggtcgcctcggcctcccaaagtgctggtaatacaggcatgagccaccgcgcctggccttaagctaacattttttattatatgtgccaggcattgtgctattagctttgcatgtgttatcttttttctttttaaaaaaaatagcaaccatcccagaccatgaaaagtgttatttaatcctcacaataactttgtgagatgaaggtattattggtatcagcattttagagatgaagaaaatgaggcccaaaagataaaggaggttattccaaacctgtgctaataatgaaatttcttttatggaaaataagtgaaattaggagaagtctaacttttacaattctccccttttatccttacttccagtatgctgagatcttgcttctccctctgccaaaaacacccacttttctaccacacctcaattagatactcacttgcattgtccattagtgaaaacagaaacaatctgcacttcattcatagtgtctgtctctactgccaactccaaaaactgttctagaatttcaatcttgttgaaacctgtttcctttgtggggcctgggagtgggaagtgggatataaggaaagaggcagttattcattgttttggacagtaaggaaagagtgacggttaagagaggtcaaggagggtgttaacatttaagaatactatgtgtttgtagaaggaaattttttgttaactgctccattcttttttttttttttttttgagatggagtctccctgtgtcacccagactggagtgcagtggcgtgatctcagcttactgcaacctctgcctcccagacgcaggcgattctcttgcctcagtctcccgagtagctggaaccacaggtgcgccctatcacggctggctaattttttgtatttttagtagagatggtgtttcaccatgttggccagactggtcacgaactcctgacctcaggtgattcgcctgcctcgaccttccaagtgcttggattacaggtgtcagccactgtgcccacccagcaagctccattctttatcacctcttaagaacatccaggatcccttggggagaattaaaacggttgcaaagttttagaatagaggaacatgtttaagcgtagatcattttttgggccagtcatggtggctcacgcgtgtaatcccaacactttgggaggccggggcgggtggatcatgaggtcaagagtttgagaccatcctggccaacatggtgaaatcccatctctactaaaaatacaaaaattagctgggcatggtgacacatgcctgtagtcccagctactcaggaggctgaggcaagagaagtgcttgaacctggaaggtggaggttgcagtgagccgagatcgtgccactacactccagcctgggcggcagagcaagactccgtcttgaaaaaaaaaagtaggtcatttttggctgggcacggtggctcatgcctgtaattccagcactttgggaggctgaggtgggtggattgcttgagcccaggagtttgagaccagcctgggcaacatagtgaaaccctgtctttgtgaaaaatacaaagattagctaggcgcagtggcaaatgcctgtagtcccagctacttggggggctgaggtaggaggatcacttgagctcaggttgttcaggctgcaatgagctgagatcgtgcaactgcactccgaactgggtgacaggagtaaaactgtctcaaaaaaaaaaaaaaaaaaaaccaaaaaaaaaaaaactgttttaattgttttatttaggaagagaaagtcagaacatgcaaggaaattttttttatttgtttatttttgagacggagtctcgctcagttgcccaggctggagtgcaatggtatgatcttggctcactgcaacctctgcctcccggattcaagcgattctcctgcctcagcctcctgagcagctgggattacaggtgtatgccaccacgcccagctaatttttgtgtttttagtagagatggggttccaccatgttggccaggctggtttcgagctcctgacctcaagtgaaccgccctccttggcctcccaaagtgctgggattacaggtgtgagccgcggtgaccgaccacaaggaaattttagttaacactgttggttgatgggagttgggaggtaggataaaaggagaaattaaggaaaacctaggcatgaaaaataaaagaccctgagctcttagatttgaagaaatagcagttccatgtgaggaataagtggaagaaatagaattcagacctcaggtctcaggctggtgacttaaatctttcagtatcacatatatgaatatatctattatacttaaatcctcctaaacatttttatttttcagttggatatattaaatatataaaaataattatttaatttattttagagacagtgtttcactctcttacccaagctggagtggaatgtgatcatagctcactgcagcctcaaggctcattcctaggcttaagtgatcctcttttttttttttttgctagagataggatcttgttatgttagccaggctggagaaatttcaacaatattttgaacaataaaaaaaaaataaattaggttttattgtaaagtggtatgtttaagtttacgccattctcctgcgtaatgcatatttcatactcttcctactgataatgtttctgttcacaactttttctttatattttgatttcttttctcttttctttttttttttttttgagacagagcctcgctttgtcgcccaggctagagtgcagtggcgcgatctcggctcactgctagctccgcctcccgggttcacgccattctcctgcctcagcttcccgagtagctgggactacaggcgcccgccaccatgcccagctaattttttgtatttttagtagagacggggtttcactgtgttagccaggatggtctcgatctcctgacctcgtgatccacccgcctcggcctcccaaagtgctgggattacaggcgtgagccaccgcgcccggcacatattttgatttctaatgtggacatcagaatgggctgttgacagctcttttttttttttttgaggcagagtctcgcttcttcacccaggctggagtgcaatggcgcgatctcagctcactgcaacctccacctcccaggttcaagcgattctcctgcctcagcctccccagtaactgggattacaggcatgtgccaccccacacccagccaatttttgtatttttagtagagacagcatttcaccatgttggccaggctgttctcgaactcctggcctcaagtgatccactcgccttggcctcacaaactgctaggattacaggtgtgagccaccgtgcccagccttgacaggtctttagtttgattttagttcaacaactgatgccgtaatatgccaaattaaattagttcagactgaaacggattacttaaagattcattttcctttaaaaatgaagtaaaactttagccggatgtggtggcgggtgtgtgtaatcccagctactcgggagggtgaggcaggagaatcgcttgaacccaggaggtggaggttgcagtgagctgagatctcacccattgcactcctgcctgggtgagaagagtgagactccatcaaaaaaaaaaaaaaaggctgggcatggtggctcaagccgggtgcagtggcccatgcctgttatcccagcactttgggaggcagaggcaggcggatcacttgtagtcagaagttcgcgaccagcctggccaacatattagtgaaaccccgtctctactaaaaatacaaaaattagctgggcatagtggtgcacgcctgtagtcccgggtacttgggacgctgacgcaggacaattgcttgaactccagaggtggagattgcggtgggccaagatcacgccactgcacgccagcctgggcaacagagcaagactccatctctcaaaaaaaaaaaaaaaagaaaactgagtttatattgttatggttcttatctatcttaaattttttctttaggagattgaatatttttgtactttagtcttaatccagtggttgaaagagagtgcacttttgaagtctgcctcttggctgtccttgacaacacaaaccttagttccaagagaatgtaattcttcctctttctcagtgcttcaaaatatatatgatcaaatagaaacgagttgaataggcagtctcttcaaaggtttcctaactctgtggttaactatcaaggagctggtaatatcatgcactgccattcccttggcaacatgacttatcttttttttttttttttcttttttgagacagagtcttgctctgtcacccaggctggagtgcagtggcgagatctcagctcgctgcaagccccgcctcccacgttcacgccattttcctgcctcagcctcccaagtagctgggactacaggcgcctgccatcacacctggctaattttttttgtattttttagtagagacggggtttcaccgtgttagccagtacggtctcgatctcctgtcctcgtgatccgcccaccttggcctcccaaagtgttgggattacaggtgtgagccactgcgcctggcctacttatcttctaatttaactgaaaaccaatttatttgattcagtgaaatggcatcaaactgtagtagtgttaattgaaatatttggtaccttgaaatgttaaatgccaaattaaatctcattttaatgaaatctcgtgtaaatgtgttttatatggtgactatgtttattctgaattttattcttatggcatactaaaaaaaaaaaaaatttttttttttttttgtaatggagtcttgctctgtcacccacgctggagtgcagtggcgcaatctcggttcactgtaacctccacctcccgggttcaagcgattctcctgcctcagtctcccgagtagctggtactacaggcgtgcaccactatgcctggctaatatttttgtatttttaggagagacagggtttcaccatgttggtcaggctgatctcgaactcctgacctgaagtgatccgcctgcctcagcctcccaaagtgctgggattacaggtatgacccactgcacccaacccatactcaaatttgacactgaattttcataaaggccttaatttatctgaaaccaaactatttcaaaagaggaatagcacagcaaattctgttgacttaatgagaggatatgtgaagtctatttattaaagcaaatattaattggaggccagttaatttgtacagctctgcattttagatatttgagaaatatttatttcctctccagtgagatgtgttaaaacattagttatgtgattaacaaatatgtgtacatacgtatatatgtacatacacattttgagacagggccttggtctgttgttcaggctggagtgcaatgacaccatcttagctcattgaagcttcagcctcgcaggctcaatcgatccacccacctcagcctccctagtagctgggtctacagacatataccaccatgcttggctgattttttaattttttgtagagatggtgatcttgccctgttgactaagttggtaaatattttaattgttgaactttcttggaagactgaaaacctgtgatagccattttatataaggagaagctgaagttcaaagagtagactcatagcagaaacaaaaatagaatttaagtgaatggactcaaaatattgtactttttactttatactgcaggtttttatgttgtaatgctggtaatgagctccttggaatatttggaggaaaagagaaggttgtaataatggttctttggatttactagaacatatcatgttctgcatggctcctgtgggtagacaagccggaaatctcctgggtaacacaatggtggaggttctctaggtgacgtttgatttctcaagtacataggactaaacagaaaaggcctagtatgttatatgaatgagagatcaagtttctcaggatattctagggctaaaggatcaggcatcgaagacagaaattgtctaaataaaattttttctattcatagttttaaagggctaaagggtcaggcattgaagacagaaattgtctaagtaaaatatttttctgttcatagttttaagctgtgtatatgtgcatgtgtgtatttaaaataacttcgtcaatgaaaagagtcaaactctgtaaaatatttgaagagatttattctgagccaaatatgagtgaccagtggcccatgacacagccccagtagatactaagaacatctgtccaaggtggtcaggctatagcttgattttatacactttagggagacataagacgtcagttaaacatgtaagatgtacattggttccatctggaaaggcaggaaaactagaagttggggaggcttccaggtcgtaggcagattcaaagattttctgattggcaattggtcaaaagagcttatctaaagtcctggaatccatagaagggagtgtctggtttaaaataataggttgtagctaccaaggtttttattgtacagatgaagcctccaggtagcaggcttcagagagaatacattgtaaatgtttcttatgagactttaaaaggtggcagactcttaagttaattttctcctggttcaggtaaaagacttggaaagggaaaggattctctacagaacgtaaattttccccacaagagaaagctttgcagggccatttcagaatatgtcaaagaaatataatttagggtaaaatacttcaatttgttttatttatttatttattttttgagacagagtctcgctctgttgcccaggctggagtgcagtggcatgatctcggctcactgcaagctccgcctcctgtgttcacgccgttctcctgcctcagcctcctgagtagctgggactacaggcgctggccaccatgcccagctattttttttgtatttttagtagagacgggatttcaccatgttggccaggatggtctcgatctcttgacctcgtgattcacccgcctcggcctcccaaagtgctgggattacaggcgtgagccactgtgcccggcctcaaaatacttcaatttctttcatggcctgctatctgacgtgatgctgtactagagtcaggctgggaatttggcgtcttattgctacaaaacatcttaatatctctgttttaatgttaatgctgatcagttgtccctgaattccaaagggaagagggtatatgagtcatgtccaacccccacttctcattatggcctgaactagttttttaggttaactttggaatgcctttggcaaggggagggtccatgagtcagttgggggtcttagagttttattttttgcttaccggtttataaaaagttaatgaaaattatcatatttcataattctatataattcaatattgtactttatttaaaactcacgtataaaatagctgtccatatctgttttcagaagatgaggatggagggtagaaatcagaagtgtcagatttggtaattttcttacactgctgaaaacctatacctaccactttgaaaggattaatttcagacttgctttctttgggcctaatgattctactttgaagtttctctgattaaactaaggaataaatctgataaatggacattcagatgataccatacttttccaaaagataacattgcttttgattacatatgcaataaacatttcacattttttctcaagattatttactggcatctgcaccaaagacacaaaaaagcagccactgttaaggactttatcccttgttctgtttttagctggtttgttgttgtatttttcctcatgttgaatacagttaaaccctattaaactggattccccatattactgttagttgtcctgatgacaattaaggatagttagtaaatggatattgaatcattttatttttttagtagtgatggcgtttcgctgtgttggccaggttggtctcgaactcctggcctcaagtgatctgcctgtgttggcccctcaaagtgttaggattacaggcgtgagccactgcacctggctggatattgaattattgaagaaggatgttccctaacacttcctgcctcttttccgctgtcttactctctctgttccacccagtagtagttgggtttttgatgtctggcaaagtatagattgtctactcttctatattagttttcttcactcttttttttaaaaatgtttttaaagcaagatagagacagggtcttgccgtattgcccaggctggtcttgaactcctgagctcaagcaatcctcccacctcaccccataaagtgcggagattacaggcatgagccaccatgcctggccagttttcttcactcttgacctataatagtcctgcaaagccagtgaagctgttaatatgctgacgtagcctttttttctctcgtttgtgaattattaacaatcgctgatcttacacatcatatacaataaaacatctttgaacactgtcacatctcagcagctcattctggttaatgaggaaagaaaaatgtcaaaatctgtgattttcttagaggttattaaatgttttacagctatgtagatattctgtagacttgctgtacttacttacataacttttctgctcttctgcagagggagagaattaacttcataagtgggctttgtcaatgccctccagtcagcgatctccaggaacaaacttatctatggttgagcaagtggggtttattacccactgtagccagggagaacacacatatgtaataaccatggtatgtcatagtaaagggtgttaggaagataggatttgggctcgtttatttggtgattttaaggagggtttaaagaagcagggttttgctctgatttggatgctaccaggagctgcgaataattctatgaataaatatcataaaacctatctagaagaaaagactagagtgaggtctaaagctgtagtagttaaaaagcaaaggtcactccttatctggaaaaggggaatatttggtatttcatggtttagacagtgttcagtgttcatgttttgcctgtgtttagacataattgtagagtggtcttgttccaccgtggtcacagagtggcattatttcatgctgatattctgtaagtgccaggtcaaataccaaggtttagctgatagtagtaggccagctcctggatgtaataagctgtttttctctttctcagcttttttttttgttgttttttttttaaaatagagtctggctctgtcacccaggctggagttcagtgggggcaatctcagctcactgcagcctctgcctcctggattcaagcgactctcctgcctcagcctcccaactagctggaattacaggcgcaagtcaccacacccggctaatttttgtatttttagtagagacggggtttcaccatgttgagcaggctggtctcgaactccggacctcaagcaatccatctgcctcagcctcccaaagtgctgagattacaggcatgagtcactgcacctggcctgtttcttagatttgagggtcaacttttacccttttcgaactgtggggcttcttatggaaattgacatttaagtcctgaccatataggatcttgggcaagttacttaactatgtatgctgagatgtttttttaaatgcttagtgcttgcacataataggtactcagtaaatgagaactattattataaaatcaatagtacttttaagattacagctagaggttatgttagaacattgttaactcttcgtactagtttctgttacactttttaggatgcagtagcagcataaacgagatatggggaagaacgagaggtatttaaacagtgatataggccgggcgtggtggctcacgcttgtaatcccagcactttgggaggctgaggtgggcagattacgaggtcaggagattgagaccatcctggctaacacggtgaaaccccatctctactaaaaatacaaaaacaaaattagccgggcgtggtagtgggcgcctgtaatcccagctatttgggaggctgaggcaggagagtggcgagaacccaggagacagagcttgcagtgagccgagatcgcgccactgcaccccagcctgggccacagagcgagactctgtctcaaaaaaaaaaaaaaaaaaaaattaaaacaaaaatatttgtgttaattgtgatgacaaaaaaaaaaaaagagatggaagtctctccctaacctcactcctcatttagtgtcatggcttttttcttttttttttttttttttttgagacaaagcctcactctgtcacccaggctggactgcagtggtgcaatctcagctcactgcaggctctgcctcccagattcaagcaattctcctgcctcagcctcacaagtagatgggactacaggcacatggcaccatgcccagctaattttttgtgtagtttttagtagagacagggtttcactatgttggccaggctggtctcgaactcctgagctcaagtgatcccccctccttggcctcccaaagtgctgggattacaggcgtgagccctgctcccagactcctggcttttttttttttttttaatgaaaaattcaaaatgctcttttttttttttttttttttttgagacagagtctcgctctgtcgcccaggctgaagtgcagtggtgtgatctcggctcactgcaacctctgcctcccaggttgaagtgattctcctgcctcagcctctcgaacagctgagattacaggtacgcgccaccacgcctggctaatttttgtatttttaatagagatggggttttgtcatgttgtccaggctagccttgaactcctcgcctcgtgtgatccacctgccttggcctcccaaagtgctaggattataggcgtgagtcgctgcacctggccacagaaattttttgaagaagataaataaggtgacatttttaagggtcaaagaaaatgtcaaaaactagaatgatgtctttacatagggtttaaaactttccaaattaacagggaaaataattctttaccttgaaaataaatgtttgctagtgaaagcaaatacaatctttttactaaatgttttattaaatttttttttcttgtagacacagggtcctactgtattacccaggctggtcttgaatgcctggcctcaagcaatcctcctacctcagtcttccaaagtgctgggactacagacatgagccatcacactgggtcttttttaccaaattatagtagaaagcactttttctctaatggtgaactatgagagaattaatcaggggctattagtaattcatccctgaattaatcagtgattataatgctttgtggtccatgtagtttgctggggattaacacaccatgaaagtctaccaggagatttttttttttctttgagaacaggggccataatcagtagtccttaaatgaaatggactattcccatttcattatatgttgcctaggctggactcgagctccttggcttaagtgatcttcccacttcagactctcaagcagctgggactataggtgtgtgccaccatacctggcttaattgagtgtttgttttttgtttttttttctgagacagagtctcgttgtgtcgcccaggctagagtgcagtggcacaatctcggctcactgcaacctctgtttcccaggttcaaacgattctcctgcctcagcctcccaagtagctggaattacaggcgcctgccaccatgcctggctaatttttgtatttttagtagagatggggtttcaccatcttggccaggctgatctcgaactcttgacctcatgatccacacaccttggcctcccaaagtgctgggattataggcgtgagccaccgcgcccggctttaattgagatttttagatatctattactctgctaattttgtcacttgcaagttgccatcagaaaattgtaggaaaatggatatatttgttccttggaatggtttgtgtgagaatacttaaggattaaatagataagtaaaactggtgggctttatataacatagatgagcaaatgtcaggaacatacaactgtgcacacagttcaggagaaggaggatttaagttaatcaacaaatttactaagtataataaagatactaaaagtagtgtttccataccactttattacttaaagtatcatcatataccctattttatatgatttttgccacaagtcagagttaggtaaaagaaatacttgcttttcaggtaaggagtttgacgcccagacagattaactgacttttccaaaatcatattgctattaaatggtggaacaaggacttaaatctttgccttctaactcacatacttgcaaacacatatcctctcactctaccccaagctacccatgttttgacccttcttgtggcaatctgggtctcactaatatttgaaagaaaacgtacagtagataatttgcaagttaatctgttacgcatatctcttacctctatttaaagatgaatatcagcatttctgttgtttctacagtaacatactaaaaaataatgcagtccaggtgcagtggctcacacgtgtaatcctagcacttttggaagttgaggcaggaggatcacttgaagccaggagttcgagactagcctgggtatgcaagaccccatttctgttttttttttttgtttgttttgttttgttttgttttgtttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccccatttctttttcactgcaacctttgcctcccaggttcaagtgattgtcgtgcctcagcctcccaagtagcttgggattacaggcatgtgccaccatgcctggctaatttttgtattttttggtagagatggagtttctggccaagctggccaggctggtctcgaacgcctagcctcaagtgatctaccctccttagcctcccaaagtgctgggattacaggtgtgagccactgtgcccggccccatttctacaacaattaaaaaatattagcccagtgtagtggtgcatgtctctagtcccagctactcagaaggctgaagtgaaaggattgcttgagcccagaatttcaaggctacagtgagctatgataatggcattgcactccagcttgggtgacagagtgagaccctgtctctaaaaaatgaagtaaaatagtgcacaagtatagaacttgaaaatcttccttaaccttaccataagggaaatgattactaataagtttcttaactttttgtacttacataaacataaatattcatcagagaaaaaaatatgcaaaacaatttgcaatctttttcacttaccatattttggaatttttttcatttcaatatatttgatcttccttgtgttttttcagtttgtttgtttttgtcacccaggttggagtgaagtggtaagaacatggcttattgcagcctcaatctcctgctcccattcagcccctcaagtagctgggactacaggtacatgtcaccacgcccggctaatttttatttttattttggtagagatggggtttcaccatgttgcccaggctgatcttgaattcctgggctcaagtgacccgcccacctcagcctcccgaagtgttgagagaacaggtgtgaaccaccatgctccacctcttagtctttacaatctgcaaaacctcataagtggctaatagaggaatatagtaaagcaaagggggatatcactgattagaactgtgtttttaggctgggtgcggtggctcacgcctgtaatcgcaacattttgggaggctaagtgggagtatcacttgagcccgggagttcaagaccagcctgggcaatatagtgagagaccctgtctttagaaaaaaattaaccaggtgtggtggtgcacacctgtggtcccagctattcaagaggctgaggtgggagaatcgcttaagcctaggaggcggaggttgcagtgagatcataccactgctctctagcatgggtgacagagcgagacccagtctaaaaaaaaaagtattttttcgtttttttccaactcatgtacacccgccaccccacccctgctttttttttttctgacattgggtcttgctctgtcacccaggctagagtgcagtagcacaatcaactcactgcagcctcctcttcctggactcaagcagtcctaccacctcagcctcccaagtagctgggaccacaggtgtgcaccatcatgcctggctaatttttgtactttttgtagagatagggtttcaccatgtggttcaccatctctaactcctgggctcagtcagtccacttttgcctcggcatgagccactgtgtgcagcccacgttttttattaatggatatttggattgtttccatctattgtgaataatgtggctatgaacattggtctaaatatctgtttaagtcccggctttcaatacttttggatatatacctaggagtagaattactgaattatatggtaactttctgtttaaatttttgaactgccaacctgttttccataggggctgcaccattttgcattcccaccagcagtgtacaagggttccagtttctccacatttgttatttttcattttttaaaataatagtcatcctaaagggtatgaagtggtatctcgttgtgattttgatttgcatgtatttttctaatgacttatgatgctcagcattttgtcatgtacttatgtaccatttgtgtatcttctttggaaaaatgtctattaatgttcttttcccattttttaattgggttgtttttatgtttatcaattttgtaaacattttaagctctgcagcataactactcaaccctgtcacatggtaagattgacccagtaaaactttatgtacaaaaataggcagcttactagatttaatcttagtccatagtttgctaaggcatgcattagataatgtagttacactattggctaataatttaaactacaagtggttgtaagtttctgccacccaaattctttcttgatttgatgtagtctggttggttgaatttgagtgttatatggggtcatagagttaaaagagaaatgtctatgagaaactagggactgttgggagctaatgttaaaggattttggaggccttttgtgcactggagaccattggaagattggattttctgctataaatgtatctaaaggataatcagtgtaagttatgggctgtagtttgccaacccctacattaagggattgaaataatttgaatatgggtttcagttcttgtatggtctggctcagttctttttttttttttttttttttttttttttgagatggagtctcactctgttgcccaagctgcagtgccatggcacgatctcagctcgctgcaacctccgcctcctggcttcaagtgattctcctgcctcagcctccagagtagctaggactacaggcacgtgccaccacatctggctaatttttttttttttcaagacagagtttcgctcttgtcacccagcctggagtgcaatggcacgatcttggctcaccgcagcctccgcctcctgggttcaagtgattctcctgcctcagcctcccaaatagctgaggcaacaggcgtgcgccaccacgcctagctaatttttctgtttttagtagagatggggtttcaccatcttggccaggctggtctcgaactcctgatctcatgatccacccgcctcagcctcccaaagtgctgggattacaggcgtgagccacctcacctggcgtttttttgtgtgtgttttcagtagagatggggcttcactgtattagccagaatggtcttgatctcctgacctcgtgattcacctgcctcagcctcccaaagtgctggaattataggcatgagccaccacgcctggctgtggctcagttcttaactgttcattcattcagggtcccagccaaaatcttttgccacagcttctcctgggcatgctctgaaattcattttttgtctgtttagttgcatgagtccactgaaagctttgcttattttctccaccactttcagagttcacagtcacttcaagtagacgaggtcaggagatcgagaccatcctggccaacatggtgaaaccccgtctctactaaaaatacaaaacttagctgggcgtggtagcgtgtgcctgtagtcccagctactcaggaggctgaggcaggaaaattgcttgaacccgagaggcagaggttgcagtaagccgagatcataccatttcactccagcctgggcgacagagtgagacactgtcaaaaaaaaaaaaaaaaaaaaaaaggaaagaaaagtgctccaaatgctgggctcatctctgctggcttctctcctttttatatttcgataatttttaaaataataaccatcctaatgggcttgatatggtccctcctttctaaattttggtaattttcattgttttggaaactcactaatcccttcaaacagatgtttttaaaactttttttctagttctctctctttttttttttttttttttttttgagacagggtctctctcagtggtgcgacctcccttactgcaacctctccctcctgggttcaagcagcgattctcctgcctcagcctcccaaatagctgggagtacaggcacccacccccacgcccagctaatgtttgtatttttagtagagattgggtttcatcatgttggccaggctggtctcgaactcctgaccccaggtgatccgcctgcctcagccttccaaagtgctgggattacagccatgagccaccgcacctggctctagttctcttctaatcttactatagtaatcaaaattttagtgctgatgttataatccaagcccaaatggatattcttatacattaaatgttggaatatcatgtttgttaaaaatcagatctgctgggcacggtggctcaatgcctgttatcccagcactttgggaggccgaggcaggtggatcccctgagatcaggagttcgagaccagcctgaccaacatggagaaactccgtctctactaaaaatacaaaattagccgggcgtggtggcacgtgcctttcatcccagctacttgggaggctgaggcagaagaattgcttgaacctgtgaggcggaggttccagggagctgagatcgtgccattgtactccagcctgggcaacaagagcgaaattccatctcaaaaaaaaaaaatcagatctgtccctatggttttatcttcactgcatgtcatatataaatggaagcatgtagtatgtagccttttgtgtctcgcttctctccctttgcataatatttttgagatttatcccttttcctacatatgtcagtagtttgtttctttttaatgctgaatagtattccacgtgtggagataccacaatttgttactccattcactaaatgatttgggttgtttcctgtttttgttattgttgttgttgttgtttaattaattaattaattttttttttgagatggagtcttgctctgttgcccaggctagagtgcagtggcgcaatcacagctcactgcaacctctgcctccccggttcaagtgattctcctgcctcagcctcccaagtagctgtgattacaggtgcccgccaccacaaccagctaatttttgtatttttagtagagatgggatttcaccatgttggccaggctggtcttgaactcttccctccttggtctcccaaaatgctgggattacaggtgtgagccaccatgcccatcctcctgtttttaaattttatgaataaaggtactgtaaattcatgtacaggtcttagaagtttgcatttttcttgggtaaatatgtagaagaagagattgttgactcatgtggtaaatatatgtttaatgtcataagaaactaccaaactgtttttccaactgggtgccattttgtttcctaccagcaaacataatgaaaggtccattaccctttgtctcgtaatattttggtatttttatgttcttttgtttttttgccattcaaaattgggtgcattgttgtatctttggattttaatttgtacttccctaacaactaatgatgtggagcatctttttatacgcttacttgccaattatgtcttaattctttggcaatacttatatttgactctgcctactatatatatatatatatatatttttatgctatatatagagtatatatatttttatactatatatatttatatatactatatatatttatatatactatatatatatatatatatatatatatttttttttttttttgagatgaagtcatgctctgttgaccaggctggatgcagtggcatgatcttggcttaccgcaacctcaacctctgcctcccaggttcaagtgattctcctgcctcagcttcctgagtagctgggactacagacacatgccaccatgcccggctaatttttgtatttttagtagaggtggagtttcgccatgttgtccaggctggtcttcaactcctgacctcaggtgatccacccgcttcagcctcccaaaagtgctgggattacaggcatgacccaccgtgcccagctggaataagcaatcttaaaaagcagtttgttgatttctggtgaatagagaaaatgtgacaaactatgactcaatagtttcatttcttttttgtttgtttgtttgtttttttgagacagagtcttgctctgtcacccaggctggcgtgcagtggctcactgcaagctctgcttcctgggttcacgccattctcctgcctcagcctccggagtagctgggactacaggcgcccgccaccatgcctggctaatttgttttttgtatttttagtagagacagggtttcactgtgttagccaggatggtctcgatctcctgacctcgtgatccacccgtctcggcctcccaaagtgctgggattacaggcatgagccaccgcccctggcctacttttatttcttaagcatatatcttaaagaaactgcaggtatgcattaggggacaggtagaaaaatgttacagcattgtttgaaatgttgaaaaactggaaacaacctcaatatcttaataatagaaaaaatggttgaggctggctgtggtggttcatgcctgtaatcctagcacttttggaggctgaggcgggcggatcacctgaggtcgggagtttgagtccagcctggccaacatggtgaaaccccgtctctactaaaaatacaaaaaattaggcaggtgtggtggtgcacacctgtaatcccagctacttgggaggctgaggcacaagaatcacttgagcctgggaaatggaggttgtagtgagccgagatcatgcctactgcactccagcctgggcaatagagtgagactccgtctcaaaaaaaaaaaaaaaaaaaaaaagggaaggagcatgggaatgggaagaggcactaaaaaaggaacttcttttgtatctgttacattgtactcattttgtttttaaaattttaagccaaatatgacattgttatcacttttgttgccactcagaatacaagtgctattacactattttctataattttccctttttcaaactaaaaaacaaaaatacatgtaaacaggtgttttctttatggaaaacaggaaggtgagcatccaaataattttagttaatttataacaaactcttaataatttctttttcttcttcttctttttttttttttttttttgagtcagggtcttgctcttttgctcaggttagagtgcaatggtacaatctggtacaatcacatcttagtgcaacttctacctcttcagctcaagtgacctctctcctcagtcccccaagtagatgggaccacagatgtgtatccccaatcatggttaatttttaaattttttggtagagataaaatctcaccatgttgcccaagctgggcttgagctcctgggctcaagcagtcctcctgccttggcctcccaaagtgctgggattataggcgtgagcaaactgtgcccagtcttcataaacttttctttacatgtccttatcaagtactttttgagcacctactgtcaaccagccgtagtatataatactgataattctataacataagaaattgacctgtttaaggggatgaatatggttagttattttcagggtgaagaaacagaagaatcggggaggtagtacatagtcataaggagacggcatttcttagtcactttgtgtggtgtttataataagacttcatgtggccaggtgcggtggctcgtgagcgcctgtaatcccagcactttgggaggccgaggtgggaggatcacaacaaggtcaggagatcgagactatcctgaacaacatggtgaaaccccgtctctactaaaaatacaaaaattagctgggtgtggtggcacgtgcctgtaaccccagctactcgggaggctgaggcaggagaatcgcttgaaccagggagtcggaggttgcagtgaaccaagatcgtgccactgcactgcagcctgggctacagagagagactccatctaaataaataaataaataaataaataaatagacttcgtctgtttcatcaagagtcattgtattatattgattttgaaatttcaaataataataaggaatagtatggaaatttttgtttgattaaatggggacatgaggccaggtgtggtcactcaggcttgtaatcccagcacttcgggagaccagggcaggaggattacttgagcctaggagttcaagaccagcctgggcaacatggcaagaccctatctctacaaaagaaatacacaaaaattagctaagtgtggtggcacatgcctgtagtcttagctactcgggaggccaagggaagaggatggatcacttgagcccaggagttggagggtgcagtgagctaggattgtgcccctgcactctagtgtgggtgacagcaagactctgtttaaaaaaaaaaaaaaatgaggccgggcgcggtggctcacctctgtaatctgagcactttgagaggccaaggcgggtggatcacctgagttcaagatcagcctggccaacatggtgaaaaccccgtctttatacttaaattacaaagattagctgggtgtgatggtgcacacctgtaaccccagctactccagaggctgagacagcagaatcgcttgaacccgggagggggaggttgcaatgagccgagattgcaccactgcactccagcctaggtgacagagcaagactctgtctcaaaaaaaaaagaaaaaaagtctaagaagttaattttcattcagacaaatgttcaaaaataatagaaataaaacaaaaaattaattttcaaatatgtgatttgagtataacgatcactttacagaagttattctacatactttttgattatgctgagtttttaggtccttttaaagcttaacttgtatcaggaattaatgttttaaactagttgttgggttcaaagaaaatagaaatgtgttattaaatgccacacttgtaatctcatacagcagttctcatgatgcaatcaattgttaaataaaaacttcctctagagaggaggtacccagcaatgaacacattatatcagatttgaatatgagattaaacaatgctttttgtttcattgttattgaaatcatatttgtatttttcaaaagtatatatacttaaaaattcctaaataaaatgtctttctgtaatacagcattttaggttataaggatcaataccatgggctgataagcaaaataggactcacggccccaaaatgttgataaacatcatgaccatattccccataatggagttacatatacacattacaatgataaaaatactaagaagttatatagtaatgtttctcagacttgttcacaaccctgttttttatgtattacctctcaacagcatgatttgcaatatttagtgtactcttcatacgatctatacaaataattttttattttaaagcaggacagaaggagcaagctgtggaatggtataagaaaggtattgaagaactggaaaaaggaatagctgttatagttacaggacaaggtaagattgtatttgtttatagccatcccaaattatgatatattcacatgattgtccagatttcagatctatttatttatttatttatttttctttctttcttttcttttcttttcttttttttttttttttttgagacagggtctttcctctgttacccaggctggagtgcagtgatgtgatcatagctcactgcaacctcaaacttctgggctcaagtgatcctcctgcctctgcttcccatgtagctgggaccacaggcgcacactaccatacttagctaattattattattattattattattattattactagtttttgagacagagtctcgctcttttgcccaggctgtagtgcaatggtgcaatctcggctcactgcaatctccgcctcccggattcaggctatttattctcctgcctgagactcctgagtagctgggattacaggtgcatgccaccgtgcccagctaatttttgtatttttagtgaagatggggttttgccacgttggccaggctggtttcgaactcctgatctcaagtgatctgcccacctcagcctcccaaagtggtgggagtacaggcatgagccactgtgggccacacttagctaattaaaaaaaatttttttgtagagacagggtctcactgtgtttctgtgactgatcttaaacttctggcctcaagtgatcctcctgcctcagctttccaaagttgtgggattacaggcatgagccactgtacccagccagattgtatttatcttaataaatgtatttgggccaggcacagtggctcatgcctgtaatcccagcactttgggaggccgaggtgggcgaatcacctgggatcaggagttcgagaccagcctgatcaacatggagaaaccctgtctctactaaaaattcaaaattagccaggcgtggtgtcgcgcacctgtaattgcagctacttgggaggctgaggcaggagaattgcttggacccaggaggcggaggttgtggtaagccaagatcgcgccattgcactccagcctgggcaacaagagtgaaactctgtctcagaaagaaagaaaagcaaaacagtatttcatttaattaaaaatgccttgtattataccagtaagagtaaaaaacaatttaattaaagtatgatatatgctcttttcatcacttagaatttgaattttaatcttattgaagaggctgttttagttttatttagatatggttataacaacaatattaatatctgtgaccaaattggtgcatgcatgggcaatgaaaagctatgttgtgactgcagcatggtggatagcattagtaagttagcattggttgtaaaatgaatcccaatttcaaagattttgaaacgtggggaaaaaatattttagaccccatgaaataagacctgaaatctatgaaataccacagtaggttggaaatcatcatgagaaactgtaactatttttttttataggtattatatgtattctttgagacagggtctcaccctgttgcccaggctggaatgctgtgatgtggtcacctctcactgcaacatccacttcctggggctgaagtgatccttgcaactcaccctcccatgctcggctaatttttttttttttttttttaagtagagaccagatctctttatgttgcccaggctggtcttgaactcctgggctcaagtgattctgctttgtctgcccagagtgctgggattacagaagtgagccacaacacctggcctaaagatagtatttttaaaatttcttctgttttctttcttttgggtatacattttcttcttttttttaaaaaaaaatttctgtataaagactgtgactccccatgaaagtagtttgggtgataatttatcgtgaaacaatattagttgggaaatgtagatattttaattaatttttttctttcaggtgaacagtgtgaaagagctagacgccttcaagctaaaatgatgactaatttggttatggccaaggaccgcttacaacttctaggtatcaattaatgtataatttgatgtgggatgtattggaaatgtgtgttcaatgaaactttaatttgtagaaagaaatagatcagtgattgaaaatgtggtccaggctttttaacataaagaaaacgtataacatatacaaaaacagaagagcataatggacttctttttttttttgagatggacgcttgctctgtcacccaggctggagtgcagtggcgtgatcttggctcactgcaagctctacctcccaggttcacgccattctcctgcctcagcctcctgagtagctgggactacaggcacccgccaccacgccccgctaatttttttgtagttttagtagagacagggtttcaccatgttagccagaatggtgtccatctcctgacctcgtgatccacccgcctcggcctcccgaagtgctggagttacaggcgtgagccaacgcgcccagccgagcataatgaacttctaattattcttctctcagctttgataattatcacctcactatcagtcttgatttatttataccaagggctagcaaactgcagctgatgggccaacccagctcactgcctattactataaataaggttttattggcacacagccattcctttcctttaggtattgtctatggctttcatgctacggtgacagaattgaatagttgatacagagacaacactgccctcaaaacctaacatatttactgtctggccctgagaaagcctgccatcttcacttgacatcccacttcactgtcccccaacttcttattattttgaaacaaattattgacttattttccatttataaatatttcatattatacctctaaaagataaggatgtcaaaataaaatcacagaaataccattatcacacctaaaaaataactccaaatttcttttaacattatccaaaaaaactgacccccccaaaatgcaatttccaaatttctaattttctcaaaatttaataatttttactattttttaataatttgtttgtatcaggatcttaaaaagatccgtatgtctcttttaatgtacaggttcatctgtttttcattttcttccaatttatttgttgatgaaaccaggtctttgtcatgtaatatttcctacagtctgacttttgctgcatgcatcttttgtggtatgttttaacatgttcttctttcctcccacgttaaatgatagttggatatagagccttgatcacattgaaagttgatttttattttttaatgattagactacttcctaggtggttgtgtttgtgtgttcatcattagttgttccatcttgtgaggttagcagcagttaactatgactgatgtccagtgatactttaattctgtcattctttcagcattcatcaactgtaatagaaacttttacttgtcttctgtttgatggcgtaggttttaaatatatattaataagttaaatctaccactcaaaaaaagtagaacaaaacctactacatatgagtggctctaccatacgttggtggatggaaatagtagatatttggtaagcaggtaaaccttatttatttgtagccctgtgacttggggtaagttattttgcatgtctgggtcttttttatctaatttgtaatatgaagctattattattattattattattattattattattattattattattattattcgagatggagtcttgctttgttgcccaggctggagtgcagtggtgcaatctcggctcaatgcaccctccacctcctgggttcaaactattctcgtgattcagtctcccgagtagctaggattacaggggcctaccaccacacctaatttttgtatttttagtagggacggggtttcaccatgttggccaggctggtctcaaactcctgacatcaagtgatccatccacctcagcctcccaaagtgctgggataggccgggcacggtggctaacgcctgtaatcccagcactttgggaggccgaggcgggtggatcacgaggtcaggagattgagaccatcctggctaacacggtgaaaccccgtctctagtaaaaaaatacaaaaaactagccaggtgtggtggcgggcacctgtagtcccagctacttgggaggctgaggcaggagaatggcatgaacccaggaggcggagcttgcagtgagccgagatcatgccactgcactccaggctgggcaaaagagcgagactctgtctcaaaaaaataaaataaaataaatagataaataataataataaagtgctgggattacaggcatgagccaccacgcccagctgaagctaatattattagctaataataatatctcatatttttgaccattgaattattaaaggaacctaaaccatagtagtaagtgctttaaaaatgttggtttttatttatctgtttacctgactgtcatcacctcctttgcttaggtagaaagatatattcataaacacatacatatacattttattcattctttaattcatttactcctatatggtcattgtgtttgtgggatttttgcccgcacatagttaaaaatgcagccgttactgctttcagatgagtaacaaggtagtgttccctggcttctgtggctgacaggatttgccttcttcctttctaaatggaggttattactgtgtcagatataattaaatagtgtattaaagtttgttgcaataaaataattgatggttctaattggtactttctacgtgttttatctttaaagcttttcagtgtatatataaagtatatatcatacagaataaatttgattgtggagcattttgtaacatctttcaaaattaataagagttggtttttatgttttgtttgatgttatgatataggacattagaagtattaatatcaattagagactcatctttgaatgtgactttgtactttcttatttgtgttagtagaggagagaacaaaaagaagatatgtaatgtaatatgaaactaggcatttaaagatttaacgttttggatattttaaagttggtgtctgttttcaccctcaaaaatgctattacctatttatgaaatatctttaaaagtgtggagtggtagatgggaaaggtgacatcggctgggcgcggtggctcacacctataatcccagcactttgggaggccaaggtgggcggatcacctgaggtcaggagttcacgaccagtctggtaacatggtgaaacctaatctctactaaaaatacaaaaaattagccaggctggtggtacgcacctgtaatcccagctactcaggaggctgagtcaggaggatggcttgaacccagaaaatggaggttgcattgagccaagatggcaccactgcactccagactgggtgacagagagagactccgtctcaaaaaaaaaaaaacgccgggcactgtggctcacacctgtaatcctagcactttgggagactgaggcgagcagatcacttgaggtcaggagttcgagaccagctgggtgcctgggcaacatagtgaaaccccgtctctactaaaaatacaaaaaaattagccgggcgtagtggcgggcgcctgtagtcccagctacttgggaggctgaggaaggagaatggcgtgaacccgggaggcggagcttgcagtgagccgagatcccgccactgcactccagcctgggtgacagagcgagactccgtctcaaaaaaaaaaaaaaaaaaaaaaatagccgggcatggtggcgggcacctctaatctcacctacttgggaggttgaggcatgagaattgctcgagcctgggaggcagaggttgcagtaagcagagaccacaccactgcactctagcctggatgacagagtgagactttgtctcaaaacaaaaacaaacaaaccaaaccacctcttgtccactcctaatctcccttactgtgtttcacttatttttttcccatatatttgtcaccttctaataaactgtgtaacttattttttatgtttattgtgtactatctgtcttctccctgttggaatataaactctatggaggagggatccttgtctatatcccaagtgcctacaacagtgtctagcacatgctagttaccgaataaatatttgccaagttaatgaagttgtttataacccttggcactatacctgatacagtgtagggacttaataaatgaatgttaaatgaagctatcttaaaaatatatatatatatataacagccagatacgccaatttgccgacatcaaaattaatcttttcatctattgcaggttttacagttaagctttgctctaaggttcactatcactaaaccaaaaataaataatatggatggtcttttcccatttttaacagagaggctacatcctctcaaaccagtcagtattaggaattcccaggatcattctctccattttccatcctaattagatacctatctggcaccacatctctgaaaagctccaatttttaaccagcacataataaacaaatatgttactattaatacacgtttgtacacaagtcatttttattgtcttaggtatatccactcccagaccttctgagttattgaaagacaggaatttgtgatgtcacctcttttttcttttttttgagacggagtcttgccttatcacccaggccagagtgcaatggcgtgatctcggctcactgcaacctctgcctcccgggttcaagcgattatcctgcctcatcctcctgagtagctgggattacaggtggccctagtttgggtttttggttttaaacaggatggtctcctctttgagaagttgccatgagttagccatgatgatacctgggacaataatggtccacagagaagtaagagccaatacaacgccttaagagaaagtacctggtatgtttgtgaagcagcaaagaggccaatgtgttccagcaaggagattatagtagagatgaagtcagagaactcatgcggagagggattgtcacaacacgcagggctgtaaaggccaccatgaggacttgagcttttaccgcctgtgaaatggggagcagttacaaagatttttaagaaagcagcccagtgcagtggctcatgcctataatcccagctctttgggaggctgaggtgggtggatcacctgaggtcaggagttcgagaccagcctggccaacatggcgaaaccttgtctttactaaaaatagaaaaattagctgcgtgtggtggccatgcttgtaatcccaaatactcgggaggctgaggcagaagaatcacttgaacccgggaggcggaggttgcagtgagccgaggttgcgccactgccctccagcctgggcaacaaagcgagactccgtctcaaagccagaaaaaaagatttttaggaaaggaatgaaatactctgacttaaattttagaaggatcactctggttgctatgttgcattatagactctaagggtagaaccagggagagcaattaggacactgttacagtaatctaggagaaaagtgatagaggcttgcaccagggtagtatcaggagaaatggtaacaagtggttggattatgattatagttgaaggtcgaacaactagatttgctgatagattggataaaatggtcctctctttatggatctcataatacagtaggagaaacagacacataaatagtcatcactgcaggatgggtattagaaatattttgcaagggtgtaaaaggtgctaagaaagctttcttgtgtgacaaagctggttaaagaaagaaaagaaagcttcctagaagtgaaacctaaaatatacacttagataaatgaataaaagttatgaaagaatgtgagggctgggcacagtggctcatacctgtaatcctagcactttgggaggttgagtcgggggtattgcttgagtccaggagtttgaaaccagcctggacagcgtactgagaccccatgtctaaatttaaaaaaaaaaaaaatagccaggagtggtgatgtgcacctgtagtcctagctacttacttgggaggctgaggcaggaggattgcttgagctcaggaggtcgagactgcagtgagccatgagtacaccactgcactctagtctgggtgacagagtgagaccctgtctcaaagaaaatgaaaagaaaaagaatttgagaaaagatatgtcaggaaaatgtgatgacatgaacaaatactcaaaggcaagaaaagcatggtgagtaggggagggtacaggttgagacatgaagttgggattgccgaggcgtaagaggtataggcagatcatggatggcctggtttgtcataggaaggagcttgggctcttatctgtgggcaatgggaagccactaaagggttttaagtagaagagtgttatatggtaaggttttcctctccagtagatcactcagatgactgtgggggttggatgtgaggaggtaaagcagcaaagttactgctttaatttaaatcattgattaatctgtacaatcctagtcattccaaaaagaaacattagtcctttaacagaagtgaattgggtctgggcgcggtggctcacgcctgtaatcccagtactttgggaggccgaggcgggcagatcacctgaggtcaggagtttgagacaagtctggccaacatggcaaaaccttgtatctactaaaattacaaaaattagctgggcatgggggcacccacctgtaatcccagctattcgggaggctgaggcaggagactctcttgaacccataaggcagaggttgcaatgagctgaggtcgcaccactgcgctccagcctgggcgacagagtgagactccgtctccaaaaaaaagaaaaaatattggagcagtttcacagatgctgtttactgttatactgtatgtgtctatgactcctcctccaagaaaaaaaaaatgaattggagcaggttcacagaagcaatgtactgttacactgtatgtgtctgtttctacacatataaatctgaattctgtgtacacgaaaagaaatcctatagctttttattcctagctataaaaactaagaatataatttctttctttttattacataatgaatggttctgttaactttttgttaaaatttcattgaggggagtattaattcacatttatgtacggatgtctacatttacaaatcagtgtattttttgatttatgcttttactgagacaaagggtttctgtctcagcatggtcatttaaagagtttatcattgagaaaaatcagatgaccaacctgttagctcaaaaaaaaaaaaacctccaaggtatattgtatcagccagttctaggatacaaaagccatgcagtactttgtgttttgtgccaaaaagggtagctgctatttgacctgtcccaaaggcatgtgtggttgtaccgtaaaccaagcatggtacctgtttgtcaaactttagaaatgaaagtttaagagagttaatatataggtgctgcattttttatgtattcattgacttgctggtacagaagaaaagaatcaattatgattcagcacaatactccacttggggaagagagtgcagcagtagtttagagtgtcagggatcaaactgctaccttcttgggcttcagttgctagacttaagagacccagatcttgggaggggtttttgttgttatttgatgtgggggtaaggttgaaatactcccttttaattgattaatataaaaaataggtaatgtagacgtatgtcacaaaattttaacaagtttgagtgtgaaaagcatccatcccattctatgccctggctacccatttcccctccctagaggcggctgttattatcagtttctctgggtcctttttagaggtaatctttttgtatgcaactgtgcacatgtatgtttacacaaatggtagggtattgtatatatatacagttactgcagtatgcttatttgactttgctttattgcttttattttctgcctgacatatgttaatgtggccaaatagggcatttcccagacaatccttatagtttcattctgtgctactttaaatgctgttctccttccctgaaatgtcctttttttttttcttttctttttttttttttgagacagagtctcgctctgtcacccaggctggagtgcagtggcacaatctcagctcactgcaacctccacctccccggtttaagccattcccctgcctcagcttcccgagtagttgggactacaggcgcgtgccaccacgcccggatacttttttgtttgtttgttttagtagagacagggtttcactgtgttagccaggatcgcctcaatctcctgacctcctgatctgcctgcctcagcctcccaaagtgctgggattacagacgtgagccactgcgcctggctgtcctttcttttaatcttttcaaattctagccagttcatagcccacttgctctgtaaagctttttcagtgatctttcttttgtaccatgcagtcttttaaaaaatctacagttttattataagttgctaattatatttaataaatacctaaatggtagaaattgattcattttttaatctccgtagtgccaggaactgtggctcatgtctgtaatccctgcactttgggaggctaaggcgggaggatcgcttaaggccaggagcttgagcccagcctgtggaacatattgagaccccgtctctacaaaaaataaattagctgggcatagtggtgtctgtatgtagtgtcaactactcaggagactgaggcagaaggataacttgagctcagggagttgaggccacagtgagccatgatggtgccactgtacttcagcctgggtgacagagcaagaccaagaccgataattatctccatggtatttgttttggacgtattagatattcagtaaatattttctggtgatgatagtgatatctaactacctcaggttacctaacctgaataaggcctatttttaacatagccattcacttgttaatttctgttattttcgtgacttcatttttactaattatattttaaaagataattttatataaatgcaaaaactttttatcatgtaacaatctggtaacaccttgagtaatttgtcatttcacatgcacattttatttgttcattatcttttttctttttgtttattttttctgttttttaccttctctgttgcatagagaagatgcaaccagttttgccattttccaagtcacaaacggacgtctataatgacagtactaacttggcatgccgcaatggacatctccagtcaggtgggtttaggttaactaacataaaataataaagcttgcatgcaaagtaagagtcttacttaacctgataatgttgatttgattttataatggtaggtttaattgttcatgttttcacagggctgtgttgaaaatatagtacctttatcatcatagtatataaacatgcaacaagtcaggtatagtcattctaaacttgctttatttgcatattttgcaacctctggtttttcagattataaaatatgaaggtatacattcccgtaagtgattaaaataatctttttttctgttgtggcttttgtgtttttatatggatagctatactgatttttttcatgaaatagtgttttctaagacacattttaattttttatgtatcaatttttattgcatatcaattttcatttatagtatatgtgaatgtcttatagtacttgatagaagaaatttgaaacttcacatagtgaggagaaacattacagtattatttgctatggattaactctatccttcataaacttttggatatcaacttctacagaagattaaatgtctttctgttttgttttctttgggtaggggactctccatttcttaggttctctgacatctgagctagctttttgtttaattaaaactttttttttagttgacagataatgtacctgttcatggggtacacagtgatgttttgatacatatagtatatggtgattagatcaaggtaattatcatttccatcatcccaaacatttatcattccttgtgttggaaacattcagtattttccttctagcatttgaaatgatataatatattatattgttacctataatcatcctgcagtgatgtagaacaatggagcttactctttctatctagctatacctttgtatcctttccctacccttttcagcctctagtatcctctgttctactttttatttctatgagattaactttttaaaaataatattctgtgtgtatatataccacattttctttattcattcgtctgttcttggacacctaggttgattctgtatcttggctgttgtgaatagtgctgcagtaaacatggggtgtagatgtctgttcgatatgatgattttctttcctttggataaattcccaatagtgggattggtgggtcatatggtagttctgtttgtagtttttgaggaacctccatactcttctccatagtagctgtactagtttagattcccaaaagtagcgtataagagttcactttctacacatcctcaccagcatttggtactttttttgtctttttgataatagccatcctaactggggtaagataccttgttgtggttttgatttgcatttccctcataattaacgatgttgagcattttttcatatctttgtttttgacggtccagctagttttattggttactttttttttttttttttagcaatagtttcatgtgcagggctcaaattatatttaatattacttttttcaaattataccagaacaaccttaggttaggctataaaacaactgccttctttttcttttggcataataattatatatatatttttaattacactttacgttctagggtgcatgtgcacaacatgcaggtttgttacatatgtatacaagtgccatgttggtgtgccgcacccattaacttgtcatttacattaggtatatctcctaatgctacccctcccctctcccctcaccccacgacaggccccattgtgtgatgttccccaccctgtgtccaagtgttctcattgttcagttcccatctgtgagtgagaacatacggtgtttggttttctgtccttgcgatagtttgctcagaatgatggtttccagcttcatccatgtccctacaaaggacatgaactcatcctttttgatggctgcttagtattccatggtgtatatgtgccatattttcttagtccagtctatcattgatggacatttgcattgattccaagtctttgctattgtgaatagtgccacagtaaacatacatgtgcatgtgtctttatagcagcatgatttataatcctttgggtatatacccagtaatgggatggctgggtcaaatggtatttctagttctagatccttgaggaatcgccacactgtcttccacaatggttgaactagtttacgttcccatcaacagtgtaaaagtgttcctgtttctccacatcctctccagcacctgttgtttcctgagtttttaatgatcgccattctaactggtgtgagacggtatctcattgtggttttgatttgcatttctctgatggccagtgatgatgagcattttttcatgtgtcttttggctgcataaatgtcttcttttgagaagcatctgttcatatactttgcccactttttgatggggttgtttgatttttttcttgtaaatttttttaagttctttgtagattctggatatcagccctttgtcagatgggtagattgcaaaaattttctcccattctataggttgcctgttcactctgatggtagtttcttttgctgtgcagaaactctttagtttaattagatcccatttgtcaattttggcttttgttgccattgcttttggtgttttaggcatgaagtccttgcccatgccagtgcccatgccagtgtcctgaatggtattgcctagattttcttctagggtttttatagttttagaactaacatttaagtctttaatccatcttgaattaatttttgtataaggtgtaaggaagggatccagtttcagctttgtacgtttggctagccagttttcccagcaccatttattaaataggaaatcctttccccatttattgtttttgtcaggtttgtcaaagatcacatggttgtagatgtgtggtattatttctgagggctctgttctgttccattggtctatatctctgttttggtatcagtaccatgctgttttgattactgtaccttcgtagtatagtttgaagtcaggtagcacgatgcctccagctttgttcttttggcttaggattgtcttggcaatgcaggctcttttttggttccatatgaactttaaagtagttttttccaattctgtgaagaaagtcatttgtagcttgatggggatggcattgaatctataaattaccttgggcagtgtggccattttcatgatattgattcttcctatccataagcatggaatgttcttccatttgtctgtgtcctcttttatttcattgagcagtggtttgtagttctccttgaagaggtccttcacatcccttgtaagttggattcctaggtattttattctctttgaagcaattgtgaatgggagttcactcatgatttggctgtttgtctgttattggtgtataggaatgcttgtgatttttgcacattgattttgtatcctgagactttgctgaagttgcttatcagcttaaggagattttgggctgagatgatggggttttctaaatatacaatcatgtcatctccaaacagggacaatttgactttcttttcctaattggataccctttatttctttctcctgcctgattgccctggccagaacttccaacactatgttgaacaggagtggtgagagagggcatccctgtcttgtgctagctttcaaagggaatgcttccagtttttgcccattcagtatgatattggctgtgggtttgtcataaatagctcttattattttgagatacatcccatcaatacctagtttattgagagtttttagcatgaagggctgttgaattttgtcaaaggccttttctgcatctattgagataatcatgtggtttttgtctttggttctgtttatatgatggattacgtttattgatttgcatatgttgaaccagccttgcatcccagggatgaagccaacttgattgcgttggataagctttttgatgtgctgctggattcggtttgccagtattttattgaggatttttgcgttgatgttcatcagggatattggtctaaaattctctttgttgtgtctctgccaggctttggtatcaggatgatgctggcctcataaaatgagttagggaggattccctctttttctattgattggaatcatttcagaaggaatggtaccagctcctctttgtacctctggtagaattcagctgtgaatccatctggtcctggactttttttggttagtaggctattaattattgcctcaatttcagagcctgttattggtctattcagggattcagcttcttcctggtttagccttgggaggctgtatgtgtccagggatttatccatttcttctagattttctagtttatttgagtagaggtgtttatagtattctctgatggtagtttgcatttctgtggaatcggtggtgatatcccctttatcatttcttattgcatctatttgattcttctctcttttcttctttattagtcttggtagcagtctatcagttttgttgatcttttcaaaaaaccagctcctggattcattgattttttgaaaggttttttgtgtctctatctccttcatttctgctctgatcttagttatttcttgccttctgctagcttttgaaggtgtttgctcttgcttctctagttcttttaatggtgatgttagggtgtcaattttagatctttcctgttttctcttgtgggcatttagtgctataaatttccctctacacactactttaaatgtgtcccaaagattctgatatgttgtgtctttgttctcgttggtttcaaagaacatctttatttctgccttcattttcttatatacccagtagtcattcaggagcaggttgttcagtttccatgtagttgtgtggttttgcgtgagtttcttaatcctgagttctagtttgattgcactgtggcctgagagacagtttgttgtaatttctgttcttttacatttgctgaggagtgctttagttccaactatgtggtcaattttggaataggtgtggtgtggtgctgagaagaatgtatattctgttgatttggggtttagagttctgtagatgtctattaggtccacttggtgcagagctgagttcagttcctggatctgtcttgttgatctgtctaatattgacagtggggtgttgaagtctcccagtattattgtgtgggagtctaagtctctttgtaggtctctagggacttgctttatgaatctgggtgctcctgtattgggtgcatatatatttaggatagttagctcttcttgttgaattgatccctttagcattatatgatggccttctttgtctcttttgatctttgttggtttaaagtctgttttatcagagagttggattgcaaaccctgctttttttgttttccatttgcttggtagatcttcctccatccctttattttgagcctatgtgtgtctctgcacgtgagatgggtttcctgaatacagcacactgatgggtcttgactcgttatccaatttgccagtctgtgtcttttaattggagcatttagcccatttccatttaaggttaatattgttatgtttgaatttgatcctgtcattatgatgttagctggttattttgctcgttagttgatgcagtttcttcctagcctcgatggtctttacaatttggcatgtttttgcagtggcttgtaccggttgttcatttccatgttcagtgcttccttcaggagctcctgtaaggcaggcctggtagttacaaaatctgtcagcatttgcttgtctttaaaggattttatttctccttcacttatgaagcttagtttggctggatatgaaactctgggttgaaaattctttcctttaagaatgttgaatattggcccccactctcttctggtttttagagtttctgccaagagatcagctgttagtctgatgggcttccctttgtgggtaacccgacctttctctctggctgcccttaacattttttcctacatttcaactttggtgaatctgacaattatgtgtcttggagttgctcttcttgagtagtatctttgtggcattctctgtatttcctgaatttgaatgttggcctgccttgctaggttggggaacttctcctggataatatcctgcagagtgttttccaacttggttccattctccccgtcactttcaggtacacccgtcagacatagatttggtcttttcacatagtcctatatttcttggaggttctgttcgtttccttttactcttttttctctaaacttctcttctggcttcatttcattcatttgatcttcaatcactgataccctttcttccacttgatcgaatcggctactgaagctcatgcatgcatcacgtagttttcgtgccatggttttcagctccatcaggccatttaaggtcttctccatgctgtttattctagttagccatttgtctaatcttttttcaaggtttttagcttctttgcaatggtttcgaacatcctcctttagctcggagaactttgttattacccatcgtctgaggcctacttctgtcagcttgtcaaagtctttctctgtctagctttgttccgttgctggtgaggagctgtgttcctttggaggagaagaggcgctctgaattttagaattttcagcttttctgctctggtttctccccatctttgtggctttatctacctttggtctttgatgatggtgacgtacagatggggttttggtgtggatgtcctttctgtttgttaattttccttctaacactcaggaccctcagctgcaggtctgttggagtttgctggaggtccactccagaccctgtttgcctgggtatcaccagcggaggctgcagaacagcaaatgttgcagaacgacaaatgttgctgtctgatccttcctctggaaccttcgtctgacaggggtacccaggtatatgaggcgtcagtcagcccgtatggggaggtgtctcccagttaggctacttggggatcagggacccacttgaggaggcagtctgtccgttcgccgatctcaaactccatgctgggagaactactactctctttagagctgtcagacagggacctttaagtctgtagaagttactgctgccttttgttcagctatcccatgtccccagaggtggagtctacagaggcagtcaggcctccttgagctgtggtggactccacccagttcaagcttcctagctgctttgtttacccactcaagcctcagcaatggcagatgcccccgcctccagcctctttgccgccttgcagttcgatctcagactgctgtgctagcagtgagcgaggttccgttggcatgggaccctctgagccaggcatgggatataatctcctggtgtgccgtttgctaagaccattggaaaagcccagtattagggtgggagtctccctattttccaggtaccatatgtcacggcttcccttggctaggagagggaattccccaaccccttgcgcttcccaggtgaggcaataccccgcccttcagctcacactatgtgggctgcacccactgtctgacaatccccagtgagatgaacccagttcctcagttggaaatgcagaaatcagctgtcttctgtgtcgctcacactgggagctgcagactggagctgttcctatttggccatcttggaaccctgccttcttcattcatatgtaatacaaaacttctaaggttttagtggagaagagatagagtaaaaggatttctatagacagaagaaacagttggtcatcaactctttcccttgtggcttcacatctcccctaaggacttcttatgttggtttggtcttacagtatagtcagtggcagtttccctcttcccattccttcctctgtctgatttaaaatgctgtttcaagtatcgatataagtattttgcctgtttcttttagcgtggctgtgaagggctgacattttcagaaggcacttactgaaaaaaaaaaaacaaagaaatgtaagagtccatcacatataaatagttaagtttctaaaatatgtatttgagatcccagtaattctactaggataaatagcaaaaattctccagccctgaagagttggtctgtctttcctttccttgttatcttgattctcttttatttcatttcacatgctagaccccatcatgttttcctgctgcattccccactccaccctccaaagcaatgttctcttcctgcaacctgtttgaaaaaattgaactttgtcttatttcatatccctagtacaagttgaatatccctaatatgaaatctgaaatccaaaatgctctaaaattcgactcttttttttttgagatgaagtcttcctctgtcactcaggctggagtgcggtggcgcaatcttggctcactgcaacctccgcagcctcccctaaccccatccctgtgggttcaagcgattctcccacttcatcctcccaagtagctgggactacaggcacctgccaccacacccaactaattttttgtatttttagtagagatgaggtttcaccatgttggtcaagctagtctgagactcctgaccttaagtgatccacctgccctggcctcccaaagtgttgggattacagtcatgagccactgtgcctagccaaatatccaaaactttttgagcgctgacatgatgctcaaaggaaatactggagtattttgcattttggatttttgggttaaggatgctgaaccagtaagtataatgtaaacattgcaaaatgcaaaaaaatgtaaaaaccctaagcagttctggtcccaagcatttcgcataagggatactcaacccataatcttttcttttctgttttctggttggaagggcatattggctttatagctaatttacacagcattgatgtttaatacacagtgagtccaagtagatcactcagacctattagtagtttattagtgtcactcacttctggaacattctgtgatgttttacttggatgagttctttcacctctcttgggaaatagtcataccaaagtctgcttattactacaatgtgttatctattatacattgtccaattttctactcaaaattactagacaggcaaagaaaaagtaaagtataacccttactcaagaaaaaaaagcaatcagtagaaactgtgagtgggcccagatattggatttagcagacaaagacttcaaagcagctattataatatgtttaaagaattgaaagaaaatatggtatcagttaaacaggaaatctaagtagatgatataaactagacaataaaaataatattctaaagttgaaaagtgtagttactgaaattaaaaatttacagacaacagcctcaacagcagattagagatagcaaaagaaagattcagtgactttgaatgcaggtctgtagaaattactaaattgatgactctcacgtagcaactttcacccgtagtttggtttcatatacaatgctttaactctttttgctattttttctcttactttctgtgatggaaacattttgtgctttgattttaatgggtgtatcacagttatatacatctttacaaactcatcaaattgtatactttatttatatatttatttttttttgagatagggtctgactctttctcccaggctggagtacagctgaaattagttgggactacaggtgggcaccactgtgccagctaatttttgtattttttgtagagatggggtttccccatgttggccagtctggtctcaaactcctgggctcaatcatttctgccgcctcagactcccagagtgttgggattataggtgtgagctactgtgcctggctggtatagctttttttttttttttttttttttttgtgacagagtctcactctgtcgcccagggtggagtgcagtggcgcgatctgggctcactgcaacctctgcctcccgggttcaacccattctcctgcctcagcctcctgagtagctgggactacagatgcgtgccaccatacccagctgatttttgtattcttagtagaaacagagtttcaccatgttggccaggatgatctcgatctcctgacctcgatccacctgccttggcctcccacagtgctggcattacaggcctgagccaccatgcctggctgttggtatactttaaatggatgtaattcattgcagattatacctcagtaaatttttatttagtttttgagactgagttgctctgttgcccaggctggagtgcagtggcacgatttcagctcactgcaacctctgcctcctgggtttaagcgattttcctgtctcagcctccccggtagctggaattagaggtgtgtgccaccatgatcagattatttttgtgtttttagtaaagatggggtttcaccatgttggccaggctggtctcgaactcctgacttcaggtgatccacccgcctcggcctctcaaagtgctgggattacaggtgtgagccaccacgcctggccttaatttttaaatactgtaaggcttataaagaaaagaatattccccttctgtttctttcctctcacgtagcaaccttcacccctagtttggtttcatatacagtgttttaactctttttgctatttttttctcttactttctactatatttccaaatacaatgcttctataatgattccttttttttttctatcagtttttgataatcattgactccttatggtcaaagaagacttaattcccttctgtcactcttcatatattaatataactaatatatatattgtttagttttgatataactaaaaataactatatgtatatataactatatatgtataagctatctgtatatagttatatatgtatatgcacatacatatatagttacatatgtatacacacatacatatatagttacatatgtatatgcatatacatatatagttacatatctatatgcatatacatatatagttacatatgtatatgcatacacatatatagttacatatgtatatgcatatacatatatagttacatatgtatatgtatatgtatatacatatatagttatatatgtattagttatatcaaaataactatgtatatatagctgtaaatgtatatataaactatatgtatacagttatatatgtatttgtatatgtgtgtatacatatatagttttttttgttttttttttttgttttttttgtttttttttggagatggagtcttgccctgtcccccaggctggaatgcagtggtgctatcttggcttaccgcaacctctgcttcccaggttcaagcaattctcctgcttcagtctcccgagtacctgggattacaggcacgtggcaccacgccaggctaattttttgtatctttagtagaaatggggtttcaccatgttggccaggctgttctcaaactcctgacctcgtgatccacccgcctcggcctcccaaagtgctgggattacaggcgtgagccaccgcgcctggtccctatacatatatagttatatatacctatagttatttttagttatatcaaaataactatatgtatatgtaactatatatatagtatatatagtatatatatactatatagtgtgtatatatagtatatatatactatatagtgtgtatatatagtatatatatagtgtatatatcgtatatacactatatactatatagtgtatatatagtatatgtagtatatatagtatatatagtatagtatatatagtatatatagtgtatatatactgtatatatagtgtacatagtatactatatagtatacatatagtacactgtatagtatatatagtatagtatatatagtatacatagtatactatatatagtatagtatacatagtatactatatagtatatagagtatatatacagtatactatatagtatatagagtatatatacagtatactatatcgtgtgtatagagtatatatacagtatactatatcgtgtgtatagagtatatatacagtatactatatcgtgtgtatagagtatatatacagtatactatatcgtgtgtatagagtatatatacagtatactatatcgtgtgtatagagtatatatacagtatactatatcgtgtgtatagagtatatatacagtatactatatcgtgtgtatagagtatatatacagtatactatatagtgtgtatagagtatatatacagtatactatatagtgtgtatagagtatatatacagtatactatatagtgtgtatagagtatatatacagtatactatatagtgtgtatagcgtatatatacagtatactatatagtgtgtatagcgtatatatacagtatactatatagtgtgtatagcgtatatatacagtatactgtatagtgtgtatagcgtatatatacagtatactgtatagtgtgtatagcgtatatatagtatactgtatagcgtatagagtatatatatagtatactgtatagtgtatagagtatatatatagtatactgtatagtatatagagtatatatagttacatatacatatagttatttttagtaatatcaaaaaaccatagctaagatttttatgatttagcaaaatattgtttaccccaaagccacgtattatatattaatgatattttttcccttttgagtttttcttccccacaggttttctgatctttttttttgttctctaactttatattataggtatatactcttttctctgtttaatttgctttttaactagaagacctcctttagtagttcttttagtgaatatctgtggttaaactcttagtctttccagtgtctgaaataccctcattttaatgtgacaggtcacttttctcacctcaacattttggacatacctcatttccaacaaacatttgttacttctgatagagagtctgctgtcattctcatacttgttccttgtggaaatgtctatatataaagtctcagaactatatatttttaatatatatacatatttttatttatttaaaaatgtataattaagttagtagtagtagtagtagtagtagtagtagtagtagtagtagtttttttttttttagatggagcctccatctcccgggttcaagtgattctcctgcctcagcctcctgagtagctgggattacaggcacacaccaccatgcctggctaatttttgtattttgagtggagatggggtttcaccatgttggccaggctgatcttaaactcctgacctcagatggaccacctgctttggcctcccaaagcgctaggattacaggcatgaaccactgcgtctggccttaagttattattgactattgatgccctgttgctctatcaagtagtaggtcttatttattctagaacctcgttttaaggtatcctgaatgtggcttttttttttttttttcctaagacggagtctcactctgttgcccaggctggagtgcaatggagtgatcttggctcaccgcaatctctgcctccttggttcaagcaattctcctgcctcagcctcctgagtagctgagattacaggcgcacgccaccacacctggctaatttttgtgtttttagtagagacggggtttcaccacattggtcaggcttgtctcaaactcctgaccttgtgatccgcccaccttggcctccgaaagttctgggattacaggcgtaagccaccacgcccagcctaatgtggattttgtttttttttttaacttgaattttatttatacttcctgattttataatagttaacttgtagtaaaagtaaactggttgtctaaataaataagctgatttcctatactagtttagagtctttagttttcttaaaccgtattaagagatttgattacaaaagtaaaattgaggcttttgtctttttttttggccactctaatttgctgactgacttaacatttgtcttcacagtaaacattgtaaataaacactgatgtttgttgcgtagtatgtaaaaatattatttaggagtggtgagatttaaacatttacaaacctgtaatatatatagtacagcaacactggacaaataaccttttcaacttaatcagaggtgttctataaatgttcatttgcatatatacagcccatataatacttagcatatgtaaaagcacatctttatactctttcaattaaaattgattattattattattttttttttgagacagagtccctctcagtcacccaggctggattgcagtggtgtgatcagggctcactgcaatcgggtagctggaactacagggatgtgccaccacgcccagctatttttgtatttttagtggagatggggtttcaccatgttggccaggctggtcttgaactccatacctcaggtgatctgcccgcctcagcctcccaaaatgctgggattacaggcgtgagctactgcacccggcctaaaattgattagtttttaagaccctcttggtgggaacagactttcatagtgtttatagttataatagtttggaatcaaagtagtcgagtgctacttttttttcctctgtacatcctatccctaatgcctttactatattttgtttcttatttgagagctttatttgcttcataactttttttttttttttttttttttgagacagagtttcactctgtcacccaggctggagtgcagtagtgcaatctcggcttactgcaacctccgcctcctgagttcaagtgattctcctgcctcagcctccgaagtagctgggattataggcccccaccaccacgtctgactgattttttgtatttttagcagagacgaggtttcaccatgttggccagcctggtcttgaactactgacatcaggtgatccgtccacctcgatctcccaaagtgctgggattacaggtgtgagccatcgcgcccggcgcttcataacctttttatattgtctttctgttccccaaaatgaagtagtttcttcttaaaaatactgttttttgtttttttgtttttttttttatttgagatggaatctctctctgtcgccaggctggagtgcagtggcacgatctcggctcacttcaacctctgactccgtggttcaagcaattctcctgcctcagcctcccaggtagctgggattacaggcacaaatactgtttttaataagaaaattagaatagggacaggcacaatggctcactcttgtaatcccagcactttgggaggccaaggtgggaggattgcctgagcccaggagttcgagaccagcctaggcaacatagtgagtgagaccctgtttctataaaaaaaatttttaattagtccggtctggtggtgcacaactgatgtcccagctacttgggagtttgaggtgggaggatggatcacttgagcccaggaagattaaggccacaatgagctgtgatcatgccactgcactccagcccaggccacaggtttcaaaaaaagagaaaattagaattatacgttagggggaaaaaacctaataaccatattcctatctacctagtgaccacccctatgaagatcctggtacatgttctcattgaaatcttattttgaaatatttttgaattaaaaaaatatattattaccttggttttacaaatgtttgcttgtctttatgttcagctacaattttctaatcacaatggttttactttttccttgtcagaaagtggagctgttccaaaaagaaaagaccccttaacacacactagtaattcactgcctcgttcaaaaacagttatgaaaactggatctgcaggcctttcaggccaccatagagcacctagttacagtggtttatccatggtttctggagtgaaacagggatctggtcctgctcctaccactcataaggtattctgggacagtaactttaattgctgtctttttgcaaatagaaaaatttttaagatactattcctgcttaagttgatcataagtactttataatactttagagaatggataagtttccataaagttaaattttttttttttttttttgagactcttgttttccaggctggagtgcaatggcgcgatctcggctcattgcaacctccgcctcccaggttcaagcgattctcctgcctcagcctcccaagtagctgggattacaggcatgcaccaccacgtcgagctaattttgtatttttagtagagacggggtttctccatgttggtcaggctggtctcaaactcccgacctcaggtgatccgcctgcctcagcctcccaaagtactgggattacaggcgtgagccaccgtgcccaaagttaatttttttttaaatccacagggcaacttgctataaaactttttttggacctcattagacatttaataccaagttttgcttacccagtctgttttatataatgctgtatatttcattttaaatttatttttaaaattatttcaatctttgtaaatgttttataccagtaacatacctagagttttgtcatgattctaacaagggttaaaatttgtttttattttgtaaaaactaaatctctggataaaatcctctataactgacttaatgccaaatatagttctctagtgaatacagttttaccttcaggtaaataaatatacaatttatggatttttataccctttttcctatttttaaagcttgaattctgtgaactttaaggttaacttatttatgaaaagtgtaaatgttaggttgtattttcatattaaaattttgtatcctttaagggtactccgaaaacaaataggacaaataaaccttctacccctacaactgctactcgtaagaaaaaagacttgaagaattttaggaatgtggacagcaaccttgctaaccttataatgaatgaaattgtggacaagtaagttttgccatctaaatgttttattttatagtttttatattttaattttacttataaaacatgtcaggagtgaaatagataataaataccttgtctggtttacatacttaatttttatgatagttttcaattataaatgtagaaaaccattgctttactgatttaactatagtttaacagttaacattaaaaataactatatgtcatagggcttaggcttcatcttgtaataactgggccctgtttgtatcgtagaactaactgaggtcttgtttcttagtggaacagctgttaaatttgatgatatagctggtcaagacttggcaaaacaagcattgcaagaaattgttattcttccttctctgaggcctgaggtaagaactttatattatcatttttctataataccatctgttactgaatccatagtagtagtagtagtaaagaaatatttgagctatactaaaataattaattcatataaggtaacaatagatttaatgttttaaaaaagataaaacattaacaattgatgttgagaagttattatagaataggaaaatggatatgagttcctaatttccaatccttttatatttttaggaaaagtgggtagtatgatataattttgttttgttttggagacggagtctcactcattgtgtcgcccaggctggagtgcagtggcatgatcttagctcactgcaacctctgcgtcccagaattcaagtgattctcctgcctcagcctcccaagtagctgggattacaggcatgtgccactatgcccagctaatttttgtaattttagtagagatggggttttgctatattggccaggctggtctttcatacctgatgtcaagttatccacccatttcggcctcccagagtgttaggattacaagtgtgagtcactacatctggccaaattttgatatcaaggtgagagagatttaaaattaagataaggtacaaaaattagcctagtgtgggggcgcacgcttgtagtcccaactactggggaggctgtggcaggagaattgcttgaaccaggaggcagaggttgcagtgagccaagatggcaccactgcactccatcctgggtgacagagcgagatgtcatctcaaaaacaaaacaggccgggtacggtagttcacgcctgtaatcccagcactttgggaggctgaggcgggcagatcacgaggtcaagagattgagaccatcctggctaatatggtgaaaccctgtctttactaaaattacaaaaattagctgggcttggtggtgtgtaaccccagctactcgggatgctgaggcaggagaatcgcttgaacccgggaggcggaggttgcagtgagccgagatcacgccactgcactccagcctggcgacagagcgagactccgtctcaaaaaaataaataaaaatttaaaaagataaatacataaaaataaataaataatattaagagaaggaaatcaggcaggtagtggcccctgacacaatgagttttcccagaattggattgcttggaaatgccgctcaaagagtgtggtaaactccatcgaaggctaaataccaacgtgacagtgataataaacaagtactttatgggaaagttttttttttaattatttttaaaaagagagaaattgtactggagaaaagaggaattcaggtagaataattctttttttttttttttttgagatggaattttgctcctgttacccaggctggagtgcagtggcttgatgttggctcactgcaacctctgcctttggggttcaagtgattctcatgcctcatcctcctgagtagctgggtctataggcatgcaccccaacacctggctaatttttgtgtttttagtagagatagggttttaccattttggccaggctggtctcaaactcctggcttcagatgatccgcccaccttggcttcccaaagtgctgggattacaggcagaggccactgtgcctggcatgaagaacaatttttaaaagaatgacttttaaggatattaagtcatcaaagtagatagagccattaaatgatgggtagaaacctaatcttccatcccatattttatgacttattaaggaagataggcaatcttgcagttgataataaatatttggctttccatacttagcaccgttttgaatttttccagttcacagatggtatatttagtgctgttccaataatattgcaaaaaataaatctgaagactcacttctgggtcacagttatttcactattaacattaaaatcttacggacctacctgcaacatgtagtggaaataagttgtgtggcacgttgtggtgggtgcattattaaataaatgtgcaaaggttttatggctgtctcaatttttccatagtcttgagtcattcacatactgcctttatggtgtttatcacttgtaagtgagtaccaactgtactagaacttactgaatatttttcaagtctattttacttattactcattctaagtacataaaatcactggtctgatatgcaagttaggttttcgctaatacccagtaaaataattagataattattaaaatagaaagcatttgtcattatgtgaactggatttatgtcatgtaccacctcaggtcacactttgggaaacgtagcttacgtattgagctaacattttgctggagttatataagattagtaaatgctatagactaaatattgaaaaaaaagcttgcttaaagaggatttacataattgtagacctgaaaaggatcttagcagtcttctgatcgattcattgataaagaaactagtcctaagagctaaaatgacttgctcaagattttagttaagtggtagacctaggaaatacctttctaagattagagctgcctggttagtgctatagctgccacctaattcttacatttatttattaagggacatgctttttacggtagaaaaatatatctaaaattgtgaaggtaataccaaggaaatatttaggctatgcaagaaaagtcattcagcttttgctttacccaggcctatagagaacatatctaaaataataagtaacatgtgaatttgaatttaggcatattttcatggtagtgacataatgtgcaattaagaagctataataatgtaaaaatgccagttgcaagttatttcaaataaagttgaataacctgacctcaggaggggcagaaaccttagtaaacttagcaaactgagacctaaggaagagcaagatctgtggtagagccaggtctaaaggtttatatcctggtacaaacttgtctatacatcaccacacctgccaaatggaactttttttccttgtagttcagatttccaagaaagggaatattattgtcctagctcagcgtttcacaatagactcacaaaatgaatcttgttaagcctatgaatgggtaagacttatcccataacacgcctctattgtgtaaaaaaatcagctttattcctaattccctgtagtaggaagcttgcatagaccacaatagagacattgttagattatatcaagaaggtgagtggcaggcattcttgagtatactggaatttttatttcattgtagaaacacagaatcataattagtcatctaaaactggttttaaggagataatactaaagatactcacttgaggtagattgttctcagaattacttaaaataagtgctttaaatcttgctcattcatgaagccatagccctggaaggagatattgaaaaacttctccatcttccttcaatcccataggaccatgtttttaattgtagtttaacattaaacataatttttgaaagtagccaatattaatctttgacaaaaaactcaaactaaatagcagaaaatagaacatgccctctcctctcgcccaaaagtaagactacattttaaagtatatcacagtgatctgtctaaatatttttctcaaatattttactaagaaagcgtatattcttctgtccttatttcatagatctcttctgtatcctgtgcagcttgtctatcatttcgagcttttatatttcttattttgttctcttgctgcttaaatgtgattctttgagatttatagaagaatgtgattgttctccagttttaaaaagctcttctctatctactaaaatttccatgaatttctttctttctttttttttttttgattgagacagtctcgctgtgttctccagcgtggccttaggcttaagtgatcctcctgtctcagcctcccaagtagctgagattacagaaatttccatgaatttccaaatatgatgttatctttcatataagcttaaacataagcctttcttctttcaaaaatgttagaacttacctctttaaataatcttataaagccatttcttaatttttgttaccttttcgaatctattaacttgcatatcatagtaaatgaacccttagctccatcataccacacaccttctactcctgtcctcccactttttctcacccaggctggagtacagtgaatatttagtgcttttaaatattattcattaccaagccaagtagcgtactattttttccttgtacagcctttttttcccctaaataattgtgttattttttcatttgcttcattttcatcttatcgattgataattcttctgttccatttcagtctaatttccacatggccaaaccaatctaaaaacctgttaactcaggtcttttttttttttttttttcccagaataccttttcctggaaccaccttcttcttttcattcgagaccaaatgctttccatgcctgtgtcaaagtggttgttctctaatctgtcttcactaccatcataatttccttttccttttttcctttctttattatgtatctcctgtcttttaaattccatattttccactttcatgatttattttctcattttgatggctacatctttcagtaactgagaaaaggttgtgtgagggaatattttgagatgctgtagttttgaaaatatctttattctgctgtcttctcattaataatttgactggatgtcaagatttaagttggaaactattttccatgagtattttgaaggcattatctattgtcttctagcttccagtgctgctttgtattagagacagaagatcaggaatcaggatagcattggacttcttatttctatttcccaaagctttttggatcttctctttattcttatcttctgatattttataatgatatgcttgatgcatttactttttcttttcttcttccctcttgtacatttctttctttttttaggtgggggcaggggggaaggagtctcactcttctcacccaggctagagtgcagtggtgcaacctcagctcactgcaacctccacctctggggttcaagcgattctcctgcctcagcctcccgagtagctgggattacaggcatctgccaccacgcccagctaatttttgtatttttagtagagacggggtttcaggctggtcttgaactcctgacctcaggtgatccgccctcctcagcctcccaaagtgctgggattagaggcatgagccactgcgcccagcccctcttggacctttctagatattcatccttcaattctgagaaaggttctataattctttaatttaaaaaaagtttttttgtttcatctttctcactttttttttttttttttttttttaagacacagtcttgctctgtcacccaggctggagtgcagtggtgcgatctcagctcactgcgcccttcgcctcctgggttcgagtgattctcctgcctcagcctcccaagcagctgggattacaggtgcccaccaccaccatgcccggctaattgttgtatttttagtagagacggagtttcaccatgttggccaggctggtttcaaactcctgacctcaggtgatccacctgctttggcctcccagagtgctgggattacaggcatgagccaccgtgcccagccctattctgatttcatagatgcagtgtcttttatgtctctgagaggttttgtcaagttttcttttgtttactttattatctgtttcttcaagattcctcctcttttctttttgccttaagctttttcatattggaagcttctctcaaatgtctggttattctggttgtccacttatattacgtggaacaataaaaaagttgattaggactctgtgctgtaagtaagtaaattgttgatagtgagagcccattaatcacaggatgatcaagcagcaagcctactgtttatttgggtttctccaaatggctatagctgtcagtcttttttttctggggttatttggcttctctagaaaagaattttctagtctcttgtttggagaatacaagcttgactattggtgttccagaaaatgggtgggaggagacgactttgttttctgttaggttgagccatgtgaaattactaggttttgttttgttttctgttttgttttgagacagagtctcactctgttgcccaggctggagtgccttagcatgatcttggctcactgcaacctctgcctcccaggttcaagcaattctcatgcctcagcctcccaagtagctgggattataggcatgcaccaccacgcctggctaatttttgtatttttagtagagacggggttttgccatgttgaccagtctagtctcgaactcctgacctcaggtgatccacctgccttggcctcccaaagtgctgggattacaggtatgagccaccacacctgggctgaaattactgtttttataggtcaaaaacagttgagggataggcatggtggctcccacctataatcccagcactttcagaggccaaggcaggaagattgcttgagtccaggagttcgacaccagcctgggcaatgtagtgaaaccccatctatatttaaaaaaaaaaaatagatgaatatctttgtttgcagataacatgattgcatatgtagaaaatcccaaagaaccaacaaaaagagctcctagaactaataagtgattatgacaaggtgtagaatacaaagttaatatacaaagtcaattgcttttttatctaccagcagtgaacaactggaatttgaaattaaaacacaatactgctgggtgcagtggctcacacctgtaatcccagcactttgggaggccgaggtgggcagatcacctgatgtcaggggttcaagaccagcctgaccaatatggtgaaaccccatctctactaaaaatacaaaaattagctgggcatggtggcgggtgcctgtaatctcagctactcaggaggctgaggcaggagaatcgcttgaacccaggaggcagaggttgcagtgagccaagatcgcgccattgcactccagcctgggggacagagcaagactccgtctcaaaaaaaaaaacacaatacctttcatattaacactaataaaatgaaatatgtgtagttctaacaaagtttgttgtagaagatctatatgagaagaattatagcactcatgaaagaaatcaaagatctaagtaaactgagagatattccatgtaaatggacagggagactaaatattattgagatgtcagttcttcccaagttcatatatcgattcagtgcagtcccagtcaaaccccagccagttattttgtggatactggcaaactaaagtttatatgaaaaggcaaaagacctagaacagccaacacagtattgaagaagaaaaaagtcagaggactgaaactacccaatttcaagacttactgtaaagctacattaatcaagacagcatgtcattggcaaaagaatagacaaataaatcagtagaattggacagagagcctagaaatcaacccacacagataaagtcaactgatctttggcaaagggacaaagacaattcagtggagaaaagatagccttttcaacaaatggtataggacaactggacatccacatgcaaaaaagttaatctagacacagacctgacaactttcacaaaaataaatggatcatagacctaaatgtaacatgcgaactgaaacttctagaggataacataggagaaaatctaggataacatgagaaaaatttttggtttggcagtgacttcttaggtacaataccaaaacatgatccttgaaaaaaaaaatcagtatgttgaactttgtttaaattataaacttctgctctgtgtaagatgctgttaggagaatgaaaagacatgcagcagagtgggagactttacaaaattcattatctgatgaaggaccagtatccaaaatatacaaagaacttttaaaactcaacaataagaaaatatacaacccagttaataaatgggcaaaatatctgaacagacacctcaccaaggaagatagatagatgacaacaagcatatgaatatatgctcaacatcatgtcgttagggaaattgcgcattaaaacaacaacaagataccctgccatccctattagaatggctgaaatctaaaacactgacaacaccaaattctggcagggatgtggagcagcagaaactttaattcattgctgatggaaatctaaaatggtagaaccattttggaaggtagttggacagttttttacagaactaaagacagtttgacagtttcttacaaaactcttaccatatggtccagcagtcttactccttagtatttacccaaataagtttaaaatgtacatccaataaaaaaaactgcacatgaatatttctagcagcattattcatagttgccaaaacttggaagcagtcaaggcatccataagtaggggaatggataaacagactttggtatatcatgtaatggagtattattcagcaataaaaagaaatgatctatcaagccacaaaaatatatggaggaaccataaatgcatattgctaaatgaaagaagccagtctgaagaggctacactataggattctgactatatgatgttttggaaaaggcaaaactatggaaacagtaaatagatcagtggttgccaagggagacagggagagatgaataggtggagcacagtggatttttaaggcagtgaaactgttctttatgataatccaatggtggatacatgtcattatacctttgtcaaaacccacagaatataaaacataagagtgaaccctaatgtaaaatatggacttcagttaataataatatatgaatattttttcattagttctaacaagtgtactacactaatacaagatattcagagtaggggaaattggaaaggaatgagaggttatatgggaactctgtactttctgctcaattttctgtaaacctaaaatcactaaaaaaaaagtttatttttatttttatttttttttaatttttaattttttgagatggagtttcactcttgttgcccaggctggaatacaatggcacgatctcggctcactgaaacctccgcctccagggttcaagcgattctcatgcctcaacctcccgagtagctgagattacaggcatgtgccaccacgcccagctaattttgcagttttagtagagacagggtttctccatgttggtcaggctggtcttgaactcctgatctcaggggatctgcccgcctcggcctcccaaagtgctgtgattataggcgtgagccactgcgcccagcaggtttttttttttaagttggatattagccatttcatatgattcaacttaaaagtacatacaccttcactgttattaaagtgtaggtgagatgttttcagtctggagctctacccttgattcctgccatgcctagtgtccctgaatctggagactctgacttatttctttagagaacgaaactcctgccttctgctttggtggtgattggtacctgcttgactgcctttggtggggagttcctcataccaactttcaatcagttcctgtgtttgtttgtttgtttgtttttgagacggagttttgctctgtcgcccgggttggagtgcagtggcgcaatcttggctcaatacacgctccgcctcccgggttcacgccattttcctgcctcagcctcctgagtagctgggacgacaggcacccgccaccacgcccggctaatttttttgtatttttagtagagacggggtttcatcgtgttagccaggatggtctcgatctcctgacctcgtgatccgcccgccttggcctcccaaagtgctgggattacaggcgtgagccactgtaagccaccgtgcccggccagttcctctgtttttgactgcctgccttactactgctttctgtggtgcctgataacatccaattcctgaaccttcctgggatttttgttcacgtcagcgtgcttcttgcatttaggtatcccttcacaagtaggcatttaggttttaagctctgctaagtgatttaccacactttatcagttctccattttgtggaattcattgtgttaatctccttttctatttttgtttggaagattcatatattttttattcatttagtattttttggtgggatttctaagtagagaaacatgcctatgttcaatatgtcttgtttaagcagtctgctttcatttttaccaccgaggagttggttttatttctttttttttttttttttttttttttttttgagacagggtctcactttgtcagccaggctggagtacagtggcacaatcaaagctcactgcacccttggcctcccaagctcaagtgatcctcccacctcagcctcctgaatagctgggagctcaggtgatccagcacacccagctaattttttttttttttaattttttgtagaagcagagttcccctatgttgcccaagctggtcttgaactcttgggctcatgtaatcctcctgtctttgccccctaaagtctgggattacaggtgtgagccaccacacccagctgtttttaattattacattaatttatgattatgtgtttcctttaaagctatgggcagctctgtttgggaagatgctactgaaaaaaggatgctttttagatggcaaagagtacttaaaatgtctctagaatcatagttgtaaactaaagtatatattttttagttgttcacagggcttagagctcctgccagagggctgttactctttggtccacctgggaatgggaagacaatgctggtaagggttctcttcaaatttgagttttctgttgagatatttgggataatatgaaaaaaagaaactttatcttgtccttgagtctattatttacgacttgctttttgctattgtacacttttgttttttttgtttgtttgttttgttttgttttgagtgatctgggctcaccgcaacctccgcctcctgggttcaagcgattttcatgcctcagcctcccaagtagctgggattacaggcacacgccaccacacctgtctaggttttttatttttggcagagacaggatttcgccatgttggccaggctggtgtcgaactcctgacctcaagcagtcctcctacctgggcctcctaaagtgatgggattacaggcatgagccactgcacctggctgatacacttttaagtttttcagctacttttcaatgtagaagtagatggaaaaccatgtacgttatcttcagtagtgtgtttttggttggttaaatttgacagtatgattgtcattattttttgtaaattaaatttttacctggaagagcttaccttactatattgagtatctttctaacccctgatttttgcttctactatcataataactttatttaagtaatcagtatgttatagcttttttttttttttaagtattcttttgccagaagtttttatcaggctctggatacctctttcctctgcatagtcctcctggatggaagaaacaaagagggaaagagtaacttttccttagatgtttgtctttctcaaagcagttatctttgtatatctaagaagagaggagaataacactgtctctctttttttttaaatctctctctactcattctctctcaggaggagagtagaaagaagcacagctcttcctataacctgtccttattactgagaaaggaacacattgattgccatgtattggggattgtattataccttacatttttatttttattttttattaatttttttttttagacagtcttactctatcacccaagctggagtgcagtgatgtgatctcggctcactaccatctcttccttctgggttcaagcaattctgccacgtcagcttcctgagtagctgggattacaggcatgcgccaccacgcctgactaatttttgtatttttattagagatgggatttcaccatgttggccaggctggtctcaaactcttggcctcaagtgatgcgcctgcctcggcctccgaaagtgctgggattacaggcatgagccaccacacctggcctcatagcttacatttttagagaatcttttctagtacttaaatcggtaaatatggttatcttttaaatgtaatatattgaactaatttaatatttgctcttgtgatttttaaaggctaaagcagtagctgcagaatcgaatgcaaccttctttaatataagtgctgcaagtttaacttcaaaatacgtgagtgctctgtttccaatattgtcgtattttaagttactgtctaaatgttactgtgttaactgtaaatggtaatatttcatgaaaatatttttctaggagcttatctattgtatctattatttacatatgatgaatatctatcttcagagtagaaagttatgtacatttgtgttgtcaaatactgtattagtttactggggccatgtaataaaataccgtaaactggctggcttaaacatcagcaatttattgtctcacagttgtggaaggtagaagtctaagatcagtcaaaatgttggcagggttgcttcctcctgagggctgtgagggaaaatgtatgttgtgtgcctctctcctggcttctggtggcttgctggcaatcttttgtattccttggcttgtagatgcatccctcctatctctgtctttatctttatgtggcattctccctgtgtctgtcaccatgtccaaatttcccctgtggattaggacccaccctaatgatctcaatttaagtttgtcatcagcaacaattctatgtccaaataatgtcacattcataggtactagggataggacttcaacacgtttttggagaacacagttcaacccattaacaaatactatcactttccacttaagcttcaagtaaagtggattttatctcaaggagccaccagataggaacacagatctgatggcataaactgagtatttctggccttctgattctgatctaaaatatgacagaagattttccctgttttaattttttttttttttttataatagagacacagtctcgctatgttgccaggctactttcaaattcctgggcttaagcaatcctcctgcctcggactctcaaagtgctggaattacaagtgtgagccaccacacctggccagtagattttccctgctttcttttgattgtttataattttgttttctttttccattcaccctctgctgaccctatagtattattcaaagaagtgttcagtctagttttggggtagggcaagcataactacagtgcttaaagagagtaatttgtctggtgtgcagaactagtgtgtaaatataactggtgcattgcaaaactgtgaagtagtttctgtcaaaccttacactgctttgtctttctccctctctccctttctcttggttgccccctccccctcccaatgataccttagtctctgcttgcctttatcaaaacctttatgattggccgggcacagtggcccatgcctataatcctagcattttgggaggctgaggcaggaagatcacctgagcccagaagttggagaccagcctaggcaacatggtgaaaccccatctcttccaaaaataaaaaatagagccaggtgtggtggcatgcacctgtagtcccagctactcaggaagctgaggcgagaggatctcttgagcctgagaggttgaggctgcagtgaactgtgatcatgccactgcactccagcctgagtgacagtgtgagaccctgtctcaaagaaacaaaacaagggggggcatggtggctaactcctgtaatcccagtactttgggagactgaggcaggaggattgcttgaggccaggagttcaataccaccctgggcaacatagtgagacccccatctctacaaaaaataaaaaatttagctggacatgccagcgaatacgtggtcccagcaaatcaggaggctgaggtgggaggatcacttgagtcaaggaggttgaggttgcagtgagccacgatcatgccaatgcattccaacctgggcgtcagagcaagaccacgtctcaaaaacaaaacaaaacaaacttttatggttgaaagtgttttggcaaacatacttaaactgaaatgtgaatctctgatgaaagaacatgttacctgtaaaagtttgaagtgtcagcatttgttgcaccgaaatccagaggtgaggccaggtgtggtggctcacgcctgtaatcccagcactttgggaagccaaggctggcagatcacctgaggtcaggagttcaaaaccagcctggccaacattgcaaaaccccgtctcgactaaaaatacaaaaattagccagacttggtggtgtgcgcctgtaatcccagctattcgggaggctgagacacgagaattgctcgaacccaggaggcagaggttgcagtgagccgagatggcaccactgcactccagcctgggcaactgagtgagactctgtctcaaaaaaaaaaaaaaaaaaaaatccagaggtgaatccagaggtgatcaccacatgatatccagatagcctctttccatgagaggctcaaaggataattttactgtctacagttttgcagcgagagaaacttgattttatcagtacaccaagagcagatctatgtcttcggaacagacatgagatcagaattgtctagctgctatgaacagcatgttctctccctgtacctatagacatgtatgggaaacttatttgtaaggttgtataatgagcagtgagttaaagcaaacttgacatgttgaccatagttgttatggcattggactaaagtagcctccatcactatgatagagatagccttggtgttggacccatagtttttgaagtctgtttgctaagactccctcttccttaggcagttcttcaaatattattatgctttttcctgtcatgggattcctcttcatggagtttcctttctcaggaacactatcttctcctggttaatttgtacttattcttcagataccagttgaaatgttacaaccttccctgaccctccaaactattccccgttattattctcctagcaccacttgcacctcattttcatactcactggagttgcaattcatattcattgataggattattttaattgtatctgatatcactgtcacctccactagaagatggtctccatgcgggcagagactatcaccatgtgttcttcacttcaattttcagtagttggctgtgagtaggtattgaataaatatttgtggagtaatcataatgaggtatagatattattctcatagctctattttattaattagggaattacagaattcagtgatctgctcaggatctcataaccaggaagtgggaaactaggatttgagctccagtgagtgtggcctttcattaaaaatattacagcaaccattctctttttttttttttttttttttgagatggagtcttgctctggagtgcagtggcgtgatctcggctcactgcagcctctgcctcccgggttcaagtgatccccctgccttagcctgctgagtagctgggactacaggcacccgccacgacacttggctaatttttgtattttagtagagacggggtttcaccatgttggccaggatggtctcgatctcctgaccttgtgatccgcccgcatctacctcccaaagtgctggattataggcgtaagccaccacacccggcctacagcaaccattctcttttatccatacttttttcaagagtactgtttcatcttcatgttttcagaaacaacatagcattcatgatcttaacccccaattctgatactgcctgaatatcttgaagtaagtttacttttaagaaagttgaggctaggtgtggtggctcatgcctgtaatcccagcactttgggaggccaaggcaggtggatcacttgagctcaggagttcaagaccaggctgggcaacatggcgaaaccctgtctctaccagaaatacaaaaaattagtcgggcgtggtggcgtgtgcctgtggtcccagccacttgggagactgaagtgggaggatttcttgagcttgggaggtggagtttgctgtgagccgagagatcatgccactgtactccagcctgggtggcagagtgagatcccatctcaaaaaaagaaaagaaaaagaaaattgaaatgtctagtctatcattttgtcagttctatctaatacaattttttccttatgtctaactgaaatctgctttttctaatttttacatacttgatttaacaaaactcaatctttttttttttttatgagacagcctttcaaatatataggaacttaatgttatatctgcttccctccagtccccagaatagttactattttagttgtctttctatggtctcatgccagtttgtcagtatgcctagataagaactgaatattttacctcagatgtgacctgactttgaagacttaaaaaggaagcattgtgccaggcgcagtggctcacacctgtgatcccagcactttgggaggccgaggtgggcaggtcaggagtttgagaccagcctgattaacatggagaaaccccatgtttctctactaaatacaaatctctactaaatactaaatactaaatctctactaaaaatacaaaagatgagctgggcattgtggcacatgcctgtaatcccagctactcgggaggctgaggcaggagaatcacttgagcccaggaggcggaggttgcggtgagccgagattgcgccattccactccagcctgggcaacaaaagtgaaactccatctcaaaaaaaaaaagcagcagcattgtgtaatattatgtagatgttgtgtctcatgatctatcctgagaaagcttttgggaggaactgcatcatagtcatggacaacatttgtgttattaaaatatctagattattttccacaaaaaatcagttacatatgtatcttaacatgttgtattattgtttaaccttgtttattgaataactaacatgtagaaaagtatttatagcataagtatacagctgtatacagctcagtggattaccacaaagcgaatatactttcataatcaccacccaggtcaagaaataaattgttacctgtggccctaaaatccctccaggcactccaccatctttatccactcactcctctccctcaaaaccactagactactaacatcatagacaaagctagcatgcctttgaactttatataaatctaatgatgtaggattttgtgtgtatgtgtatttggcttctttcatcagcattgtatttgtgagatttatccagattgttgcaagtagttgtagttgtgcttttttacacagatttaatttttatatttttcttatatgttcgaacagttaacctgcttatctattattaaaaaaaaaaaaacgaacattcacatagttcttaccagtttacagtgttttttccacaccgtcttcaaaatgtaaagtttggtcttcaatacatcagtatgctgctagatttaaatactagggaaaaaaaaatcagagaagttaataatattaactgtcacctccactagaagatggtctccatgtggacagtaatatttctcttgtattatctgtgctaagtaaaatcttctgtaagtttctttaaatattttaataaatcatagtacttaaaatgttctcaatattctaaagtagttaaaagtaactataaaatagtacctgtttttctgatcacattttacttcctatgtgaaattttacaagtcgttactctatttatttattgatttattttttaagacagggtctgttctgtcgcccaggctggagtacagtggcgtgatcatggctcactgcagcctcagcctcctgggctcaagtgatcctcccaccttagcatcccaagtagctgggactataggcacatgccaccatgcccagctaattttaaaaaattctggggggccgaatgcggtggctcacacctgtaatcccagcactttgggaggccgaggcaggcgaatcacaaggtcaggagttcgagaccagcctggctaacatggtgaaaccctgtctctactaaaaatacaaaaaattagcggggtgtggtggcaggcgcctgtaatcccacttactcaggaggctgaggcaggagagttgcttgaacctgggaggcagagattgcagtgagccgagactccatctcaaaaaaaaaaaatttttttttgtagtgacaaggtgtcactgtgttgccagggctggtctcaaacttctgggctcaagtgatcctcccatttcggcctcccaaagtgctaggatcacaggcatgagtcactgtgcctggtcttcaagttgttattaaagcatgtttacccacattatgcacatggtataatggaaagtattgttgtggaagttaggagatagggattctagcctagctttttatttttttgggacaaggtctcactttttcgccccaggccgaagtgcagttgtgcgatctcggctcactgcaacctccaactctcaggttcaagcaattctcccacgtcagcctcccgagtagctgggattacaggcatgcgccaccacgcccggctaatttttgtagttttagtagacacagggtttcaccatgttggccaggctggtcttgaactcccgacctcaggtgatccacccaccttggcctcccaaagtgctgggattacaggcatgagccaccgcacccggcctctagcgtaacttttacatcctgaactgaccttaagaaagtataactttaggcctgtttcatctgtaaaatgttaatgtcataggagatgatcttttgagatttctttcagctctgataattttgtgtgtgtgtgtgtgtgtgtgtgtgtgtgagatggagtcttgctctgtcgcccgggctggagtgcagtggtaccatctcggctcactgcaagctccacctcctgggttcacgccattctcctgcctcagcctcccgagtagctgggactacaggcgcctgccaccacgcctggctaattttttgtatttttagtagagacgaggtttcaccgtgttagccaggatggtctcgatctcctgacctcgtgatccgcccgcctcagcctcccaaagtgctgggattacaggtctgagccgccgcgcccggcctagaatatttgtttcgattattctaaatctggtgacatttcttttgtttttaagttaaatcttcagtaaaaagaataaatgccacctagaggacagaaaaatttttacagtagattatcacagacctcatgactcattactttggtgtataaaatggcctttgtatggtgtcagcacctgggaatgtctcaaggggtgttcattgaccttctggactatctggaaatattttgatatttattggctgggcgcggtggctcatgcctgtaattccagcacctcgggaggccaagttaggtggatcacttgaggtcaggagtttgagatcagcctggccaactaagttagttgactatttgtgaaatttccctctccaaataggaaagataggattggaaacattattcagaaggaagaagttttaaagaagggcaggcttaaagactatctaatgaatttaccaatatggtaaaaccccatctttactaaaaatacaaaaattagccaggcgtggtggtgggcgcctgtaatcccagctacctgggatgttgagggatgagaatcacttgaacccaggaggcaaaagtcacagtgagccgagattgcaccactgcactccagactgggctatagagcaaaactctgtctcaaaaaaaaaaaggaaaaaaaaaaaagaaattttgatatttatgtgagaatgacttttcacggtgttcttaatagcgcaagttttgtttaggagagcacattccaacttacttgcttctataaatataccgtgtaatctagggcttaaagaatatgtacaatgtctttttctctcccctagtcttccccttttctcactagttatatccttgactgaagagctatttcattctcaagtcttaggaatgcagggtgaagcaaaacagatgaatttttaaagcacttaaccaggctgtatgaaatcacagtctgttgtctaaaattgtaagggacggttagtagtactctcccctttctcaaaccaaatctttggttgttttaaggaagggaaattaaattcctgtgtgctagattttcaacataaaatttaaaaaactggaataatgttgcattttatgtgtataacagtataatgctttgttttaggtgggagaaggagagaaattggtgagggctctttttgctgtggctcgagaacttcaaccttctataatttttataggtaagaacatattttccaactaagttattgactatttgtgaaatttccctctccaaataggaaagatacgattggaaacattattcagaaggaagaagttttaaagaagggcaagcttaaagactatctaatgaatttagtaggacccactatattaataagtagtaaactagattaatctcagatgactcacatagcttggtctttaattaaagtcttatacttgtatttcctctagatgaagttgatagccttttgtgtgaaagaagagaaggggagcacgatgctagtagacgcctaaaaactgaatttctaatagaatttgatggtgtaagtgttgattatgatatttttaatgtggcagcattttagtatattttcctattaaatggccaaggttaaaaatacaaatatctttatatttgttattacttttctaaatgaattgaaaaaagattttttgcttgtaggtacagtctgctggagatgacagagtacttgtaatgggtgcaactaataggccacaagagcttgatgaggctgttctcaggtagggagatttatatggaaatacatgcatttattacagacaatatttactcatgtgtccatcttacatattatttccttactctcagttttaagactaaattcactattttcttccagtactatctctagcctcttgttaccaactacataaggattttgaggtcaacagcttgatatcaggagaattagtctagtaaaggtttagttacggttttaggcaaattggtcagttcttctgggttgcattaaattatctttaaacttgaaaattgattcttaccgtcttttattgggcttcatgagaaaataatcaaatcagggttcatggaaaatgtgttttctgttcttgtgtgtttgagcagtttattcccttcatactggaaggacggtttgggtcagcataaaattcttgggcatcctttcccaaggaatttacaatattgctccattgtttctagattggctgtagtagtgtaaaagtctgaatccaaattgattttttcaaatttgtaaaataacttgatttttttctctctttactggatgggttacgtgggtatattgcacccaggtagtgagcatagggtgcagtaggtagtttttcaacccacacctcactgctttcttcccccatgtagtagtccgcagtgtgtattgttcccatgtttatgtccatgtgtactcaatttttagctccccacttatgagaacatgagctatttggtttactgttcccacattaattggcgtagtattaaggcctccacctccatccatgttgctgcaaaggacattatttcattcttttttatggctgcgtagtacatagtattccatggtgtgtacgtaccacattttctttatccagtccaccattgatggacacttagattgattctatgtctgctgtcatgaatagtacagcaataaacatgaaatgcatgtctttttggtataatgatctattttcctttgggtatatacccagtaatgggatttcagggtcaaaggtagatttgttttatgttttttgagaaatcttcaaactgctttctacaatgactgaactttacattcctaccagcagtacatacgctccacaacctcaccaacatctgttatttttttactttttcccgccaatctgtagacaatatgggattttttttgccattttattaatagccattctgactggtgtgagatatctcattgtgattttgatttgcatttttctgatggttagtgatgatgagcattttttcatgtttgttgtcccctcgtatgtcttttgagaagtgtctattcatttcctttttacccattttttaatagggttgtgtgtttttagcttgttcaattgtttgaattccttatagattctggatatcagaccattgttagatgcagttctgtagattgtctgtttactctgttgatggttctttttgctgtgcagaagctctttagtttaattaggtcccacttgtcaatttttatttttgttgcaattgtgtttggggacttagccaaaatttctttctgaggctgatgtcaagaagtgtatttcctagttttcttctagcatttttatactttgagatcttacatttaaatctttaatccaccttgagttaatttttgtatatggtgaaaagtaagggtccagtttcatttttctacatatggctagccagtaatccccatgccatttattgaatagggagtccttttcctcattgcttgtttttgtcagtcttatcaaagatcagatggttataggtgtgtggctttatttctcaattttctgtcctgttcctttggtttgtgtgtctgtttttataccagaattatgctgtttgggctgctgtgtagttcggtttaaagtcaggtaacgtgatacttacagctttgttctttttgcttaggattgctttgtctatttggactctttttttgcttccatatgaattttagaatatttttttctaattttgtgaaaaacaacattgatagtttgatagaaataccattgaatctgtaaattgctttgggcagtatagtcattttacgaccagataaatcaggcaagagaaggaaacaaaaggcatccaaataggaaaagaagtcatcatactctcactcttcactggcaatatgattctatactttgaaaaccctaaaaattccgtcaaaaggctactagaactgataaatgattttaccccaagattcaggatacaaaatcagtgtacaaaaaattagtaccatttctatacgctaataatgtccaggctaagagtcaaatcaagaacacagtcccatttacaatagccacaaagaaaatgaaataatggctgggcacagtggctcatgcctgtaatcccagcactttgggaggctgaggcaggtggatcacctgaggtcaggagttcgagaccagcctgaccaacatggtgaaaccccgtctctactaaaaatacaaaaaattagccaggcgtggtggtgggcgcctgtaatcccatctgctcgggaggctgaggcaggagaattgcttgaacccaggaggcataggttgcagtgagccgagatcgtgccactgcactgcagcctgggtgtgaaagagcaagaatccgtttccaaaattaaaaaaaaaaaaagaaaaaaaaaaagacaatggagtacctaggaatacggctgatgaaggaggtgaaagaatctgtatgaggagaagtgtaaagcactgctaaaataaatcagaggtgacacaaataaatggaaaaacactccatgctcatggattggaagaatcaatatcgttaaaatgggaaatttatcttaatttttttccctagttcatttttctgttttcttttgcacataaattatgtgttatgttgcgtccttttgttttccctatctgtaattttcttcttcatccttttaaactcttaggtctttttgttttgttctgttttcccaagcctgttgcctttatttcttactgggttagtatctaatctcctttctgctatatcttttgtaactcttctttccttggtggttttttattcattactttcctgacatctgttattctacttttcatcttctgttttatttctttgagcatctgtatgttatttccataagctcttacatttcactgggctcttgtttcatagaaaacaattttttggcaaggacagaccacttgaggccaggagtttgagaccagcctggccaacatagtacaaccctgtctctgctaaaaatacaaaaaattagctgggtgtggtcacacacacctgtaatcccagctactcaggaggctgataatcgcttgaacccaggaggcagaggttgcagtgagccaagacggcggcactgtactctagcctgggggacagagcaaggctctgtctcaaaaaaaaaaagaaaaaattttttggtcaggcgtcatggtgggtcacacctgtaatcccagcactttgggaggccagatcacttgaggccgggaattccagaccagcctcgccaacgtggcaaaaccccatatctataaaaaaaacttaaggataaaaaaaattaaatttttaaaaaattaaattattttatttcgtggaaagatacttggtcataattttagtttgctctatggcaaaatcttctcatgcatgttcttcattttatctagtttatgtttattgtgttttgtttgctcttttttgggggcaggttttgttgttgttgtttttttttttttttttttaaatgagccctgtcctggtttttccttttttgcttattatttttctttgaataaaaggagttttcttggaaaacctagttttggaaggatattgtaggggaagggataggtatcttgagtagtccatgtatacactaaactagcatgcagcctccctcacttacagtgaagccctacctaataatgaagtatatgtgtatgtaaataagagatagggttgatttattcttctactaaaaaatattggtcactgcaagacattgtcttcccgccagactgttagatgccttcttataaagataattcgtcttagagtttctttgttcattctcaccttccttgccattcctatgctatcaattagggtttatatggtctgcagagccaggcttcatatgcttgtttaaatgtggagggactggccttattaccctttagggtgtgctatctctttttgggaggaaaactgtactctgacagtcatgtccatgatctttagcggcagatcctttgtgtgtcttcctttgtcagtgtaattttcactgccctaggcagttcacctttatgtattttagttccataaatgttacctagtttgttgatgaagtgtatgtttctgtttctattatccttgctgattttagtttttttcagattcaagaagacagatctacttatatcagatattttgtttgttttaaagcattactgctattaaaaacatatacatacataaatgattaattctaacaataccgaattaaggattttaaacattaactagagttttaaaagagtaacaaaaatatttttacattgataactaccaaaatgcattccagtgccttgaatattatattttaaaagcttttcctgtcatttgctgtttcagctttaaattcaaaattatatttctaaaagtgctggatttttttttttaggcgtttcatcaaacgggtatatgtgtctttaccaaatgaggaggtatgtatctgtgtttgaattttttttgttttagagcagaaacaagaactaccatcttgacaatattaagtcttccaatccatggtacagctactttggaaaacagtttagtggtttcttaaaaagatgtacataagcttactgtcagagccagcaatttcactcctaagaatttaccccagagaaacaaaaatgtatgtccacacaaagacttgtacaagaatttttatagcagcaatattaataatagccagaactacaaatgatctaaaatgtttattttggtgaataaacaaatgtggtatattcatttaatggatactgttatccattatacatgctgcatactcacttcatatattaagttttatgaatgaaactccaaaacattataagtgaaagaagcaagatgatatatgtcgcatatcataggattctgtttatatgcagaaaacgcaaatttattttttatttatttatttttttgagatggagtcttgctctgtcgctcaggctggagtgcagtggcgtgatctcggctcactgcaaccttcacctcctgggttcaagtgattctcctgcctcagcctcctgagtagctgggactgcaggcatgtgccaccaggcctggctaattttttgtgtttttagtagagacgggtttcactgtgttagccaggatggtgtgatccgccctcctcagcctcccaaagtgctgggattacaggcatgagtcaccgtgcccggccagaaatcgaaaatttctagaaacgtaaagcagatcagtgggttgtcagggtgagagttgggaatgaggattaactgcaaacaggtatgagtgaactaaaaagtgttctaaaactggattgtggtgatgattgcacatctataaatgtattaaaactcattgaattatatacttacaatgggtgaaattcatagtagatgaattcatacctctataaaactggttttttgcagcaaaatatttattgctatgtttttattcaagtgtggtgaattattgctatgtttttatccaggtgtggtgtctcacgcctataatcccaacactttgggaggctgaggtgggaggatcgcttgagccaggaattcaagaccagcctgggcaacatagggagaccctgtctctacaaaaacttttttagaaattaaccaggcatggtggcacgtgcctttggtcccagttactcgggaggctgagatgggaggattgcttgaacccaggatatcgaggctatagtgagctatgattgtgccctgcactccagcctgggtaacagcacaagaccctgtctcaatataaaaaaagaaaagaatcattaattctgaaattagactgaatgatcattttttaatatttttcagacaagactacttttgcttaaaaatctgttatgtaaacaaggaagtccattgacccaaaaagaactagcacaacttgctaggtgagtaatttggatttggtttatcttacagcttttatttattttttgtaaataattctttttttagttatttaaagtaatcttaagtatgaaatgagtaattcattgatcagaagactttctctcatcctctacctcctttgcctttttcttacctcttgttcttatatatatatgtggaatctaaatttcactggctatgtcctttgcaagacgtgatctaatgatgatagtatattctttttataaatttattaaaacctgtaagtggtattaaagtaatttaaacatttacaccttaggcaacatggtaaaaccccatctctacaaaaaataaaatgagtcaggaatggtggcacatacctgtagtcccagctacttgggaggttgatgtgggaggatcgcttcagcccgggaggtggaggttgagcaacagagtgagaccctgtctcaaaaaaaattttaaacatttcatattgcacactaacacagatatttttatataaacttgttcttggcatatgctgaatacttttcagctcttttaataattttaattatttgataattttaataattttaatttcagctatttgaataatcttaaactttatgaacagtgtgaagtagaaactgagtataggagatgcgctcatgaattttattccctgaaaaatgtcataaagtaatataaagtattcaatgagtatgtgagtattgaataattttaacaagaactctgagttcccagatacctatgacaaaagaacaaattacttggaagtctcttctactccagacctttctgtctatccccttatttaaaaaaatgtacattgattgtcccttatcccatcaagagagtgttctttgccaagataaacgctaattagagaagtaattgtgtttatgtgtcagttggccaccagtagtttgtagatgttacctttccaggtgacatgtttacaatttaatgaagcctctggagatagtatgccttaatctaaaggaatggttctaatgattaaaatttgaggcattactacatttgttttcagcaaatgggcctttctattcccttaaaatcaaaccctcataactatgggtttgctgacaaagggaaactagtttttactcttattatatggagattttaaatctgcagagatgaaaataatttgctgtttcagctgggtgcggtggctcatgcctgtaatctcactactttgggaggctgtggcgggtggatcacctgaggtcaggagttcgagaccagcctgaccaacatggcgaaacgccatctatactaaatacaaaaaaaaaattagccaggtgcggtggcgcatgcctataatcccagctacctgagaggctgaggtaggagaatcgctccaggaggtggagatcacagtgagctgagatcatgccattgcactccagcctgggcaacaagagcaaaactccatctcaaaaaaaagcgggaggggaaataatttgctgtttcttccttcccttcctcagaatgactgatggatactcaggaagtgacctaacagctttggcaaaagatgcagcactgggtcctatccgaggtaggtatacaagagcttaaaacatttagaactatttattataccaccttagaagtttaagaagtccaaaaaaatctaccaagagattttttttttcttttggagacagggtctcactctgttgcccaggctgtagtgcagtggcacaatcatagttcactgcagcctcgaaccccccaggctcaggtgattctcccacccagccttcccagtagctgggactacaggcatgcaccatcatgcccagataattattttattttatttcttgtagagacagggtttcaccatgttgcccaagctggtcttgaactcccgggctcaagtgagcagcctgccttggcctcccaaagtgctgggattacaggcatgagccaccatgcccagccttaaaaccattcttagctcacagatcatacaaaaacagtctatgagccagtagactgtgacccctgttctaggcaagaggtttcatttcttgatagtaagtaagcagcagaaaactcaaaaagaaaactttaaacaaaaaagaataatgtaaggaaaatgttcttatctgttttctggctcttttcagtattctgacatcatttgaaattaatgtgtctaaaggaaattctataagagaagttttcacttttttaattatatcttttgagggattgcagcaaaatatttattgctatgtttttattcaggttacttggttgattctgaaataccacgaccaattctttttaggttaggttaggataaactcacacagatattttcagctacatttccacagccagcatcggtagtggatggttgatgctctcaggtatgcactcagattattagctatgatgataaagtaatcataatagctccatccctttctctcattcaagaaagtacaattgaatgtagttgtacgagaaagatgttatcatagtgtctactgtaatttgcattaaaagcctacattatacaaacctttttgttttactagttaaaaattaccagtaacacctcccgtagtgaaatagggtgctgattaagaactgctactttgcaaaataaaaaatgtaatcttgagagtatattttgaaactctggatgaacaaattttcttgctgctggagcttaaatcttgttcagttagtggatttagaaacagtagctaatgcataaatgagttgtattttcttagaacgttttggctattctaaggtagacaaaatttgggtttaaaaaaagattcgcatccattaaagtacagaaaatggccgggtgcagtggctcacacctataatcccagcactttgggaggccaaggtgggaggatcgtgtgggcctaatagtttgagactagactgggcaacatagggagatcctgtctctacaaaaaaatataataaattaaccaggcccgttggcatgagcctgtaatcccagctactcgggagtctgaagtaggaggatcacttgagcctggaaggtgcaggcagcagtgagccatggtcatgccactcactgcactccagcctgggtgggtgacatagtgaggtgctgtcttaaaaagtaaataaataggccaggcacggtggctcacgcctgtaatcccagcactttgggaggccaagatgggtggatcatgaggtcaggagttcgagaccagcttggccaatatggtgaaaccgcatctctactgaaaatacaaaaattagccaggcgtggttgtgcgcacctgtaatcccagctactcaggaggctgaggcaggagtatcgcttgaacctgggaggtgaggttgcagtaagccgagcactgcagcctgggcaacagagcaagactctgtctcaaaaaaaaaaaaaaaaaaaaaaaaaaaaagtaaatacataaagtgcagagtaaaaacaaaaaaagactaatgcattttgtaaagaacaagttgcattcttttaagttccctttcaaatttgtgaactattgtttttgggcagtatgcaagaaattgaacactttccagttattccaaagaaggaatattctcttctcagcatttataaattgtatttgctctcaaagttaacatgtgtctcttttttttaatataatgatttgtactgaatagatacatgtagatcattgtacttggttttgcccttcaacaatttcaactgcaaaatgtatgtatttttaagtgcctgacttttatgttttacagaactaaaaccagaacaggtgaagaatatgtctgccagtgaggtatagtattttacaatgatattttctttgtcttctatattgtaagacatatataagacatacatatatgaatgtgtgtgtgtgtggtttttttttttttttttttttttttgagacagtctggcatgatatcggctcactgcaacctccacctcctggattcaagctattctcctgcctcagcctcccaagtagctacaggcatgtaccaccaagcccagctaatttttgtatttttagtagagagggcatttcaccatgttggccagtctggcctcagactcctgacctcaagtgatccacccaactcggcctcccaaagtgctgggattacaggcttgagccgctgcatctggctgttttgtttgtttgtttgtttgtttgtttgtttgagacggagtctcactctgtcgcccagactggagtgcagtggtgcgatctcagctcactgcaagctctgcctcccgggttcacgccattctcctgcctcagcctccctagtagctgggactacaggcgcccaccaccacgcctggctaattttttgtacttttagtagagacggggtttcaccgtgttagccaggatggtctctgtctcctgatctcgtgatctgcctgcctcagcctcccaaagtgctgggattacaggcgtgagccactgcgcccggcctttttttttttttttttttgagacacagggtcttgctctgttctcaggctggagtgcagtggtgcaatcgtggctgactgtagccttgacctcttggtctcaagcagtcctcttgtctcaaactttttagtagctgggactacaggcaagtgccacaacgccccactaattttttaattttctgtagagatggtgtctctccctgttgcccagggtggtctcagactcttggcctcaagtaatcctcctgcctcagtctctcagagtgcttgggactaattttttttaatggatttttctagttgattagaagctagaaaaaattaactttgcttcatttcaaaatatggaaacctatgaaatagtcaaaattttttttggtaatagacaaaacatatatacataaagtcattttctatcaaatcatattacataaataccaaacagaagaaaattacaggccgggtgcggtggctcacgcctgtaatcccagcactttgggaggccgaggtgggcagatcacttgaggtcaggagttcaagaccagcctggccaacatggtgaaaccctgtctctatcaaaaatacaaaaaaattaggccgggggcggtggctcacacctgtaatcccagcactttgggaggccgaggcgggcggatcacgaggtcaggagatcgagaccatgctggctaacatggtgaaaccctgtctccactaaaaaatacaaaaaaattaccggggcgtggtggcgggcacctgtagtcccagctacttgggaggctgaggcaggagaatggcgtgaacctgggaagtggagcttgcagtgagccgagatcgtgccactgcactccagcctgggcgacagagcaagactccatctcaaaaaaaaaaaaaaatagctgggcatggtggcacgtgcctgtggtcctggctacttgggaagctgaggcaggagaatcacttgaacttgggaggcagaggttgcagtgagccaagattgccccattgcactctagcctgggcgacagagtgagacccagtctcaaaaaaaaaaaaattacatgaaacttgtgggggtttatacaataaaaataacctataactatacgttaatcctttaataatgttctattttgtttttcaataacctttatttttttaattaatttcttttttttgagaaggactctggctctgtcacccaggctgcagtgcagtggcaccatcttggctcactgcagcctccacctcccaggttcaagcgattctcctgcctcagcctcctgcgtagctgagattacaggcatgggccaccacgcccagctaattttttttttttttgtatttttagtagagatggggtttcactatgttggccaggtgggtctcgaactcctgacctcaggcgatcgccagcctcggcctccctaagtgcaaggattacaggcgtgagccaccatgcctggccaatttattaccgtttcttaatatggaagacctccttatgagatgctgaagcatttcatttgaaaaaagttgcatgtaaaatataaaattgggtatgcagaatggtcataactctgtgagcaaaattttgaaatcaggcttgaattacagtcagccttttctatccgtggattctgcattcatggattcaaccaactgcagatcaaaaatacttgggggaaaaaagcatctgtgttgaacatgtacagacttttattcttgttattattccctaaacaatatagtataaaaactatttacattgcatttacattgtattaggtgttataagtaatctagagatgatttaaagtatacaggaggattgtgtaggttgtatgcaaatactgcaccattttacataagggactttaagcgtttgcggattttgctatctatgggggaaccaatttccgagagatactgagggacagctgtatatttgtaacttattttttatttccctaattgcagcagctgttgaggggacagtgaactgttaacacagataacaagtgtattcaagtacattttggagtttgtttgtttttttttttcaggcttttattcgcctgtcggatgaggcaccatacttgaatttttttttttaagaaagcttttagttttctttctttctttttttttttttgtgagatggagtcttgctctgtttctaggctggagtggagtgcagtggtgtgatctcagctcactgcaacctccgcctactgggttcaagtgattctcctgcctcagcctcccgagtagctgggactacaggtgcacgccaccacgcccagctaattttttttttttttttttttttttgtatttgtagtagagacagagtttcaccatgttggccaggatggtctcgatctcctgaccttgggatccgcccaccttggcctcccaaagtgctagggattacaggcatgagccaccacgcccggctgaaagcttttagttttctaacttatttaatttaatttaatttaatttatttttattttattttttgggacagtgtctcacttggttgcccaggctggagtgcagtggtacaatcatggctcactgcaccctctagctcctgggctcaggcaatcctcctgcctcagccttttgagttgctgggactacgggcatgtaccaccacactcagctaaatttttaattttttgtagagatggggtctcactatgttgcctaggctggtctcagattcctcaagcattcctcccacttgcacctcccaaaatgctgggattacaggtgtgacaccgtgccagacttgaaatttttaatcccacacctaaaaatataattttatccaccattttttaaaagtcataacattatttattaaaaatttagatggtaaaactaaaaattaaagcttaataaaactactgagtgatttacaaggaagaatattactggtcccttttgtgagcatcccattaattatatatattcaggttatattgttacaatatttggttctactgtatacttttttttttgagactgagtttcgctgttgttgcccaggctggagtgcaatggtgcaatctcggctcactgcaacctccgcctcctgggttcaagtgattctcctgcctcagcctcctgagtagctgggattacaggcatgcgccactatgcctggctaattttgtgtttttgtagagacggggtttcactatgttggtcaggctgatctggaactcccaacctcaggagatccgcccacctcggcctcccaaagtgctgggattgcaggtgtgagccaccatgcctggctctactatatactttcattcagttgtttctttttaatctagtggttttggtattaataatttgataatgacctttagctgttattgcttacttatgagttaatatttataaagcacttaaagtagctggcacgtagtaaacactatgtaaagatccattaaataactttaaaaaatataaaactgatagtggcattttattatagagattaaggtaatccattctctcatttccatttatgggatgagacgtaaacacaagtagtttgctctctaaaactgtatactagaattttatatacccattatttgatgcaactttaataccaaagtgtattgtcagttaccggtgaatatatataaatttaggtaaggaaaacccaacttggtcgcacacagtggctcacgcctgtaatcctaccactttgggaggccgaggcagttggatcacctgaggtcttgagttcgagaccagcctggccaacgtggcgaaaccccgtctccactaaaaatacaaaaattagccgggcgtggtggcacatgcctgtaatcccagctgctcgggaggctgaggaaggagaattgcttgaacctggggaggtggaggttgcagtgagctgagatcgtaccactgcactccagtctgtgcgacaggagcgagactccatctccaaaaaaaaaaaaaagaaaaacccaacttatcttttacagtttataatagtagaagttcaaataattggtttggaatttctgtatttttaaggttagtactaaaattgttggttataaattggggtacaatatactttgttttttaagtaccttgtgtatctaatttaactttaagtcctttattattttggtttgataagacaacttttctacttatttccccccttaactgaaccagctaccatctgcctttttcctgttgtatacattagtctcttacgttaaaatatcatataagtttcatatatatacacatatcaaactatagacttaaagtacaattacatcaacatcttttaaaaccttaatttctggccaggcgtggttgttcatgcctataatcccagcactttgggaggctcaggccattggatcccttgagctcaggaattcgagaccagcctggataacatggtgaaatcctcatctctacaaaaattacaaaaagttagctgggcgtggtggcgcacacctatagtcctagctacttgggaggatctcttaagcctgggaggcagaggttgcagtgagccgagatcatgccactgcactccagcctgggtaacagtgagaccctgtctcaaaacaaaaatattaatttctataacaaataaattttatttagtaatatcatgtttaatacccatgttacattcattattcttctacactttggcctttaggaagaggcagtgtgtgtgttacagttaaataggaaacaagtagggttcatatagtgcttatggggttttctttggtggggggttgctgggtttttggggtttttttttttgagacagggtatcactctgtctcccaggctgaaatacattggcatgctcatggctcactgcagcctcaacctcccagactcaagtgatcctcccacctcagcttccctagtagctgagactacaggcgtgcgccaccatgcctagctaaattttgtacattttgtagagatgaggctttgccatgttgcccaggctggtctctaactcctgggctcaagtgatccacttgcttcagcctcccaaagttctgggattaacaggtgcgagccactgcagccagcctatattttaactatatgtttttttctttttggctaaaatttttcagattagtttacaagttacaagtgtaggtgatatctcatggagatatcaaagatgatatgaagttagattgggtttttaagagtagtttttaaaatacggataaataccagttgttggagttttgtttaaagttctttaacttcttatttttgggccaaaatacaggtatacgctagaaatgatttttaacacaggtcatttatgccaaactgcattttgccttaatttttttttttttttttttttttgagagggagtctcactcattgcccaagctggagtgcaatggcacgatctcggctcacttacaacctccacctcccaggttcaagcgattctcctgcctcagcctcctgagtagctgggattacaggcacctgcctggctaatttttgtatttttagtggagacggggtttcaccatgttggccaggctggtctcgaactgctgacctcaggtgatccacccgccttggcctcccaaagtgcggggattacaggtgtgagccaccgtgcttggccaaaatttttattaatttttctattgcctggactctgtgaacctatccattttgccttttaaaaatacttaggtgtaaatatagatattcattaactcagcattgttttaatctatatttccaaaggcaatttaaaagatcagaaaataagaccaaattaatataaaaatgcatactttaggctgggcaaagtggctcacgtctgtaatcccagcactttgggaggccaaggtgggcggatcacctgaggttaggagttcaggaccaacctggccatcatggcgaaaccctgtctctactaaaaatacaaaaattagctgggcatggaggcatgtgcctgtaatcccagctactcgggaggctgagacagaagaattgcttgaaccttggagggggaggttgcatatctgagtggtgaaattgtgattctttttttctctttgtctgtatttttgaacttttctataaatgattgtgttttgtttttatattggaaaaatattatgctttcaaatgttaatacctatgaaactaaacacaagtaataaatatattagtatagcatttattaaggtttcttgtgtagcagatcaacatagaaaatatatttaaatggctgacataattttctaagaatacatacacgtatattttttataacattaagaaacagcagcatcattactttaatccatcatttcgttaaccaccatatacctgttgatcatttgtattgtcatgtgctttttaaaaatctagatgagaaatattcgattatctgacttcactgaatccttgaaaaaaataaaacgcagcgtcagccctcaaactttagaagcgtacatacgttggaacaaggactttggagataccactgtttaaggaaatacctttgtaaacctgcagaacattttacttaaaagaggaaacacaagatcttcaatgaacgtcatcggctacagaaacagcctaagtttacaggactttttagagtcttacatatttgtgcaccaaacttgaagatgaaccagaaaacagacttaaacaaaatatacaatgcaaatgtaattttttgttgtttaaggccttgccttgatggtcacagttatcccaatggacactaagttagagcacaacaaaacctgattctggtcttctttaccaatataatcataatgtaaataataatttgtatattgtgttgcagatgaaagtattccaggaacagtgaatggtagaagacacaagaacatttgtttgtttgtcttctgatgttttttcttaaaatagtaatttctcctacttttcttttctactgttgtcttaactacaggtgattggaatgccaaacactcttaagtttattttcttttttcgttttataaattcagtgtgccaaatgaaacttttttcctaagtaactgtaataggaaaaagtttattttgagagtttcttcttcataaatctacagacattaaacaattgttgtgttctttttaccttttatttttctattaccttgctaccaaacagtttagatagcaatataatagcaaaaaagcaaatatggtaaaatagagaaggtttgaaggtttgagttactctgtcatataacatgtagatcagtcttcatgtgacctgcagtatttttttttctaatgtatttgtcagaaatctgttgtagactgttaacttcttcctgatggaatttattttctgcaagaattattctgatatttaagagagccaattttaactgctgtgaaaatgtttccagtgcaagagaagggaaatactaggaactaagacatttctaatttattgcttattactttcttaattttacaggataattataagcaagtggaactaccatcttttattcttaataattattaatcccttcaatgaaactttaaaaaaactgaatttttatacatggcatacatttttctagttccttctgcttgctttattaactcaaaagttctagttctagtctgttgatctgccttttgttctcccaaaatgtacagtaattccatttgtttgtataaatatgcctggattttcattataaaaatgtcattgtagggagtagagactcatatcatggccttttaaatattgtaataaaggcaaatagatatttgcccttagtttactggttaaaagtttgtttacagaacttttctctggtgcttaaatgatgctatgtaaaatgtcatgagtggaaagaatatttgtagtagtaacaagaatttttcatttaggaaagatttcttaggttttgaaagaatacattaaaataaaaaacttgcccctactaggtaagaactttataatgaagacatacattcttcttaattttactcttgctcttgttaaagatttgtttgaatatagaagatgcatgatttctgggtttttttttttttttgagacagagtttcgctcttgttgcccaggctggagtgcaatggcgcaatctcgactcaccacaacctccgcctcccaggttcaagcaattctcctgcctcagcctcccgagtagctgggattacaggcatgcgccactaccccagctaattttgtatttttagtagagatggggtttctccatgttggtcaggctggtcttgaactcctgacctcaggtgatccgcctgcctcggcctcccaaagtgctgggattacaggcataagccactgcgcccagccagaagatgcatgatttcttaggatcatatgctgtttgtagccataaggtaaatcatgtctcttccaatcatgactttggaactccctgaataataaaaatgagagttgagataaataggggaaaaaaaatttttttcaagccagagctatgcatatgttaggtgatgggtagtatccctttaaggtctcaaacattacaacatcaattatgaaatactgataacgaaaggtagtaatgaaatatatatgatgaaaagaattgagaagttctaaattaagacatttcagttaagctcataaaatttcattgttttcatttaaaagattaacgttattgatacttggataactggctaatcatattaaaggactatgtggttccagctcaacttttaatatattgtctcctttaaaactatcatggttataattctattgggaaagacttttagataacaaagatttcaaatgttaaaagagataaaagtcaggttaatactatcttaaacactgagtcagaaaatcattactgtatagaagttgctttcctgatcaagtctgaacttcagctagtgctagagaactattttctatgacttaactctaaccaagttttattttaagctgtttctttgatagaagggccatgaaaatagagtaatgatatagtaggagataagggattggtttggtctttttcaataaagatagaagttgctgaagttttctgaattaataatgacttagattgtgaccttttagattcggtgttgagctctgtgttgtattacttcctaaaagataatgcttaaacattaagcattagtgtgctcttcatgttaatatggcagagttttgtaaactaaattaaaacttactgatatattggactttgagccaagggaaagaatgagtactatctttccagatatcttaagggtaaaagcttattctaagacagtctgtccattgagaatattagatttctgacttgcaaatatgtttgtactccagaagaattagaggaaaagcagatactagaattctaatttaattacatatacagccgtctttgtttatagtgtagaattctttatattttgtacaaaaactaattcttttggtaaaatgaaccatttacagttcggttttggactctgagtcaaaggattttcctttaaatgcttgtctcaattttagtctggtcttttgtacttttcttcagaagaaatgaattaaagggtacagttgcataaagtgggtttttatcctaatgtattggaaataaatgataaacttta

SEQ ID NO: 725 - DNA, 94027 bp, Homo sapiens; identical to SEQ ID NO: 724

SEQ ID NO: 726 - DNA, 58272 bp, Homo sapiens
gttctgggaaaactcgagcacccagaacggcttccggcgggagctgtgcagctccttatcatggtgagttggctgttggggtgagggtttcggctgtagctgattcggtttatcttatttggtcccgaagcgaccttgaaatccctcagccacccagaggaggggtcattggagttgaagtcgggccccttggcaggagcggctgtctcccaaaatgttccccttcagagttctggtccctttcggtccctcacctgttccgcaggcgctcacgatctaggccccgctgcaggcagagctttcagctcctggcgagtttctgacttccctctgccgagatttctttaaggtaataaaagtttttgccagcgtcaacaactaggccaccaacaaaagatctgaaaacaagtccacagcaacaactgtaatagtgattcttagagcagtggcgataacgccagcggaaaaaaaaaaaaaaggttagtaatagggttttagggcagacgtctcactctgcaacttggctttactaaatattaagtagcctgattacggcagcaaatttcataagcgcagtaactacagaaagtcaaggtgttggtaggacattttattgctgctttatttctgggtttgtagaaactaatggaagacccagtagacgttatggttgttgggatatggtgttttctctcaaatttgttagaattagtcattctttgcctttagagctcaaatatatagctctgaactttaaagataagcagttggttgggatttgaagtgtccaagtggcgtgtgccttttgaaaatgcatttattagaaaaatttatggagtacttattgatagcctacgtatgagaaagagaccacatttctgtgcctaagcttttgtcactgtactaagttttttacttaagtggatatggtcgggaaaatgcctcattcacacactttatgttttgtaaattttctgtaatccttttgcacacagaaaatgggtaaaagtttacactttttggctaatgatcaaatagccttcagttacgctcttcttcaaaacattcaccattgtgaagcctgtagccagagttatatttctaaaatttgaccacatcactcccttactcaaattttctccttttttttttttctgtagcactcaagataaagtcctgtttagcatggcatacaaagccactcattatcaagcttcttacttttacagcctctttttttgttgttgttttcgagacggagttccactcttgttgcccaggctggagtgcaatggcgcgatcgcggctcaccacaacttccgcctcccgggttcaagcgattctcctgcctcaccttcccgagcagctgggattacaggaatgcgccaccacgcctggctaattttgtatttttagtagagacggggtttctccatgttggtcaggctgatcgcgaactcctgacctcaggtgatcctcccgcctctgcctcccaaagtgctgggattacaggcgtgagccaccgtgccaggccacaaactctttttttttttttttttttaatgcatacatgtatgcaacatccgtatttcagccacagtgaatagcttgcaaatcatgctgtattaattgagcctttgtacctaatttgcatatgctcttccatccccagaattgttctctgttctctatcggctgtccttatcagaataacccttatatatccttaattatttttcatgaacctttccctcatgttccagtatcctcttagttgcttctcctttgtgctctggtggtaccttgtgcttttatatgcacaaacacacacacacacacaccagttttgttacataaagctgcacaaaacgaatacatacaatagaaacttaacttgcctataatactgatgatttgaagggagttgaagataaagggataagagacttaaaattcagaggtctttcagattatacaccttcattaactcacagccctaatttaagaaagtaaaacttgaatctcttgtgttttttaccagtaacatctgtaatccttacagacgatgttaaagttgtgtacttatttgtctttctcactttctagactgtaagctcattgagagcaggacctatgtatttcaccctaattcccagagctttgtagcgtgcctggcccagaggaagttttcaataaacatctgttttataagacactgaaaacttatggcactatatctttatgcttgaaacattagtattagtcatgcagggaaacagtatttaaggtttattttaaaggatattgagaaaaggttttgcgtttattaagaacatgctatgtgaaaacagtactttcttagaaaatataaagaaaaatacaaataaaacgtctgttttataaagcactgaaaacctatggcactatatctttatgcttgaaacatcagtattagtcatgcagggaaacagtatttaaggtttattttttaaaataaatattttaaaataaaatattgagaaaaaggttttgtgtttattaacatgctgtgtgaaaacagtgccttcttagaaaatataaataatataaatatataatattaaaaatataagtatataaaaacaaaatataaaggaaaatagcccttgtcattagtgaagttactaaaattacaaagcaatgtaacaagttgaaggctttactttggttaatgcaaaataagtggcataaaaaacactatagtttggaatgatctaggaagacttcatttaagaagtgaaacatgaaactaagtactttgtgccccactctaatactcttaatctaatacttgtttgtcattatatgaataagagcttgggttagacagatctggccttttcacgcaagagtggtcatgagacaaaagagtagaccagtttaactgaagttgagggtttctatctggagtaagagataagactggaaagaaacaggctaagtcattgaaaacctggaaattcaggttgtaaaatttgtagtttattctgatagcaatggcgagccaatataattttgggaagagtgatatgacattaggatttttgttttattttcattgtcaggatggcatcagaagtggctttctgcctcttagaaaccttgttgattctcttaacctgaaacttaaagttggctagggttaaacagaagatgtccaaaataacagtattaaggagaattttttaaatctttggaaccaaaataactcacacataattctttaagaaaagaatatatatacatatgtacatacacatatatataatatttatacatatgtacatttatttatgtatttatttatttatttcgagatggggtctcgctctgttgcccaggcttgagtaaagtgtgaacctggctcactgcttgacttcccgggctcatgcgatccttccaccttggtgtcctgagtagctgggactacaggcatgtaccactatgcctggctaatttttttcttttcaatttttttgtagagacagggtctcagtatatttcctaggctggtcttgaactcctgggctcaactgatcctcctgactcagtcacccaaagtggtggaattacaggcatgagccaccatggccagccaagaaaaagatatatttattggctgggtgcggtggctcacgcctgtaatcccagcactttgggaggccaaggcgggcggatcacgaggtcaggagatcaagaccatcctggctaacacggtgaaaccccgtctctactaaaggtaaaaaaaaattagccgggcgtggtggtgggtacctgtagtcccagctactccttcaccgcagaatggggctgcgacagagtgaatatcctgtttgccgtgtagcctatatttaaaatcagactgtcctcctcaaaagcagctggaactgaggttcaagagatggatgtgactgtgtatagggagaggcataccatttttatttttaaagtatcaagagaaatcatgatttcacattaacaatacaaagttgcaaaagcaaatgtgaataatgagcaggtactgatttggccagctttataaatgtgtaacttttaaaactgggttattcatctttttaaaaatagtttgtggaagctcattgtgtatagagaaaattggcctattgtctgttgtgaattatagttttttttcagtttgaccttcttaaagtttttttcccccttaagggtattacattcgcccatgaaattatatagtaaaatcaatcaatttttttcctttagagcttcttgggttttatgccctattaagaaaggcttcccccaactcccagattataaaataatacatctagactttcttcagtcaagtactctataaatctgtattttatttttaaaaataacaacagagtaaggagtaacggtaagggtgaaacattaccttgatcaaaataccatttattgactggcttatattttctcccagtgatattggatactgcttttctcataagttaatttctcatatgtgtttgaactctctgttctgctaaggctttcccatgtgatttcctaaacttgggtggttaatcccctctagttgccacttggtctcctctctcattggtgagccctatctttactatccccaaactaactatacactagcaggggccagggagactagccaggatgtcagatactttgactgaatgcctaagagagaatctcaggggttttactataatagttgcctgaacttactttctttttgagacagagtctcactctgtcaccgaggccagagtgcagtggcacaatcttgactcactgcaaactccacctcccaggctcaagagattctcacgcctcagcctcctgagtagctggtattacaggtgtgcaccaccacacccagttcatttctatatttttagtagagacagggttttgccatgttggccaggctggtctcaaactcctggcctcaagttatccctctgcctcggcctcccaaagtgctggcattacaggcatgagccccaagcacaaccacatatatagctttaattaggtgaattttcagtagaaatttccagtagagctatttggcaaactatttctttttcagttcaagttgccttatccatttaaaaataaagagtgtggtctggagctaaaaagcctgggtttgaatttctgctcagccatttactagctctgtgactttggatgacttactaaaagttgtctccaccacataggtttattgtgaatattaaatccataaatacacataaagtgtctagaataagtgcttgatgtatattgagtacttaataaatattggttatttatatcataggaaccactatatcatatcataggaactctgaagatgattaaatatctaaatgctgatttgtatatgtttgtttgaaaggggacaattcatctctttcgaaaaccacaaagatccttttttggcaagttgttacgggaatttagacttgtagcagctgaccgaagggtaagttattccttaaccccaattttaattattgcacaaacaacattataacattgaagaaagataatttttaaggccaatagaaatcactcctgatcctgccacactgttttcatttttctatgttggaaaagtatttttttagtgtaaaattgcagttgtttggtgttaagttgttttactttggtaggaagcttctgttaaagttttgattctaattctgaagtgttttaaagaaaaatggttttgtggttgctttttgttattaagttttcaaaaaattaaatggatccagtctaaagccatgttttctcttttatttatttttttttttttgagatgaagttacactcttgttgcctaagctggagtgcaatggcatgatcttggctcaccgcaacctctgcctcccgggttcaagcgattctcctgcctcagcctcccaagtagctgggattacaggcatgggccaccacgcccggctaattttttgtatttttagtagagatggggtttcaccatgttggtcaggctgatctcgaactcccgacctcaggtgatccgcccacctcggcctcccaaagtgctgggattacaggcgtgaaccaccgtgcctggcccatgttttctcatttttaatgtagggcaagaaaaatatgttttgagactgtaaataaaaagatgtaattgccatccttttaggccaccaatgtaaaccttctagttactgtgtttcatgcttctcattgttgtctaaatgataaactctctgagggaagtgactgtctctattttgctcacctttttatagaagtacaatataaacattcagtaaatatttgatgacttttaagtaaagccagcttcaatgaaacaataataagcagtaccaatgggcactccaattgaaactctgccatattttcactatttttcaactccgttatcctcatttgcttccttatccaacttagattctatgctccatcattatcatttccctcctttttgttcttttttttttgagatggaatcttgctaaattatccaggctggtcttgaactcctgggctcaagggatcctccttcctcagcctcttgagtagctgggattacaggggtacaccaccactcccagctagtatcattttcttttatatgttctcaactcttttgtgctccccttccctctgtcttaattcctggaaaatccctaaccttcattaagttcactttctttctactctacttgcatctaagcaactgaatgtaacctgagagaaacaaaaccatgcgactggtctcactttgaattcatgatcagacagaccattagtgctgcctattaagtgctgcctattagtgctctttcattttatatttcctttgttcattcaattttccaatttcctagatggctgtttcatacgatgttctttcgtttctatcctcaagcttctaataccttcttcatcctcaccctaacctgatgatcttgcttcctgtttcaccaagggaaaagaagtaatcagaagaaaacttctacatcctatcattagcacatcagccatcactccgccttccctcctatttctctggacaagctttcagttcttctctataaaggcaatcctttcacttgttgcctactgaaagatgatgtccctataattgttctgtttcttacatcattgtttttcttgcatcatgcatcattctcctctttcttgcatcgtaattacatgttataagttccactctcagggctgcttcatttctcagcttccttttgtagcaaacctacttgaaagaattatcagtacattgtgttcaccttctcttctcctcatctttattaaacacataccagttaggtacttgtgcccactaattcacataaacagcttttacaaggtaaccaaaaatctctgtgttgccaaaatgaagatttttccttatttctcaccttacttggttgatgttgaacagccaaagtcagtacttttttttttttttttgagacagagtctcgctctgtcgcccaggctggagtgcagtggcacaatctcatcttactgcaacctctgcttccctggttcaagcgattctcctgcctcagcctcccaagtagctggaaatagaggtgcctgccaccacacctggttgattttttgttttagtagagacggggtttcaccatgttggctaggctgatcttgaactcctgacctccacccaccttggcctcccaaagtgctgggattgcaggagtgagccattgcacctggacaagattactaacttttaggaacatcatcatgccctttattcagattcaccagttgcttacatttggccccatttgcttcatcgttgtctctataatatgtacttatagagacaaaacgatatgcatatgtatgtgtatttttctcaactatttgagaatttctatgtcagaatttattttctcttgaacaactctccttctggaactattcttttaaacttgtatactgtaataacttagccgatgacaattttggtagatgtagaaagtgtgacacagactttttgaaggaagttatgtttattcctttgaatatcagagtataaattgtagcaacttgaacagaccccgtgaaatttatcacttctgtacacataagagtgatttttattttcacagtcctggaagatactgctctttggtgtaataaacttgatatgtactggcttcctgcttatgtggtgcagttctactaatagtataggtatgtcacctttgtatttttatggagttgttatttttacttttatttttctcattggaaataaaggtatatcttacatagaatatattattctgaaatgtatataactcaaatgatttaaataagggactatatttaaaacttccctgtaaactgtaaacttttgttcatttgttaggattgtaatttttttttaagtttttttccttttaaaatatattttaaaacagaaatggggtttcgccatgttgcccaggctggtctcaaaatcctgagctcaaacgatctacccaccttggcctcccagagtgctgggattacaggcgtaagccacaatgcctggccattttcattttaaataagctgttattttttgaaaaatcattaaatctatctggagattttttttttttttttttttttttgagacggagtctcactctgttgccaggctgtagtgcagtggtgtgatcttggcccactgcatcctccacctccctggttcaagcgattctcctgcctcagcctcccaagtagctgggattacaggcacgtaccaccacgcctggctaatttgtgtagttttggtagagatggggtttcaccatgttggccaggatggtctcgatctcctgaccttatgatccacccgcctcagcctcccaaagtgctgggattacaggcgtgagccaccgtgcctggctggagatttgtttttaatataatagattaaaactttaatttatgcagtttgtaagttagattttgaggtttgttggcttttccttaaaaagggaattctgtaatttttttcttatatctttttatgttttttattgcattgttcttttgttcagttattcaaacaatacatttgaaatagcgctgagattacagaagcaggcagaaaaatggtaacagggcttttgaacattcattgcttcatttttcctaatggagaaatcaggttgggaagtaagcttttctaccaacgaactttggctacatatatttatcagatttactagataactgccaatatatgaggttggcccgtgactcaaaagtttttttgataatggatacccctggtagaaataattttggtaacttgctgtatttttttagaggggtcagtaatacttttaatcatttttttgttgttttgcagctttaactgcctatacttacctgaccatttttgatctttttaggtaagtttttaggaaatcttaatgttttggagctaataaggaacttggtagaaatgtggtatagccatacaattcagcaataaaaacagcaactactgatatcttacaagaaaacaataaaaacattatgctttgaagacagtcataaaggaccacatattttatgatttcatttatatgaaatgtccaaaacaggcaaatctatggagagaaaaagtagattatgaagaagttttctttgcttaaaggaaagtaatctactaaataagtaaaattatcaacatagaacaaacacacaaacaacaataattagagacataacagtaattagagagcaggtggggcggctcatgcctgcaattccagcactttgggaggccgaggcgggtggatcacttgaggtcaggagtttacgaccagcctggccaacatggtgaaaccccgtctctactaaaaatacaaatagccaggcatggtggtgtatgcctgtagtcccagctacttgggagggtgaggcataagacttgcttggacccaggaggcggaggttgcagtgagccgagattgtgccaccacactccagcctgggcaacgagcgaaactcagtctcaaaaaacaaaatatttataaatttgattatattaaagttaaaaactctaggtagcaaatgtcaccataaacagagaataacctgagaagatatttgtaattcatacctcagagggctaattttgctaacatttgaagggccctacaatttaagacaaagaccaagaaaaagaaaaggaagaaaaaaattataattcatacagagagtttacagaaaaggaaatataaatgacacttatgaaaagttgcttatcttcactaacagtaagagaaatgcaaattaaaattactctgagatgctgttttgcctgtcacgttgggaaagcttaagaaatttgagtatacctgtgtcgctgagtgtattagggaaacgtgctcttttgtttttttaaaaatggctttatttggccaggcttagtggctcacgcctgtaatcccagcactttgggaagctgaggagggtggatcacaaagtcaggagttcgagaccagcctggccaatatggtgaaaccccgtctctactaaaaataacaaaaattagccaggcatggtggtgggcatctgtagtcccagctactcgggaggctgaggcaggacaattgcttgaacctgggaggcagaggttgcagtgagctgagatcgcagcactgcactccagcctgggcgacagagtgagattccatctcaaaaaaaaaaaaggctttattgagatactataattcatatgccttaaaatgacttttagtctcttcatacatagagttgtgcattcatcaccataattaactttacaatattttctttcttttttttttctttgagacggaatcttactctgtcacccaggctggagagcagtggcatgatctcagctcactgcaaccttcgcctcccagtttcaagctattctcttgcctcagcctcccaagtagctgggaatacagacatgcaccaccacgcctggcaaatttttgtacttttagtggagacggggtgtcgccatgttggccaggctggtctcgaactcctgacctcaagtgatctgcccaccttggcctcccaaagtgttgggattacaggtgtgagccaccacgcctgacctacaatattttccttgtctcaaaaagagaccactcgccttagctattactctccagtcattccgttctcccactcattccattctcttctccagccctaggcaaccactgatcagttttttctcgcgatagatttacctactctggacatgtcatataagtggaatcatacaatatacagtcctttatgactgtcttcttagcacaatgcttttctgttttgttgtagcatatatcaatagttactctttcttttttttttgagttagggtcttactctgtcacctaggctggagtgcagtggcgtgatcttggctcaagtgattcttttgcctcagcctcccaagtagctgggattacaggcatgtaccaccaggcacggctaattttttgtatttttattagagacggggtttcaccattttggctgggctggtctcaaactcctgacctcaagtggtccacccacctcggcctaccaaagtgctgggataacaggcgtgagctaccgtgcctgagcaataggtatgttttcttctaagagttttatagtttttgctcttacaattaggtctttgattttttttgttgttgtttttgttttttttagatggagtctcactctgtcaccccgggtggaatgcattggcatgatcttggctcactgcagcctcagcctcccaaagtgctgggattacaggcatgagccaccatgcccaattagtttttgtatttttagtagagacagggttttcccatattgaacaggctggtctcgaactcccaaactcaagtcatctgcctgcctccgcctcccaaagtgctaagattatgggcgtgagccactgtgccctttgatccattttgagttaatttttttttttttttttttttgagatggagtctcgctctgtcgcccaggctggagtgcagtggcgcgatcttggctcactgcaatctccgcctcccaggttcatgccattctcctgcctcagcctcctgagtagctgggactacaggcacccgccaccacgcttggctaatttttggtatttttagtagagacagggtttcaccgtgttagccaggatggtctcaatctcctgaccttgtgatccgcccgcctcggcttcccaaagtgctgggattacagacgtgagccaccgcacccggccaagttatttttttttaatggtgtgagattgggggttcagattcattcttttgcatgtggataaccagttgtcctatcatcatttgttgaaaagactactttccccattgaattgccttggtacccttgtcaaaaaccagttcacgggccaagtgtggtggctgatgcctgtaatcccagcactttgggaggccaaggcaggtggaccacctgaggtcaagagtttgagaccagcctgactaatatgacaaaactccatctctactaaaatacaaaaatgagccgggcatggtgccatacacctgtagtcccagctactcaggaggctgaggcaggagaatcgcttgaacctggtgggacagagattgcagtaagtgagccggaatcgcaccattgcactccagcctggacaacagagtgagactccatctcaaaaaacaaaacaacaacaacaaacaccagttcactgtaactgtgaatgtttatttttggattctcaggtctgtcccattgatctgtatgtctgtcctttatgccagtaccatcagtcttgattactgcagctctgtagtaagttttgaaattggaaagtgtggatattccagctttgttctttttcaagattgttttggctaaacaggcattcttttttctcaggctggagtgcagtgggttgacctcggctcactgcagcctcagcctttaccgcctgagctcaaatgatccagctcagcctcctgagtgagtggtaccacaggcttgtgccaccacacctgcctaattttttgatattttgtagaaatgaggtcttcttatgttgcccaggcaagtcacaaatttctgggctcaagtgatcctcctgcctttccctcccaaagcgttgggattacaagcatgaactacctgtcctggctggaaacaggcacttttatacattgctggtgggaatataaattggtgcagcatctcgagggcaatttggcaatatcaattaaatttataaatgcccataaccttaaacgtagcagttccttttctagtaatttatgctgcagatatattcctgtggttaaaaatgagttgcatatgagattattcagtacaaaagattggaaacaatcagtatatgaatgatgaaataatggggcatgtataccccatattttggtatgtatatatcatagaattctcaaacttgaccatacagcagaattacttggaaggtcttgttaaaatacatattgcttcatttccagagttactgattcaggaggcctagggtaggacccaagaatttgcatttctagcaacagatgaaaccgatcctgctgggtatagggaacccacttatctgtgtaattaaatattatgtagccttagacaataaaatcaaagcattttatggttttgaggtcctaatgaggggaaaaagcaagatacacaacagtgtatatagtatgctgcaatttgtattaaaaagggggaaagaataagaatacgtacatgtatacacatccacacactacactcattcatttgcttgtatttgcgtaaatatacataggaaagataaacaaactgataataataggtgtctttgaagaggaagactctggcagggagacaagtttaaaatcttcccactatatatctgttgtaaattttgaattttatttatataaataaaacgccaatttaaaaataaataaaaagcagtttaaatatgttaccgccaagagtggtgtctcatgcctgtaatcctagtgctttgggaggctgaggcaggaggacatttgagcccaggagtttgaggctgcagagagctatgatcttagcactgtactccagcctcagtgacagagagataccctatagaccaggcacagtggctcatgcctgtaatcccagcactttgagaagccaaggtgaaaggactgcttgagcccaggagttcaagaccagcctgggcaatacagtgaaacctcttctctacaaaaaattttaaaaattagccaagtttggtggtacacacctgtaatcccagctactcactgaatagtaggcagtaggatcacttgagcccaaaaggtcaaggctgcagtgagctatgattgcaccactgtaatccagtcttgggtcttggtgacacactgataccctgtctcaaaaaaaaaaaaaaaggattttatttatttatttttgagacagggcctcatcctgtcacccaagctagagtacagtggcacgatcttggctcactgcatgcagcctccacctcccggtctcaagcgattctcctgtcttagccgcccgagtagctgggattacaggcacccaccaccatgcccggctaatttttgtatttttagtggagatggggtttcaccatgttggccaggctggtcttgaactcctgacctcaggtggacctcccgcctcagcctgccaaagtgctgggattacaggcgtgaaccaccgcgctcagcccatgcatgtactttaaaaagttactttggggaatagttactaatgttaccaaccatatttgataacaaactaacggtaataaaaatagtcaaattttaaaactaaagtaataatgtttcccttatgtcttaaggttcataaggaaaatcttttcatttaatttgaggaagtttctttctttagaggctcacaatctgccatatgagttagctatcgctacataacgtttcagatgaaaggtgtgatttagattcatttagagcttcactaatatccaaacacagaagaaagtggttatctgattttagaattttaagtgttaataaatgctactgttttacaaagaggtgtagaaatatattttattggagaacattaataccaaagtggtgttactaaactatggaaattaaaatgatttacacatataaataaaatcaaacatattgaatgatttgttaataaatgggtactgattttttagatttatgtagtaatgggaagtaaattcgatcagtgtaccatatttcatcaaatattagatgccaacagttttaagacaaatacttattttatgtgtccccaagaaaaatgctgctaattcaactgtgatgtactgtaagttgtaagactaaccctgatttgaggattattaagatgtgaaaaaacatgtacttcttaaaattgatgaattatagaaaaattttcagagatttttatccatttttaagggtaaaattttcaaaagttaatatttagacactgaatttttcagatttcttattattaacaaatcttatctatagagtattatttacaaagaaaaattttacaattaataattgaagctttggccgggcgaggtggctcacgcctgtaatcccagcactttgggagtccgaggctggcagattccctgagctcaggagttcgaaaccaccctgggcaacatggtaaaaacccatctctactaaaataccaaaaaatgaggtgggcatggtggcgcacttttgtaatcccagctgcttggaaagctgaggtgggagaatcgcttgagcctgggaggtggaggttgcagtgagccaggattgtgccactgcactccaacctgggcgacagagtgagactccgtctcaaaaaaaaaaccataaataataaattaatgattgaagcttcaattgtatatttcgtttttcttttctttttttttttttttttttgagacagggtattactctgtcacccaggctgagtacagtgacatagtcatggctcactgcagctgcaatctcctgggcttaggcgatcctcctaccctagcctctggggtagctgggactacaggtgttcaccaccacacctggctaatttttgtgtatttttgtggtgatggggtctcgacatgttgcctaggctggtcttgtactcttgggctctcaagtgatccacctgccctgacctcccaaagtgctaggtttacaggcatgagccaccacgcccagcctaattgtatatttctgactgcagaaactcatttggctgcctttatccgatgcaatttcaaaaatcattcatccattcaaaaccaacctagattatttgctgaacttcaatgtaaataccatattcttgctgcttacatgaattggaagtgagattagcacactatatgaaccctgtcatgatgagtgtgaagtactctcaaggagttagccagggctcttttgattgcagccatcagacttccactggagctctattgggggagcaaaggtgtaggatacttaattctacagattcaggggtgttaatggaatctgagggcagaggtttaactgggccccattgtaagaatcaaacttctctttatctctcatctctgttccctgtacatggacaccgttgagctattttcttcctgtaggtcagcgttccctactcgcaaatccagggatagaaatacaaatactactccaaattttcaaatgtgcatttccatcattcaggaaagcagccaaattaagcctggaatgccttggttgcagttccaaatcctacttccaaatccagagcagcattttgacgcagcttaggttacatgtgtcaggtgcctatctgtggatgagtcagctgtggccagggagtagggtcatgttaagaacataccagttctcagccaggcacggtgcctcacacctgtaatcccagccctttgggaggccgaggtgggtggatcacaaggtcaggagttcctgaccagcctggccaacgtggtgaaagcccatctctactaaaaatacaaaaattagccgggcatggtggtgcatgcctgtaatcccagctactcaggaggctgaggcaggagaatcacttgaacctgggaggcggaggttgcagtgagccgagatcgcgccattgcactccagcctgggcgatagagtgagactccatctaaaaaaagaacatatatcagttcctgctgtaatatagatggagaaaaaaatgaaggatagttaataactgagaattgaggaattgtgagctagggagacagactcttgtctccctgcttcatggagcctttcatatttccatttaaggattacaaaatactttgatgtcttcaagatccatgagataggagtatattataaggatggcttttcggccaggcgcggtggctcacgcctgtaatcccagcactttggggtggccaaggcaggtggatcacttgagaccaggagttcaagaccagcctggccaacatgacgaaacctcgtctctactaaaaaaaaatatataaaaattagccgggcatggtggtgcatgcctgtaattacagctacttgggaggctgaggcaggacaatcacttgaacctggaaggaagaggtttcagtgagccgagatggcactactgcactccagcctgggcaacagagcgagactctgtctcaaaaaaaaaaaaaaaaagcatgccttttattaatcaggtaactaacatatttaactgggtctaacgcagatagttgttacctcaatttcatattgtagtaacttgttttacagtgaatctactatagttggaaaatgaacataattttatctcactcaaaatgttgtcaaggtattattaatatttatgttaacttttaacaaagatgaagcgtatcaaagttaaaattgatcatatgtgtcattttttagcattttcagttacagaaaccatttagggtgaataacattgtgtagtggaagtatgaatttaggttctactttactgacttgatgtattataactttattctgttccttcacatgttaaaatcttccaagtataccacatgttcagatgctcactgtgattagatggtaaactactagaattaattatcttaataaattattagaataatttattattaatttagtctgtgcaaacacagataactttcaaccacttaggaattctgaaaacttaatttatcttcacatgttctcttctagttctaatactaaatttatttttctttttacttagtttaatgacatgtttaataagttactgggtaacattgaggaaacctagccctgtctattcatttgggtaagttcaaattattttattttctgctaacttatgactactaaaatattatttatagtagacgataaagagctagctagagtatttctggaaaataaatgctgcgtacttagtgaaatgatgatcagatagtgaaaatagataggctgggcacagtggctcacgcctgtaatcccagcactttgggaggctgaggcaggcagagcaccttaggtcaggagtttgagaccagcctggccaacatggcagacccctatctctactaaaaatacaaaaattagccaggcgtggtggcatgcacctgtaattccagctacttgagaggctgagacaggagaatcgctggaacccaggagacggaggttgcagtgagccgagatcatgccattgcactccagcctgggcaacagagcaagactccttctcaaaagaaaatagaaaagcatcttccaagaaacataaatatttaaggtataaatcatattaaaataaaatgttcacattaagttttttatattttataaagcaaatattttaaaaagttcacgttaagttctttaatattttggggatttattttagcaagagcaagtacaaaggattttcatgttagtgtatcttctagatgttaaataaatgtgatatagtttaataataggcagtggtaaagatggattttcatctgaaactggatttgtgatagcaatagatcaacaaataatttgagatttgtttccataattactgaggccaggtgtggtggctcatgcctgtaaccctagcactttggtaggttgaggcaggaggattgcttgagttagaagccagcctgggcaacatagtgagatctgtcgctgcaaaaaatgtttttaattagctgcacatggtggtgtacacctgtggtcccagctgcttgggaagctgaggtgggaggattgcttaagccaggagtttgaggctgcagtgagctataattgcatcactgcattacagatggcaagagtaagaccctgtctcaaaaaaaaaaaaaaatttactgaaagttgaaaggaaataatcttttatattaaaggtttaaaaatgtatttaaacatgagttccttttagatgctaggaaacaacttgaaagaattttactttattaatttttttttacctgaagaggcatatcgaccaaggaatttcactttagtaaagaaacttttggaccaaacttagtcttcttttccaccataccattcattgggactatattcttttgaacaaaattaggttttatttacttaaacaatgggaagaagtaaacaaaaattttaatgcaaaataaggattttcataaatcaatcataaatcaaaatgaatttttaaaaaatattatttttaattttatttattttttgagacggattctcactctgtcacccaggctggagtgcagtggcatgatctgggctcactgcaggctctgccttccgggttccagcgattcttctgcctcagcctcccgagtacctgggattacaggtgtgtgccaccacgcctggctcagtttttttttttttttgtatttttagtagagatggggtttcaccatgttggccaggctggtcttgaactcctgacctcaaatgatccacctatctctgcctcccaaagtgctgggattacaggtgtgatccaccacacccagactttttttcttttgtgtgtgtgtgtgtgacagttttgctgtgtcacccaggctgaagtgaagtggtgtgatcttggctcattgcaacctccacctaccagattcgatcaattcttatgcctcaacctccagggtatctgggattacaggtgtgcaccaccacacccagttaatttttatagttttagtagagatggagtgtcgccatgttggtcaacctggtgtccagctcctggcctcaaagtgccaggcccagcctgtgtcactgaaacttgagagagttgcattatcactatgataatcagttgtaaggtatagatatatccatataaggaaatctgccactgcaagtgacagaaatctaacttagtttggggcctggtgcggtggcttacgcctataatcccgggacttcgggaggccaaggtgggtggatcacctgaggtcaggagtttgagaccaggctggccaacatggcaaaaccccatctctactaaaaacacacacacaaaaattagctgggcatggtggcaggcacctgtaatcccagctacttgggaggctgaggcaggagaatcacttgaacctgggaggcagaggttgcagtgagtcgagattgtgccactgcacaccagcctgggtgacagagcgagactctgtctcaaaaaaaaaaaaattagtttggggagtcagatgcagtggctcatgcctgtaatcccagcattttgggaggcccaggtggtcgatcacttgagtttaggagtttgagaccatcctgagcaaagagcgagaccccgtctctacaaaaaaatacaaaaatatgctgggtgtggtggggcgtgcctgcattcccagctactcatgagactgaattgggaaaatggcttgaacctgggaggcagaggtttcagtgagtgagatggtgccactgcactcctgcctgggagacagagctagacgctgtctccaaaaaaaaaaaaaaaaaaagaaagaaaaagaaaaatgagttcgggggaaaaaatgggaggacttttacaatttatgtaaccaaactactgtgggaagacagtaactggcgcaggcactagaccactgaggacattgtcatttttttgcctcccaggcctgcttttctctgcatgtcctgttcagtctctcagaccacttttctccaccaatccgaaatgatgctcctatcaagaccttaattcacaccttctcaccttcatccgagagaggaaataataaattactactgttaaaataatatttatggtaggcaataaagagctagctagagtatttctggaaaataaatgctgcctagttcagaaaatcatgagaaagaactgttgcttgggccagcttggaacaggcatcagtctttatagatcagttactgtggatagaagacaaggtcgtgtaaggacatgacagctcccattttggctcacttgcttagagtgaacaggaaagaaaggagcagctaagcaataaagttaaacactcaaatatatttgcaatcgatcacatagctgaagtatcacatatatctggagacttcaaaatccagttctctaggcctgagaactatctagaatttcagactaccttcttgacagcttcacacggatgtctaattggtgtcttaaacttaggaaaaaattcttggtttcttcctcaaaaacctattcctttgtagttttccccgtctcagtaaataccatcagcactctgttgctcaaacaaaaaattctgggaatttctgttgattactgtctctcatcacccacatttaatctattagcagattaattatgtcaaggtaacctacaaacacatccagaattaccccccaatcccatttctgtctccactactgccagcccagaccaagctactttcatttacagccagtgtttttctttttaaacctgtatcatattatccctctccccttaaaaccatctagttgtttcccgtaatacttagaataaaatcctaactcctttttctaatttacaaagcccttatatgatcaggaccctgcctacttttcttcaacttaatcttctcatggcctctataggatactgactttctttttgttgtttgaacgctactaactcattcccattttaggtcctttatataagatctgcctgatatgctcttcacctgatctttgcaaggctggcttcatcgtgttactcatatcttaatatcactaaatgctaatttccattaagtgactgaatggcccaatcaaaaatagtcatctggttaatctcttgtcacatcagactactataattctctgtacagaacttaccaaacaaggtatttgtttttctgtccctaccctttaaaaggtaaatttcagagctgggtgtggtggcttatgcctataatcccagcgctttgggaggccgaggtgggaggatcacctgaggtcaggagtttgagaccagcctaaccaacatggtgaaacctcatctctactaaaaatacaaaaattcgccaggtgtggtggtgcgagcctgtcgtcccacctactcatgagatcgaggcaggagaatcacttgagaccgggaggcggagactgcagtgagccaagattgtgccactgtactccatcctccgtctcaaaaaataaaaaataaaaagcaaatttcatagaagtagggaccctgtcttgttttctgtaatatctttgtgcaatttgatgaattttaagaaatgaatacatttgtatagttactatctggatcatgatatagaacattacaagtcccccaaaacctcccttcgtgtccattcagaccctaccagaagtaactggtaatctgacctctaacattgcatattagttttgcctgtttctgaaaatcctgtagatggaatatagtatgtactatcttgttcattcttgttcattgctctcatattccattatatgaatatgtcacaaattgcttaattgttaaggacatttagatgactttcactttttagctattataaataaaactacttctgaacattcttgtatatatcttttagtgcacatgtgtacccatttatgttgggtatgtgtatctttgagtggaattagtttggatttgcatgttcattattaaaagataagataataccaaaccgttttccagagcagttttaccaatttatactcccactggtagtgtttgagagttgcatttgcttcctgtccttgacaacagttgatactgtctttttttttttttttttttcttttttttgaggcagcatctcgcttggtcgcccaggctggagtgcagtggtgcgaccttggctcactgcaacctccacctcccggatttaagcgattcttgtgcctcagcctcctgagtagctgggactacaggcatgcaccaacatgcctaattttttttatttttttatttttagtagaaatggggttccaccatgttggccaggctggtcttgaactcctgacctcaagtaatccacccaccttggcctcccaaagtgctgggattataagcatgagccaccgcacccggccttttttttttttttttttttttttttttttgaggcagaatctaactctgtagcccatgttggagtacagtggcatgatcatagctcattgcagccttcaacacctgggctcaagtggctctcctgcctcagcctcctgagttgctaggactacaggcacatcccaccatgcctggctaatttttaaaatatttttggagtcaggggtctcaccatattgcccaggctggtttgaactggtttcaagcgatcctcccacaccccgagtagctgaaattacaggtgtggagccaccgtgcccagctgttattgtcttttttcataaaggccattctatggtatgcagtggtatttcattgtggttttaagttattttccttatgactaattgagcacctttgcctatgttgattaaccattcagatcacctcttttttaaaatgcttgtaaaaatcttttaaccatttcctgtttttctgtattaatctgtaacagttctttatatataagtatcttctccttcttagttgcccttctttctcttaatggtatcttctgatgaataaaagttttaaattttaggccgggcgcggtggctcacgcatgtaatcctagcactttgggagggtgaggtgggcagatcatttgaggtcaggagttggaaaccagcctgaccaacatggtgaaaccccatctctactaaaaatactaaaattagccacacatggtggtgggtgcctgtaatcccagctacttgggaggctgaggcaggagaatcacttgagcccaggaagcagaggttgcagtgagccaatatcgtgtcattgctctccagcctgggcgacagagtgagactccgtctcaaaaaaaaaaaaaaaagttttaaattaaatttatttttttgggttggtccttttgtgtacttgttaagaaatcttggcatacccccaggtcagaaagacactttgttctgttatcacctagaagccttactgtttgatttttcatatttaatcctacaatccagttggaatagatttttttggtatggtgtgaagcaggagtaaaggcatattctggactgcagtggcgcaattcggctcacttcaacctccatctcccaggttcaagcaattctcgtgcctcagcctcccaggcagctgggattacaggcccgcaccaccacgcccagctaattttttgtatttttagtagagactgggtttcgccatgttagccaggctggtcttgaactggcctcaagtgatgtgcctgcctcggcctcacaaagtgctgggattgcatgtgtgagtcaccgcgcctggctctttactgcttttatgtgccacatttttcacaaatcagtggactatatatgtgtaggtctgtttctagattctcttttctgtacaatttggtgtatttgtacttggattagtactgcactatgtcaattattgcagctttgaaatacctattgatatctggtagtataaatcttccagcttcgttcttcttcaaggttatctttgccttccttcacattttgcagttccatatgcattttaatatcagcttctcaccttccacaaataacattggtgcatttgcatactgttttttcctgttcttttttattttttcagtagctggaaaacaacacttaatttgtattctatcataacctacttttttcactcacctttttccatgtcaataaatactttttttgtttaacaatatataatgttctattgttgattccagcatttttcctttacaaataacaatgtgatgtacagtcttaatttttttgtcttttctgtgcctccgtgattattttcttgaaaaattttaagcatttatacttaccataaatattgaataccattagaccatgtgttgcaggaaaaactaaaacaacagttcctggcctctggcttatagtctagggattataaaatatattcataattcactgtaattatgtatagaaatgagaggcagtataataagtggttaaaatctgaattctagtgtcagagtgtttgagtttgaaaaccttctacttgctatctatatgactctaaacagttacttttcttcttcgtgtcctaaacttcttatctgtttgggaaaaaaaaatgagccaagtgtggtggcacatgcctgtagtcccatctactcgggaggctgagcagctgggaggattacttgagcctgggagttcagggtccagcctgggcaacatagtgagacccccatctcttgaaaaaaagaaaaaagtggataaagtaattctaataaggggttgggaggtttagatgaggtaatatgttaagcactctggtgtctaacgcacagtgggtcaattaagtgttattattatgattgtgattatttctagaaaataaggactataattgggtcctggtaattgtcttttttttttttttaatcattttaaagtttttctggaaagagaaagcctctgacatgggctgaaggtgctctctcttctgagtcctaggaattgtacaaataggtactccttggaatctgtgattttcattgtttattattattctagaaaccctaatctgctctaacagtgttgggctcatagtagacagcacatatgtatattaagtgagcaaataaatgaatgtaaatgtgttctagagagactggtttgtgaattgaaagaattgtgatgatctaattaatgttttggtttcaggtttgaaagattagaagtcctggctgtatttgcctccacagtcttggcacagttgggagctctctttatattaaaagaaaggtacatttgtataggatattattctaaatccccccatgacacctttgggaacatgaaagaaacccgtcagacacatttgctttcaagggtatgaaaacttagatgagcagggctggagttttgatagtacactttctttatgtttcagactttttcttctgtttcattttttttacttccttccttaatgctactaaattgaatcagaagtggttgtgaatgaaacagagattcagtcaggcatgtttgatgcttattacaaacccattgaaataggcttggcagagaaagatagacattacatattaaggataatttgtgaaaaaagaaaacaactaaaaaggataatttatgagtctccttgcctcatcactgctaatagttaatagttataatattaaaagattttgtgaactttaaggtgggtgaatgatatatttaataaagctttttaactttataatttataggacttatttaatatatttttatttcttatagtgcagaacgctttttggaacagcccgagatacacacgtgagattttattttcaatatataatttactattgattcttaattattaattgatgtattattaaacagttggccaatgtcagatttcagactgtggcaacataacgtttttgctggtatttcacaaacaaaattccctaatactaagactccgtttctttactcttaacagttcccaagttctaaatatttttatactacacaggaaggcctttctatcttggcttcaggcttctcattatttccaggcctaggaaacactaacccagcttcccctagtcttctgtaatttcaaatttgaccttcaaaatctttgcatagcacctgtagaaaagagaattggacgaggctcagggattcagtgtaatcccagcactttgggaggctaaggcaggaggatcgcttgagttcaggagttcaagaccaacctggacaacagagtgagaccctgtctccaaaaaaaagaaacgtatatatgtttcatatatattgcaactatgtgattttcatatatatatgaaaagagaattgtatgtatcatatatatgaaaaaacaattgtatttctcaaccacagagctgccaactatatggaccttatctattctgatcagtttaattccacaaagtctgacttgtccagtatatcgtaaaacaaataccattgatatttatacagatttataacagcgtttacctgtagcaagatactgttaatgctaaaagtccttacttatcctttgtaagatggagcaacagtagatgggacatgggtgatggggctagtaactaagttcagattctgtatctggaaacaccaaatcattaaagcagaccactttaccttcccacctcttagtccctctacgtattgaaattacatactgataataccaagaacaaattaaaggtgaatgttatcgttgttctttttaggggaagattattagttggtacttttgtggctctttgtttcaacctgttcacgatgctttctattcggaataaaccttttgcttatgtctcagaaggtatgttttttatttactattaatttaaaaatccaactaatctctcataaaaacaagccttttgtttgtttcgttcactcagatcaatgaagaagtatattctgaagacaagagagaactagcccaaatgttctcaagtcttttttaagtggaaaattataaaacaaaatctcattagttcaagctttaaaataacaaattattttaaaacaggcaggagtgacctgtaaattaaatcatgtggtgatgaaaaattacatttaccaaataatgtgagattctaaatgtgtaatctatctaagaaaagtctattgtaagcattttagaagtatcagtatacttagaattcttagttgatatgctaattgaaaataattgtattctgttaataaagtaagttcccaggaacttctctttggcaatggtggatgggcatatatgtttgcaagtagccaaactttatttctttggaaatattcttttattttgaagtatttacaacttcagactgatttttcacttttgcagtctaaattattttcttttttcaataatttcagtgttttggaatcccactaacccacaaaagagttagccactaagagatggagaagtgaggtgaaaatagaagtgggatgtgtgcacagacccacactttgaagtatagagaagcacagataggtgtggatctttttagatctcactctaggatagtcaagagaagaaagttttctgaaatgcccattcaagtttaaacaacttcatgaatgttatgaagataaattgtgtttgtatgagttaaagaagtactgcatgaattagaaaattaaataatgataattaagatcactagaatttcttgaaaaaaattcataatttataaaatactataacacttactctagaaatttttaagatggtgcaaagatttagaaacactgtttccctgtaaagatcagggagatacaagaaggaaataagactactgataatcttatgacccacagataatatgttaacatttctatgttattccttccacttttttgtatgcacacgtacatataattttatgtgcttacttagaattgtatatattacagttttatgcctggcttttttttttttttttttgaaacggagtctcactctcttgcccaggctggagtgcagtggcgcaatcttggctcactgcaacctctgcctccttggttcaaggggttacaggaatgtgccaccatgcctggctgatttttgtatttttagcagagacggggtttccccatgttggccaggctggtctcactcctgacctcaggtgatctgtccaccttggcctcccaaagtgccgggattacaggtgtgagccactgcgtccggccatgtctggctttttgattagcattatgtcttcagtattgcttctcattaaatactctttgaatgtaaatgattttttaatgtttgcataatattgttatgaatattttaaaatattttatacatttctaacttttccttttataaataactctataatcagcctctttagatcaacttcgtctgcattttttattctttctgtaggataaattccccgagaaggaattatttactggattaaaaatacagtatttttcaaaggctttgttgtatattgccaaatttatttccagaaaagttatctagtttatatttttattatattatattatatttatttatttatttattttttaatagagacaaagtctacctgtgttacccaggctggtctcaaactcctgggctcaagcagtcctctcacatcagcctcccaaagtgctgggacgacaggcgtgagccactgctcccagcctactttatattttcattagctggaaatggaggttcccagaaacatcaagatttgtgacattagctgggcttggtagcatgtgcctctagtcccagctactcaggaggctgaggtggttgtattgcttgagttcaggagtttgagttcagcctgggaaacatagcaagactctggctttaaaaaaaaatgaaggctgggtctggtggctcacacctgtaatcccagcagtttgggagaccaagtcaggcggatcacaaggtcagcagtttgagaccggcctggccaacatggcaaaaccctgtctctactaaaaaattataaaaattagccgggcatggtggcaggcgcctgtgatcccagctacttgggaggctgaggcaggagaatcccttgaacccggtaggcggaggttgcagtgagccgagatcacgtcattgcactcctgcctgggtgacaaaagtgaaactccatctcaaaacaaaaaaaaaagaaaaaagatttgtgaaattacttgaaatttgagtgggaaataatattaagtactttctatatgccaagcactgctaaatactttacatagaataacctatttaattctagccaggtaggtacccaggttctcacctggcttttttgagagttgagggaattaatttgtatgtagtttgaatatcccttatctgaaatgcttggggccagaagtgtttcacattttagattgtcttagatttcggagtgtttgcattatatgtatgggttgagcatcccaaacctgaaaatttaaaattcgaaacgctcctatgagcatttcctttgagtatcatgttggtgctcaaagttgtggatttttggttttcagatttgggatcctcagcctgtacctatggcccgttctcagcacactagttaggaagctctgcttaaaagtataaagaactgctgggcatggtggctcacacctgtaatcccagcactttgggaggccgaggcaggtggatcacctgaggtcaggagttcaagaccagcctgaccaacatggtgaaaccccgtctctactaaaaataaaaaattagccaggtgtggtggcacgtgcctgtaatcccagccacatgggaggctgaggcaggagaattgcttgaacgcgggagacagaggttgcagtgagccgagatggcaccactgcactccagcctgggcagaaagagcaaaactccatctcaaaagaaaaagtgtaaagaacctttaaaaccttaaattaatagtaacaatgacataaattccttcaggtcaactgtatattgtataatagttgaaactgcttttgaattagtggcataagggcataaaagaggaaacatttatagatttgaggagtagcatgttcttttgtaatgttattcagtcactgccaaatttattttttaaaattaaagaactcaaatatttcaggtagtggtttttttttcttctatatagataatttaagtattttcttcttaaagctgctagtacgagctggcttcaagagcatgttgcagatcttagtcgaaggtaagatgttatggagtttcatgatatgcataatttaaaggaatacacaagaaatgcatctatcatgggaacttaaattattcgttgctgaggttactacgtgaatcacacaggtcagattgttattctccctttactttttaattgatacaaaagagaactttataaatgaaagggctttgttcacaaatcctctttgctttctttaagaagtacactatgtggtaccaaaatacaagttatcttttacaaggttgtcaccagttttatgtgagttctgctaatggatactctttctgtttgttttttcttagcttgtgtggaattattccgggacttagcagtatcttccttccccgaatgaatccatttgttttgattgatcttgctggagcatttgctctttgtattacatatatgctcattgaaattaagtgagtattttttattgttgtcaagtatgttttgatttctggggacttacttttaagggcatcagcaggatggatagtggtcaagcttctagcagtttcgcttatgtcctgtgtaacttagatcacatcttttccttaggtgtcttcatctgaaaaattaaggggattgggttcaataagtatttcttaccacaatgtataatgcagactggaaaacaatttaaattccctactgctgacctgatgagtgaaacagaaaagagaacagtaagaaagagatctgagccaccactgctattgccgagagagggaggagaagaggacgtaggcgtgaaacaattttttaaaaataaagccttttaggaaataggctttacagctgctttaagcttaacatgttatggcatatgattctttggctacccaccttttaaatattagtctttactagaatttgtccttattgttcttgctgttttatgtattttccttaaaaatcacatgcaagtatttgtttttgtttgctacttctgtgggattcctagatttttatttctagcccacatctctattgaattccaaaaggcgtatcttcctgacttctataggtgtctactttaactgaacctattttcccttaactctgaaactgttttttcttctatctcccatctcagtgaatgggagatacaagaaaaatactgtcatttatgccaatgcattcttattttaaattgcattaaaatatacataatatagagttggcttttttctgagatggagtttcgctcttggtgcccaggctggagtgcaatggcatgatctcagctcactgcaacctccacctcccgagttcaagcaattctcctgcctcagcctcctgagtagctgggattagaggcacctgccaccacacctggctaatttttgtatttttaatagagatgaggttttgccatgttggccaggctggtcttgaactcctgaccttaggtgatccacctgcctcggtggctcatgactgtaatcccaacatagagttttttatttacattgagtgtacaatttggtgacattgcatgcagccattaccaccatccatctccagaacctttttcctcctgccttccttaaattccatgctcattaagcagctttccttttcctcctcctcacagcccctggaaaccaccattctagtttctgtctctaggaatttgacttctctaagtacttcacagaaatgaaatcatataatatttgttcttttgtgtctgcttatttcacttagcataatgtcctcaaggttcatctatgttgtaacatgtcagaatttccttcctttttaattggaatgctgaatcacattttccaatgcataatgggtaaacaatgcattttgtttacccatttatccatcagtggatatttgaattggttgcatttctttgactattgtgaataataccactgtgaacacgagtgtacaaatatctgagtccttcctttcagttcgtgtgggtatatacccagaagtgaaattactgggtcatgtgatatgataattctgtatttatctaatttatttaattttttatttttgtaggcacatagtaggtatatatatttatggggtacatgagatattttgatacaggcatacagtgcataataatcacatcagggtaaatggggtatccatcacctcaaggatgtattttttctttgtgttctaattatgctcttgtttattttaaaatgtacaataaattattgttgactgtagtaaccctgttttgctatcaaatagtagattttatttattctaactatatttttatatccattaaccatcccccacatccccccaatattttagttttttgaggaactccagtgcatcattaatacccacttttcctccctcctcctctctcaccactccccaagccatttctaattcgtctccaagccttgtgtaattgtttattaatatttatttatttggctgggtgcggtggcttacacctgtagtcccagcactttgggaagccgaggcggctgggtcgcctgaggtcaggagttcaagaccagcctggccaacatggcaaaaccccgtctctgctaaaaatacaaaaattagctgggcgtggtgatgcacacctgtaatcccaaccacctgggaggctgaagcaggagaatcgcttgaacccaggaagtggaggaggttatatatatatgagacatatatacacacacacacacacacaaatataaaatatgtgttgatatatatatataaacatatatatatgtttatttgtcccctctttcccattctcattgctgctgtccctattaagacctttatcatcatttctttggcctaattagaatagcctctggtcttctagttttcattcttatccattgctagttaccttttattttgtcactaatgtgatcattcaaaattgctagtttggagataatatattcctgtttcaaaaccctccccttgaggtgtacccaacagctcattgagaacgggccacgatgacaatggcggttttgtggaatagaaaagggggaaaggtggggaaaagattgagaaatcggatggttgctgtgtctgtgtagaaagaagtagacatgggagacttttcattttgttctgtactaagaaaaattcttctgccttgggatcctgttgatctatgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactctgcctaggaaaaccagagacctttgttcacttgtttgtctgttgaccttccctccactgttgtcctgtgaccctgccaagtccccctctgcgagaaacacccaagaatgatcaataaagaaaaaaataataataataataataaaaccctcccctttgcatagttgcaaaaattgaagttgtcagcacagagtcctgagtaatcaggcccctaccaaccttactaaccatccatctatctattcctgaccatttgtggttttattgctgggtcagggttttcatgcccctgcacatgctgctttcacttgcctatctttgaagtctctgcccaaatgtcaccttctggattatctccaccccaggagccttgtcactcaatcttttgtgcggccatggtactctgtagacatttctgccttagtgcccaaagtgcttcattatgtttttcacatgtgtatctcctgttatttctagggcaaggattgtgtctcattcacatttctatttctagcatgtggggaaaagtagaaaagagtgcacaatcagcttgtaattattggcattttggtctgtattgttggtagaacttcagccagtttgaattgttgatgttgactacagtgttaccataaaaaattcctggagaatcttacctggtgaaattcctggggaatttgaagtcttattagaaataattatcgctcactggaaacttgatataattactgatagattccattagtctttctgtatcaaaaattactagttgaatgacacacagccacggctgagtggctgccctgcccctgtttcctttcacgtttttgctgcatgtaggtggttgtggccactgtgcccggagggaggcagcagtggccagtaatgcctgggaaactcctctgggggtacattatggaactggaagcacccttggaggagtccgagagccagaagaaggagaggcagaagagctttatggatatcacagtttcggctaatggattatggacctgtacttcccttatatggtttttatgaagatttaaacaagataagctgaaaatacattacacagtgctggagtgacagaaggaagtcaagccaccattatgactcagatgagaaatcagaaacaagagaaaatggtgttacagattacctggatgctcccaagaccaaaaaaattaaaatgaaagagaagctaaatggagacactgaagaaggatttaatagactttcagatgaattctctaaatctcataagtcaagaagaaaagatctactgaatgagatattgatgaatatgaaaaaaaaaaagcaagtatcatccttagatagttctactcatgaatcaagtgataagaagctagaggagaccttaacacatgaacagaaagaaggaaccttctccaatcttcctatttctgaagagactataaagcttctgaaaggttgaggggtaacatctctctttcctgttcaagttaagacctttggtcctgtatatgaaggaaaagatttaatagctcaagcacagacgggaacaggaaagaaagacattctattttgcgatccctttgattgaaagactccaaagagatcaagaaacagttttttgtttgtttgtttgtttgtttgttttttgagacagaatctcgctctgtcgcccaggctggatctcggctcactgcaagctccgccgcccgggttcacaccattttcctgcctcagcctcccaagtagctgggactacaggcacccgccaccacccccgactatttttttttgtatttttagtagagacgggatttcaccgtgttagccaggatggtctcaatctcctgaccttgtgatctgcccatctcggcctcccaaagtgctgggattgcaggcgtgaaccactgtgcccagctctgattggatctttctaaactgtgccatgttgtgcttgatgaagtggatcaaatgttagagttaggttttgctgaacaagttgaagatattattcatgaattctacaaaactgattctgaagacagtcctcagactttacttttttctgcagctcgcccacagtgggtatgcaaagttgcaaaaaaatgagtgaaatccagatacgaacagattgatgtttttggaaaaatgactcaaaaggctgcagcttctgtggaacatttggccatccggtgtcattggtctcagaggccagcagttactggagatgtccttcaagtctacagtgggtctgaagggacggctattattttctgtgagacccagaggagtgtaactgaaatagccatgaatccacacataaaacagaatgcccagtgtttacatggggacattgcacagtcacaaagagaatttacactaaaagacttcagagaaggtagttttaaagttttggtggcaaccaacgtggctgcctgtggtttggacattcctgaagttgacctggtgattcatggttctcctcctcaggatgttgagtctatatccatcgttctggacgcacaggtagagctggacagacagggatttgtatatgtttttatcaaccaagagaaagaggtcaactaagatatgtggaacaaaaagtaggaattacttttaaatgtgtaggtattccttctacaatggatttagttaaatctaaaagcacggatgccataaggtctctggcttctgtttcttatgctgctgttgattttttccaaccatcagctcagatactgacagaagagaaaggggcagtggatgcattggctgcagctttagcccacatttctggtgcatcaggctttgaaccacgatctttgatcacctctgatagggatttgtgaccatgactctggaaagcctagaggaaatacaggatgtcagctgtgcttggaaagaacttaacagaaagctgagtagtaatgcagtgtctcagattaccagaatgtgcctcctgaaaggaaatgtgcgtgtttgctttgatgttcctacaactaagtcagaaaggttacaggcagagtggcatgattccgactggatattctcagtgccagccaaattacctgaaattgaagaatattatgatagaaacacatcttctaattccagacagaggagtggttggtcaagtggccagtcgggccgatcaggtggtcgatctggcagccggtcagttagacagagtccacaagggagtcgctcaggaagttgacaagatggtagaagatgaagagggaatagaaatcgatcaagaagtgggagccacaaacggagttttgactatttgatagttaatctaccagtatgaggttgcctatttctgcctaatcatgtatattatgcaccaaaaattaggtcatcatagttgaggtatgtgtctgctatttgcaaataaattggtcatatttttttaaaaagtatttcacaagaatgattgtaaacagatctacttaccagttatacctttgaattaaaaaacctctttttattgtctctttttaaaaaaaaattactagttgaagttttttgtctgtctcaagcaaataaacatatttcagctctttctagttgacagatagtttgacaaaaaaatgcctgacggggaaatgtccacattttttttcatcatacctcttcctactaattaacataattattagttatttttccactaaactttgaaaggaaagaattctaaaaactggagtatttttctttgaaatgtttctttgcaagtagtggccaattgtgataaaattgtgtcctgttgctcagtcctgttgctttagataattaatgttcaggagatttaattgtaatatgcccagtgagatataaatttaaaatttagaattgttttttccttttagtaattattttgccgtagacactgcctctgctatagctattgccttgatgacatttggcactatgtatcccatgagtgtgtacagtgggaaagtcttactccaggtaaggtgcttcttccaatgcacgtgcttaatattagccatgttcttctaccagattaaaaagttgtatgtgttgttctacaagattgtgaaatttttatttttattttttaattttaatttttttttttttttttttagagacaggtccttgctctgtcacctagactggagtacagtggtgggatctcggctcactgccgccttgacctcccaggctcaaaggaccctcccacctcagtctcctgagtaacaaactacaggcacacaccaccacacccagctaatttttaaaaatatttgtagagatgggctctcactatgttgcccaggctgatctcaaactcctgggctcaaatgatcctcttgctgcggcctcccaaagtgttgggactatacgcgagagccatcgtgcccagtcataatttttaattacaaaagttttttggccaggagaggtggctcacgcttgtaatcccagcactttgggaggccaaggcgggcagatcacaatgtcagtagttcgagaccagcctggccaacatggtgaaaccctgtctctactaaaaaaatacaaaaattagctgggcgtggtggcgtgcacctgtaatcccagctactcgggagactgaggcaggagaattgcctgaacccgggaggcggaggttgcagtgagctgacattgtaccactgcatccagcctgggtgacagagcaagactccatctcaaaaaaacaaaacaacattttttttaatgccctccctttaacagtacagattgtgaaatttttagttactggaagcccctgctagaaatgaagtcaaacaataatctctgacattcatatagtcagaacctgatgaaagtccattagcaagtaaaatagtcacaaatcttcctatatttatattgtgacaaaatcacaaatttaaagctattattatttttcaagtgaaaagaatgttacttcttttttttttttttttttttttgagacagagtctctctctcttgaccaggctggagtgcagtggcgctacactcaggtcactgcaacctttgcttcctgggttcaagcgattctcctacctcagcatcccgagtagctgggactacagccatgtgccaccacgcctggctaatttttgtatttttagtagagctggggtttcactacattgaccaggatggtctcaaattcctgacctcaggtgagccacccgccttgaacctcctaaagtgctgggattacaggcgtgagccactgcacccggcctgaaattttttttagatatttattttccctcagtaaatgtgctttggcttttgtgtaatctgcttatgactattttattatttcctgccactgaatcagtgagactttaaaatttcaaacttaaaatcttaaatgacacattgctacttactgaaatgataggaacaccctgaatatgaatagaaaggcagtttccggccgggcgcggtggctcatgcctgtaatcccagcactttgggaggccgaggtggttagatgacgaggtcaggagatcaagaccatcctggctaacacggtgaaaccccatctctactaaaaatgcaaaaaattagccgggcatggtggcgagtgcctgtagtcccagctactcaggaggctgaggcaggggagtggcttgaacccgggaggcggagcttgcagtgagccaagattgcgccactgcattccagcctgggcgacagagcgagattccaaaaaaaaaaaaggcagtttcccagggccggatgtgcgtgtaagcactgtggttccttctgtcttaccctatgccttttccaagacttagggcagtagttccatctccagaaaaaataaaaataagataatagttgcatagtgctatgccctatacaaaatacgacctttgtaaccatttcccaaagattttttgttggttggttggttgtttaagtgttatttatctttttatcttatcttcaagataaaaaaacaggtgtgggccagttgatgatgttgttccactagtggggccagttgaaacctctcttctctaaatcatgataggacagctgtcaaagcaaaggctggcttaaaatccttttggggagggggttcaggaccattgttggcaaacttttttccttcccccattattcatattttattgtatttttccccagacaacaccaccccatgttattggtcagttggacaaactcatcagagaggtaagatggaatagtaaataaaatcattttattttatatcagggaattgaaaaggtggatacttttaatactttattcaactctacctagaattttatttgagggaagttcatgttcttcacaataacatactaggagccataatatagtggcaaacgtggaaaaatatgaggaattgttcaatttggaaatcaaattcacttgaagtgaatgtggaaggtaatggcctaatgaccaccctattataaatgctatgatttttatttattttatttagttatttagttattttttttttgagacagtcttgctctgttgccaggctgtagtgcagtggcgcaatctcagctcactgcaacctccacctcccaggctcaagcaattctccttcctcggcctcctgagtaggtgagactacaggcgcgtgccaccatgcccagctaactttttcttttttttttgagacagagtcttgctctgtcgcccaggctggagtgcaatggtgccgtcttggctcactgcaacctccgtctcccaggttcaagtgattctcctgcctcagcctcctgagtagccgggactacagatgcaagccaccatacccagctaatttttgtatttttagtggagacagggtttcgctgtgttggccaggctggtcttgaactcctgaccttgtgatccacccgcctcggcctcccaaagtgctgggattacaggcatgtccacagcgcctggcccgcccaactaacttctgtattttttttttttttttttttttttctgagatggagtctcgctctgtcgcccaggctggagtgcagtggcacaatctcggctcactgcaacctccgcctcctgagttcaagtgattcttctgcctcagcctcccaagcagctgggattataggcgcccaccacatgcctggctaatttttgtatttttagtagagacagggtttcaccatctcgaccaggctggtcttgaactcctgacctcgtgatccacccacctcgacctcccaaagtgctggggttacaggcatgagccaccaggcccggcctaacttttgtatttttagtagagacggggtttcaccatgttggccaagatggtctcaatctcttgacctcgtgatccacccgcctcggcctcccaaagtgctgggattataggtgtgagccaccgtgcccagcctgttttttgttttttttgagactgagtcttgctctatcacccaggctggggtgcagtggcatgatcttggttcactgcaacctccgcctcctgagttcaagcgattctcctgcttcaacctcctgagtagctgggattacaggctcccaccaccatgcctggctaatttttgtatttttagtagagacgaggtttcaccatgttggccaggctggtctcgaactcctgacctcaaatgatccgccccttgtgacctcccaaaatgctgggattacaggcatgagccactgtgcccagccttttgttgtttttttaaaatatatatataaaaagagatggggtcttgctatgttgaccaggctggtcttgaactcctgctctcaagccatcctcccatcttggccttccaaagtgctgggattacaggcatgagccactgtgcccggtcaaatgctgtgattttttttttttttccagggggtacagggtcttactctgccacccagtctggagtgcagtgccgtgttctctgcttcccaccggctaattgttgtacttttttagtagagacagggtttcgccatgttggcctggctggactcgaactcctggcctcaagtgatctgcctacctcagcctcccaaagtactggaattgcagacatgagccaccatgcccagcctagactttcttttaagttgttacaaatttccacctactaactaatgaagaaataaaataatgaactattttgatgttgaaactattttaaacctttgattgtcagtgtgacagaggccacttttaccagtataactggctactactctcaactagtgaagcctggccttgagtatgtgtcctgtgcaactgtaccagtgggctacacactatatatctggccttggaatttcttctagactcacatccaaacaacatcctgtgttgtgcagagatttgttataagggatttcagagaaagaagtgattgagaaaacaaaaaaattaagtaaaaaatctgataccacaaagtgctagatataaatatattccatattgatatgaaaagaaccatacactgttgaagaaattggttggggtaggggtttaaaactgagcagtggggacctgattctaaaagaattggggcaagcaagaaacgaggaaagcaaggtcttgggtcagtatggaacaaacaggaatggtatcttgagtggtctgagacttctcttagctaatgagtgtccttgtgcaggatttggctgtcattcttaagtttaaactaagtccataatgtgactaaactgcattggatatgttaagtacagacaactctgatcacctctttctgtttttggtaggtatctaccttagatggagttttagaagtccgaaatgaacatttttggaccctaggttttggctcattggtatgttcttttacatatgactttagttataatttaaaatatagtcttccatttttaaaactgaaaaaaaatatttccttaaaatttttatagagcctttgattcctagttatgttaagcagagtctaaaatgtacatgaattcaattacctaattgagggattttttggtgtttagagacagggtctcactctgttgcccaggctggtgttgaactcctggcctcaagcagtcctcccgccttaatctcccaaacaatagaggaatgtttttattttttttccatcaaacatgttaatgataataatacaggagtgtccagataagacaaatttgtagtcagtgtaatttccaaataagaaaatgttaaaaaaaattaaaagtgcaattgctttcttttttaactgtagttctcattttggagagtttgctgaatattttgaagaactacagtaacacaacttgcttcagcataaaatttcgtattttctaattcagtttgaacctcaataccagagagactttattatgacacggttttactcgtacgttaggaatgatgaggaaaatacagaaaatgtaaagcactataatcttatcatctaaagaaaactgctgttgatattttggtgtttatacatttattttccttagaaaatgagatcacgggctgggcgtggtagctcacgcctgtaataccagcactttgggaagccgaggcgggcagatcacctgaggttgagagtttgagaccaacttggctaacatggtgaaaccccatctctgctaaaaatacaaaattagctgggcgtggggtgtggcacacgcctgtaattccagttactcgggaggctgaggcaggagaatctcttgaacccgggaggcagaggttgcagtgagccgagatcacgccattgcactctagcctgggtgacagagtgagactctgtctccaaaaaaaaaaaaaaaaaaaaaaacaacagaaaatgagatcatgctgttttataattagctctttttgtttaattaatttatcatgaacagttttctatgtcattaaatactcttctacagtatcattaaaaaaaacagatagggtttgatttttctaatataacacaaattttatagataaacagatcaaagctggtctagcagttcaatgatattacccactttgcagtctttagtttcaggctatgcttttgtagtgggaaaatggttgcttcacctccaccttccccaactctttccctctctcattattttggatgtctaaaacttattacaagaaaaacttgagactgtaacatcccctccctccttactgggaaggtgccaaatgaccagagtgtcaagagaccaaagaatgacttggacaggtccagcatggccagtaggtgagtttgttaggagttacctatggggcactcctgggaagcaggacagctttagagatctacccacctcccatttctaagctgcttttaagctaattttctcgctctttgcctgctgtatgtgtgtaatgagactgttttccttggtagggtctcagatgctctctaaaatctttggttctcagggtcgcttgctcctcgactgtacaccatggctttggctcattgcctggccttcagagttcgggcagcggacatacatcatcgaataacctagtgggggacccaccacactacacttctttaaattctttagaaggggccgttgggaacaatattctctaaattcttgaatgttgaaagcagcttgtggacattataattaaaaattagtttgattggatataaactcttcagtacacatttgtttcaagtttcttaaaaacacattatcccttttatttctggcatgaagcatttctgagacaatgcctaatgatagtcttaatttttttccttttatatgtcacttggtctttttgcctggatgcccaaaagatttttttttaagttcagtacctttactagaatatgtcttggcattggtcattctgcatgagttatttcaggtatgcagtgcaccctttcttctttttttttttatttttatttttgagacggagtcttgctctgtcgcccaggtgggcgtgcagtagtgcaatctcggctcactgcagcctctgcctccagggttcaagcgattctcctgcctcagcctcccgagtagctgggattacaggcacgcaccaccacgcccagctaatttttgtttttttttagtagagatggggttttaccatgttgaccaagctagtctcagactcctgacctcaagtgatcctccctccttggcctcccaaagtgttgggattacaggcatgagctactgcgctcggcccacagtgcacgcttttgataatgctgtttcaaaaataattttttaaaacatctaattgtattttgtaatatttgttctattctctttctttggttttcttttgtggaaacttctgttatgtgcatgttaaatatgttggatctttgcctttcttactgttattttctttcaaattcttatcttttaatttccttttgattttttttaaccttttgtgtctcttaaagtatacctgtatgtttccttatgtttgtgtttgttctgagtaagtcttcatttctaaagtgatctttttttcttgtattacaattgtcatctcatttctaaggttttctaattctgatttatggtcttgttttatatcttttgattggtttttaaaaagtaggttatagtttttatctgacatgtagttttatctgtctggtgatcttttataatctgttttatagtctctttttcttacataactttgtgtgggatttgaccctctcttcttttctgttgctcatttttatgtgaaattagttttcctgaacattaaaattaggagtggtttagggtagtgtgtacaaattcatgggtctagagctccatcttctgatgattttgtgaacgaagaaagatttttgttctggctttcttcctctctgccatttttaccttttttttttttttttttttttttttttgagacagggtctcactctgtcgccaggctagactgagtgcaatggcttgatctcggctcactgcaacctccgcctcccaggttcaagcgatcctttcacctcagcctccccagtagctgggactacaggtgcatgccaccatgcctagctaatttttgaattttttggtagaaacagggtttcaccatgttggccaggctggtctcaaacttctgacctcaggtgatctgctcttggcctcccaaagtgctaagattacaggagtgagccactgtgtccagcatttttttttttttttttttttttttttaaggagacagcgtcctgccctgtcacctaggctggagtgagtggtacagatatagctcactgcagtctcaaatgtctgggctcagatgatcctcctacctcagccttcccagtagctgggattacaggtacacgccaccatgcccagctgatctttttaattttttttgtagagacagtcttgctgtgttgcctaggctggtcttgaactcttggccttaagcactcctactgccttggcctcccaaagtgttgggattacaggcacgagccactgtgcctggccctgccttacatttttatctgaacttcttctgtcctttgtctcaactgtactactcagtttggattctcttgccaatgtttctttttgatatggagctttttttttttttttttggaggggagctttgcctggttactttcgagactcatagggctcagactattccagcccttattgcagacccagtgtatttgcccactgttgtaatgtgcaaaactcctcccagttgcagctgcttttctcatattggctgtcctagatttccattaagtcttgttagccgctttggggtttttaggtcagtcagatgtgctgttgcttcctgctgcacagattgtgttaccttgaaggtcttacaccttttatttgggttttcataagggtactaggttactttctttgttttaatggaaatatttgaggcatttcaaacactgccaccactgctgccatcttgcaagaatcccaacataatttttagttttcttagttttacattatctaaatatgccataatttatttcataagtcccttagtgaatatttagattctcttctatttttcctatattaacaggtctaggataaacttttttttttttttgtttttgttttgagacggagtctcacactgtcacctgggctggagtgcaatggcatgatcttggctcactgcaacctccgcctcctgagttcaagcaactctcctgcctcagcctcccaagtagataaaaactagaaagaagctatctgtgaaactgctttgtgatgtgtagattcatctcacagagttaaacctttttattgattcaggaggttggaatctctctttttgtagaatctgcgaagagacagccgggattacagatgccccaccatgccccacgtctggctaattttttgtatttttagtagagatagggtttcactgtgttggccaggctggtctcgaactcctgatcttgtgatctgcccgcctcggcctcccaaagtgctgggattataggaatgaggcaccatgcccagcctgggataaacatttttatgggataatctttgtaaatatccatgattatttcttaagattaatttttagaagtttttgtaaatctgaaaatattcacatttttatggcttttgatgcaaattcccaaattgccttctagaatgccttttagaactacacaccttgagtcttatgttcatttttaaccattctttcctttatttttttaattaattaattttttaaaatatggaacgcttcatgaatttgcatgtcatctttgcacagaggccatactaatcttctctgtatcgttccaatttgagtatatgtgctgccgaagtgaccacttaaccattcttttaattgcgttaatgacattggatggcttataaacacaaagaatatagtcatcaactcagaacttggcatctagaaaccacacctatgaagtccctggttaagacccaggaatttaataaaacaagcttttgagctgctaaaagttaatatcacaaaagccatagattaacgcatgcactgtaattataggagacttttcaagttcatactctgaaaacagagtttccttattttaattactttgatttccatatcagactgaaagaggatatggcatctttaatacttaggtagtgacaactgtgaatggtagtggcaaaagaaaagggaaaaatcaaagatgacttgatttcaagacgtggcttgtcttagctaaaagtaataaactggaagtcaaattcaaggaatatagatattttctctgtctcatgattgacagtagctctcttactatttttctgtattttgtatttcaagtcatagattcagatacagtgttactaaacaatttggctaatttatgtgcagtttatgttttgtaagaatttttttcttttttgaaaatctgtgtttatttagagaccaacatggagtgtctgctggacattttatttaattttatttactctctttttttgagactgggtctggctctgttgcccagcctggagtgtagcgacatgatcttggctcactgcaacatctgcctcatgggctcaagccatcctcacacctcagcctcccaagtagctgtgactataggcgcgcaccaccacgcctggctaatttttgtattttttgtagagatggggttttgccatgttgtccagtctggtctcaaactcctgagctcaagtgatccatctacctcagcctcccaaagtgctgggattacaggcatgagctaccatgcctggccatctattatatatatatatatattttttttttttttttaagttcttattaggcaaatagtacccaattgttaagaaaataaaaacttgtaactaagtcataaaaaagagagtaaatatccttaataattctgccatctagagataaatattgtcatccttgatacttgtctctgttcttctgttttttatttttctttatttatatcttattttattttttatttattgagacagggtcttgctctgtcacccaggctagagtgcaggggtatagtcatggctcactgcagcctcaaccctctaggctcaagcagtcttcctgcctcagccttcctcgtagctgggactgcatatgtgtgcctggctaatttattttttataacgatagagtcttgctatgtggtccaggctggtctcaaactcttccttaagcaatccaacctaggtgcccatcaatcctaggtgttattgggcacctaggttgatgccatgcctttgctgtgtgaatagtgctgcagtgaacatccaagtacatgtgtctttttggtagaaagattattttcttttggatatatacccagttatgggattgctgggtcaaatggtagttctgttttaagttctttgagaaatcttcaaactgctttttagagtggctgaactgatttacatccccaccaacagtgtataaacactcccttttctctgcagcctcaccagcatctgttgttttttcactttttaataataaccattctggctgggcgcggtggctcatgcctgtaatcccagcactttgggaggccgaggcaggcagatcacctgaggtcaggagttcaagaccagcctggccaacatagcgaaatcctatctctactaaaaatactaaaattagctgggcatggtggcgtgggcctataatcccagctacttgggaggctgaggcaggagaattgtttgaacccaggaggtggaggttgctgtgagctgacattgcgccactgcactccagcctgggcaagagagcaagactctctcaaaataaataaataaataaataaataaataaataaataaataaataaataataataatgatagtagccattctgagtagtgtaggatggtatctcattgtggttttgatttgcatttctctgctgattagtgatgatgagcatttttttcatgcttcttggccacttgtatgacttcttttgagatgtatcttcatgtttttttcccattttttaatggggttgttttttgcttgttcagtttttaagttctgtatagattctgatatcagatctttgtctgatgcatagtttgcaaatattttctcccattctgtaggtgtttcttggttgtctcgcaagattcttacagttttgaggtctgtttttttttttagacgaagtctagctctgtcacccaggctggagtgcagtggcatgatctcagctcactgcaacctctgcctcctgggttcaagtgatttttccttctcagcctcccaagtagctgaaactgcaggcatttgccaccacgcccggcaaatttttttttttttttccatttttgtagaaacagggtttcaccatgttggtcaggctggtcttgaactcctgacctcaggtgatctgcctacctcggccacccaaagtgctgggattacagggcatgagccatagcaccctgctgaggtcttaaatttaaatctttaatccatcttgagttaatctttttatatggtgaaagtgaaggtccagcttcattcttctgcatatggctagctagctatcctagtaccatttattgaataggtagtcctttccccactgcctatttttgttgactttgtcaaagatcagatggctgtaggtatgtggctttatttctgggttctttattctgttccattggtctatgtgtttgtctttttaccagtaccatgctgttttggttactgtagccttatagtttgaattcaggtaatgtgatgcttccagctttgttctttctgcttagaatttctttggctatttgggctcttttttggttccatatgtattttaaaatatttttttctacttctatgaaaaatgacattggtagtttgatagtaatagcatggaatctatagattgctttggacaatatggccattttaatgatactgatcttccaatccatgagcgtggaatgtttttccatttgtttgtatcatctgtgatttctttgagcagtgtttcatagttctccttgtagagatctttcacctctttggttagatgtatttctaggtattttatttcttttgtggatattgtaaatgggattgaattctttttttttttttcttgatacaaggtctctctttgtcacccaggctggcgtgcagtggtgcagccactgcagcctcgacctctaaggttcaatcaattctcccacctcagcctcctgcgtagctgagtagctggcactacagatgtgtgccaccacgcccagctaattttttttattttttgtagagatggggtttcaccatgttgctcaggctgggggagtctgtgtgtgtgtgtttgtgttaaccaaaataggatcatttgctgattatctactttaaaaacataatttatggaccgggcatggtggctcacgcccgtaatcccagcactttgggaggctgaggcaggaggatcgcttgaacctaggagttcgagaccagcttgggcaacacggtgagacctcatctctacaaagaaaacaaaaaaacaaaaccaaaaaaacccataatttatggtaaacactttttcaagttaacaaatatacttctaactctcattgtaatgcctggtgttctctatcccttagaagccttgatatcatctttgatgagtcaatcttcctcatcctttacttccagctgggtatcaagtccttccattactacctctggaatatgatatatctgtctgtccctctctgatcccactatttttggcctggctcagctctcctcttttgttttgttttgttttgttttgttttgttttgttttgttttgttttgttttgtgacagagtcttgttctgtctcccaggctggagtgcagtggcatgatctctgctctctgcaacgtctgcctcctggattcaagtgattttcctgcctcagcctcctgagtagttgggattacaggtgcatgccaccatgcccagctaatttttgtatttttagtagagacgtgatttcgccatgttggccaggctggtctcaaactcctgacctcaggtgatccacctgccttggcctcccaaagtgctgggattataggcatgagccactgcacttggcagctctcctcatttataatctagattgttgaagtttttttcctacctgatttccagtcatctatacctacaatttttctgaactctgattatttatttctgttaggttgcagatgttaaattgaaattctttatcattttagagtcctctggtagcctctttttaaccttattacctacctatcatttttctttcttccttcttcccttcttctcttcccatgctgggagtgcgatggcgtgatctcggctcactgcaacctccgcctcccaggttcaagcaattcttctgcctcagccccctgagtagctgggattataggcacatgtcaccacacccggctaatttttgtatttttagtggaggtggggtttcaccatgttggtcaggctggtctcgaactcctgacgtcaggggtgatccgcccacctcagcctcccaaagtgctgggattacaggcgtgagtcaccacacccagccctttcctctgtttctccttctcttctttccttcctctcttccttctctccctctcttctctctccctcctccttcttctgccccctgaaatacttggacttcttttttttctttttcaagataggatatcactctgtcactcaggctggagtgcagtggtgcgatcttggctcactgcaacctccgcctcctgggttcaagctgttctcctgcctcggtctgccaagtagctgggattacaggcacacgccactatgcctggctaattttttgtatttttagtggagactgggtttcaccatgttggccaggctggtctcgaactcctgacctcaggtaatccacccacctcggcctcccaaagtgctgggattacagatgtgagccactgcgcccggccaggacttctttatatattggtattattgcttattcttaccaagtatgccatacattttcattgcttttccctcagtgtggaatgcgtctctactttttgaaattctgtttaatcaccaaccgtagattaaatgccatcttcttttgaagtcctcttcaattggaattaatacctaccttttcggctcttacattgtattttttgtatgtttcatttatattcttccttgtattataatattcctatcttgttcctacatggatatttctttttttgtattttaaagattcacaaattatttaactcattacaatgataatcaccagcaagtagtctttaagaaatattaacattaagctttttctttcaaagaaaatgccaggaacttaccaaatcataaataaaatgttttatctaatgaattttttgttagtataattctaagcaatctctttgttatgattttgccccttttaggctggatcagtgcatgtaagaattcgacgagatgccaatgaacaaatggttcttgctcatgtgaccaacaggctgtacactctagtgtctactctaactgttcaaattttcaaggatgactggattaggcctgccttattgtctgggcctgttgcagccaatgtcctaaacttttcagatcatcacgtaatcccaatgcctcttttaaagggtactgatgatttgaacccagttacatcaactccagctaaacctagtagtccacctccagaattttcatttaacactcctgggaaaaatgtgaacccagttattcttctaaacacacaaacaaggccttatggttttggtctcaatcatggacacacaccttacagcagcatgcttaatcaaggacttggagttccaggaattggagcaactcaaggattgaggactggttttacaaatataccaagtagatatggaactaataatagaattggacaaccaagaccatgatagactctaacttatttttataaggaatattgactccttggcttccaatttatttagtaatccaactttgcattgactgtttaatcatttactctaaatgttagataatagtagtcttgttcacatttcatgaaacctatgaaactatatttttgtaaaatgtatttgtgacagtgaaatcctcgtaaatgttaaaggctttaaataggcttcctttagaaaatgtgtttctttaaatttggattttggtatctttggttttgtagttgactgcagtgtgatgtgaccttacctttataagagccacttgatggagtagatctgtcacattactaagatacgatatttctttttttttccgagacggagtcttgctctgccactgtgcccggccaatacattattattaacttaaggctgtactttattaaggcttccttagtttttgttttgttttgttttttgagatggagtctcactctgtcgcccaggctggaatgcagtggcatgatctcagctcactgcaacctctgcctcctgagttcaaatgattctcctgcctcagcctcccgagtagctgggattacaggcacctgccaccacgcccagctaatttttgtatttttagtaaagacgggggatttcaccatgttggccaggctggtcttgaactcctgacctcatgatccacccaccttagcctcccaaagtgctgggattaggtgtgagccaccgcacctggccgatattttctttaatgaaatttataaatatgcttcttgaataatacacattttgggaaagggaaaaatgtctgttcaaaaagtaaaagtctcttttatagcttttccaaacttaattgctaaatttttctttgaggttctcctgaattatgtcttacaaactaaaagcaaaaatttttagcagaaattttggaatacattctatctagcacaatttgaatttttaattatcaagatttttgttaaagtttctctcctttaaaaattttagtacatttgtaaatagtccatggttctcagtgttttattttgattaagtgactacccaacttttggtgatatgcagtgaaagaatcccaattttctatgttacatttaatcaaatactgacataatgaatttatctttcctgacacattttcattcattggctttttaatttcttattttattaacaaaatatatcagatatattaccaaaacacatggagttccatacataatatggaatttgatgtcttttcaagttgcacaaagaatttgagcatatataattttaccaaagcataatggaccttagattatagaatacagcattgttaggtctgcagtgggcagtttctttttgttttgctttgtcaaaaatgggaaattgttaactgtgatgaaatgtgagaattacatagattatgttattttttagttgttttccaaatgcagagtttaaggactttctaacatggctagtattacttccaaaaagtataacaagcagcagtcacacatgacctaggagggttttttattgttttattttattatgcattccataacagttttaaaatgggattttgagaatggacttaactttcctggaatccaatgctcctggagatttatgactttcccagccatcagccagctatctagagaagatttttgtttttcttttgcaacagtttcttcagtcaactcattcactttcaaataggagcagcactttgaaatcctttttcttcactgtggattaaaaacatccaagaagccatctctgtcaagcagaattgtcatctgtggtaataagtgaccatgtcctaaatacctttttcttagtgaggagttggtcattgtctttggcatctgcaacccctgttcaggcatgtgacctgctaaagaaatacagcctacactaccttgactactggggaaaatgatacttcgtaaaatgtaataaggcaacctgttccttggcctttatcttatgttttccaactattactgtatctgttattggtctactattacaggatgattcttcttcctccattgatctcaactaaatatgaattagggtcatgcatgaaatctgaactgccgtgtcctgagttatggttaagaggtatgtgctgccaccccatgcatgtcttccccatccccataggattttaaagtgttcaggtaccaaacacagttctgtgtgaggttttatgcctacttcctcaacaccaattcagaggcaacacctgtgcatctgtcccaccaaaggtgctttaatacctaccttcactatttgagaaaggacactcacagttgcctgtgggttatgaaagaattggccctacgtcctgcatgtaagatgttacaggggacattgggccaggcattattatatagagaagtcttatttgccaagctctgactaacttctggatatgaaaataaggaacttgcccagcataggcctataggcagcagccttactagtaaatcttgccacagaatcacttgaagctagacagagaaagaagttcaatttaaatatttgtcccattgtttgtgattaggatgtaagctttgtggaatgtaattaaccctgctttacgaagtcaccatattataataggaaaaacactgcctaggaggcaagagatctgaattccagttctgatgctgccactgtgtaaggaagtagttttataacccatgggcaaatcatctgagctttctcatctgtaaagttagggagaggaattaattagttgatctgtaaaataatcagcttcaaaacgttatggctaaatctgtagaatgtatgcccaattgctaaacggatgttgtgcccagaattttatctagtgactacctcaacatacaggccaagcgttacctacaccaacacccaagccattaatttgaggtgccatgagaataggtgaaccacagcctaacaccatttaggtttttgtgtttttttcaggcttgcctctacttaaatatatttagatgagagagttctcttagacttctttctttgtaaggaagggttatttggggaagtgttggaaaaaagattagggcagggtacccttagtttatatagggtacaaaagaatgggaaacatcttccctttcttctttaatctctgaagtcatgtttggaattacatataatgtagcaggtactggagaggacctgaatttcaagcttctgatttagctgtttgtaaacttccaagttttgcttgactaaagaatgctgatcttttttgggagtctgatctccttctaatatcagaaagtgctttttatattccagattgcttgaattaaactgtttggattaaagaacatatatggagtttcctctctggtttta

SEQ ID NO: 727 - DNA, 58272 bp, Homo sapiens; identical to SEQ ID NO: 726

SEQ ID NO: 728 - DNA, 58272 bp, Homo sapiens; identical to SEQ ID NO: 726

SEQ ID NO: 729 - DNA, 58272 bp, Homo sapiens; identical to SEQ ID NO: 726

SEQ ID NO: 730 - DNA, 40432 bp, Homo sapiens
ttactggcttcgagtacactttatttaagcagttactagtttaaaagcacctgtaataacactgagatcatcatcatcaaattgccacccaacaagcctagcttcttgcagaaaagttaacttggataacacttggctaagttttctgactaatgctggatcaggtagaaattctttagtactaaagtcaaaaaacactaattgcttaagattctcaaatacacccatgaaggcaagccatccatcactgctcacacgatttcccgccaaattcaactgctggaagtttttcagagggttctttccaaaaaatgcacctgggtaaagaaataagtatattagttggaagaaaaattttttttaaaaaaaaagagaaataggttctacatttattttacatacttttttttcactctgaaatggccatgtttgaaccagtgctttgcctcagaaagaaattattaatataattctctatagctagggcagtgattgtgaatatggtctattatattttcctagagtataagggaatctgataaatagtgattcgtagtgaggtagcaacaatatgtaaatgaattacttttttttccccttttccttactcctaggaaatggaaggttgctttaattaaatattcagtacttgttttcaaaactggagtcaatctttggcaatattaagtcgtttcctcttctgaaaaagtaaacaccacctaactgttgtttctatgggtatgttcctaactgtaaacttgagtaagtgagcctccttcagtatctaaagatttgggtgtttttgtttacctgtttatgtataaccctcccgagcctcttcaggaagttcctccattccttacagaatagggcacctaaagtatttcctacatagggtaggtggatatcctgtctttctgatacacaaagaatgcacacacacacacatacatacaaaggatgtgtgtgtgtgtgtgtgtgtgtgtgtgtgtgtgtgtatacatacacaaatagtttagtgttcattctttatcccatgttaccagtttaggtggtactggaacccaagtgagtcttgcaataagaaaaaatacctttctttcaggttatttaccatcatacagattggccagtatacaacattaggatttcacaaaactagctctgtgttaattacacatattaaattgtgcaaagcgttagccctacccacctacctggccctttctggatgactaagttcaccttgaagtacagagtggacagacaggcagactggacatgggaactcttacttacatgtttatactccagagtatcacacacaaaatgcagaagatgtatgcctggtttatcaatccacattactcggctcatccgagctcatcttagtcttagtgtacctcacccaactttggagggttaatttgttgtatattaaacttgtgtttcttgggagatgtgtaatattagataatgttccagaaactgacccttatggaaatgaaggtccatgattcagtttggattccaagtaggaaaagaggttttaaaagttcctttccattgtctcagtgagaagaccactaaagagttcaagttaaagaaggaaagattcggtgctgtacaaccttaaggttagcaagcaaagactaaaaggtatctgctaccagtaatgagggcttaatgacagaaatggacagtcttgtccgaccagcttacgtgggtgaggtcaacctagttatgcactgaaactatacccttacccactttcagtaaaggtgtttaccagctccgtagtgagaggagatctgtgaatttggtgtctgatgtcactgcatggccttgtgtagtttgttcagtgcaactaagtacattctagagtgtgtccttagtcaatgtcagccaatgcttttatcaccatcataaggtcttgagtttcgaaaggtcttcaggttcttctttacagacacctaaagtgattggccctgcctgaccgtggtcaagatgctagcggctaaagtgggcaaagccaggtaaggagatgattcacagggttctgccttcatgtctcttacccatggtcagtgtcactgacaccatctttgggccttctttgccacttttattaatttgaaaagtgagacagaggccgggtgcggtggctcatgcctataatcccagcactttgggaggccaaggcgggcagatcacctgaggtcaggagtttgagaccagcctgaccaacatggagaaaccccgtctctagtaaaaatacagaattagccaggcgtggtggtgcatgcctgtaatcccagctattcgggaggctgaggcaggaggatcacttgaacccaggaggcagaggttgcggtgagcagagatcacaccattgcactccagcctgggtaacgagtgaaactccatttcaaaaaaaaaaagagaagaaaagtgagacagactgctagttgttcccaaaactgtctctccttattccatagttaatagagttttatttcggcatatggccactcatatcccaacctcccttgctattaggtgtggctaaatttttgccaaggaagtataggcagaagtgatgtgtgcaacttccatgtcacttttccgcttttcccctcttctactaggttgaaatgatcacagggcagtgacctagctatggccataaagtcaaaaataacactcttaaggaatagaggagtaaaaaaaaaaagtaggggtctgggcctgaaagactgcacagaggaaaaccaccccacctgcctggactgctcatttctggactgttacatgatagagaatcaagttctgccttctgtaagccatggtatagttgggtctctgttatcacagcgtagcctatgcccagcccaaatagtacctaggtccttactttcccctgccttccacctcctctgttccttggaggatggctttctccctgctctctcttccatctcatgttcatgtcctttctgcctttgccccttctccatatgcttcccagcatggcatgcactcagtccaaatgctggttgccagttgtgtgtctatttaaggctctttccccaaagatcaactttttttctccttctcagctagcagaacatattttcaccacctaaaaggaatttaagaagaatttaaagcccattccaccctcacagggtgagcaatttatagtggttatctactaaggtataaggatcttatcatcaatttaagagagtttcttagataattattggaatgtgtgctagtgcaggaaccaagaacaaacaacatttgtcataagccaagggcatgccttttgttcatttaatctgcagtgcttatgttatgaggagcagactagatccaagagaaacagaatccatgacatttagagccataggctgtatgtgggctgtggagagtgcaaatggcttgattggaattccaggaaaaatctcagatgccctgggtagaagggttctgattcttgggggttcctgtatcccaaacacaactcttcatttgtgttgtcctgtagttcacctgaacgagtaccagagttctcactgtttattcattcagcaacatctttagtgctactatgtgctgcggattatgctgggtgctggggatatgtgtaaacgacagacatggtccctgtctaaatgggcttacaaaatagtgtgaagacatgcattataaagtaattagatgggtggtgggtgctatggtaggtcagggtaccctgggagcacacaaaagcaataggctttcccactccactttgttcccagaacacttgcaattgggcttatatgctccaggaggaagactggaggattcttaggagaaatggaactgccccccgggaaaaggccctacaaagaaggggccattttgcttgcccaatcaccccctagtggagttagcctgtcaaaaattcaccgcctcccttagacacacagaactccctatcaacttgtgtctccctctaaaatgtgaagaggacagtgcaggattatcagacatttgacaacagcctcccacaaggaagactgagactaaaagccaaaacaactcccaaagaaatcaggcactgtagaaaacaagaaaaatcaaactccaaagacctaagtttttcagagatcctaagtttttcagtagactgcatctactcagcaacaataagatgctaagaaagagcttttggaaaataaaatatgatagcgggatctatacagcagaatgattgggcccaggatttaacacagagcttctagaacatgaatagggtctgcgatggctttttttttttctttttttgagacaggttctggctctgttgcccaggagtgcagtggtgcaatctcagctcactgcaatctgccccactggctcaagtaagtgatcctgccaactcagcttcccgtatagctgggattataagtatgtgcactacgcccagctaatttttgtatttttagtagagacagggtttcaccatgttggccaggctggttttgaactcctgacctcaagtgatacacccaccttggcctcacgaagtgctgggattacaggcatgagctctctttgagaacaggctggatagcagagttcagcttcaaacatccaagttgaaagataccatttaacaaagggttttgttagagcaggtgaaattggtcaggcatggtggctcatgcctgtaagcccagcactttgggaggctgaagcaggcagatcacttgaggtcgggagtttgagaccagcctggccaacatgatgaaacctcgtctctactaaaaatacaaaaattagctgggcatagtgcacacacttataatggcacatacttatagtggcggcatggaccggtaatcccagctactggggaggctgaggcaggagaatcacttgagattcagagaagcgaatagagaacagagaatcccaggaagcggaggttgcagtgagccaagatcgcaccactgcactgcagcctggaacaaaacaaacaaaaaaacaggtgaaatagatacctgagctagcaatgatttttatgttgtagtctcagattgctgatgggtaagaaacaaaattttgggagtcaagcaaaacatggcaaagcttggagatcaaatgcaatctctgaggaagaacagcagatagtctagaccaagctttaaggaaaactagaaacatttaatatctgggtagaggaatcaccattgaaaagaagactgagaagtagccaaggtggcatggaggtcaagagaatgttttgaaaagaagggaatgctcagtgtcaactcctgcggaggaatcaaataaattaaacacttctgaaagtgtctattgaaattcagccacatggaggggtgtggagagtcagatgcaatgagtagaaagtagcagatggtcaggaaatggagatgtcataagggtacataaaatttgttttagagcttttaccttgaaggagaggagagatagaatgataaccaaaggaggaagataggactcagggagagttttatttaaaatggaagagatttgagcaactttaaaaactgacaggagggagtcagtaacaagaggcacagtcaataaaatgatgtccctgaactggagtgagggtgaggctggcatctcaagcactgctaaagagactgcccttaggtaggagaagagaaacctataagctctaaggagaaggagagaaaaaaataacagtcacatcctctgtgaaataggagacgctgagtactgattgagaagaaaaaagtgtgaaatagtttacatacagtgttgaatacagaaacacagtaagattgccaggaaatattaagagagattgtgtttattcactgttttttgtttgtttgtttgttttgtctcccaggccggagtgcagtggtgccatcctgacctcaggtgacccacccgccttggcctctcaaactgctgggattacaaacgtgagccactgggcccagcccccgctattttttttttttttttttgaggtagagtctcactctcccacccaggctggagttcagtggcgcgatcttggctcactgcagcctccaccttctcggttcaagagagtctcctgcctcagcctcccaagtagctgggattacaggcatgtgccaccacacacagctaatttttttcatactacattttttaatccattcattatttgatggacatttgagttgtttccacttttgagctactaaacatgctattataaacattaatatacaagtttttatgtggatattggttttcatttatcttgagtacctaggaagagagttgctgggtcatatgacaactctatgtttaacattttgaacaacttgccagaatgttttcctcagcagctgcatcattttacattctaactaccagcatatgaatttctccgtatccttgccaacaacacttgttattgtatgtcttttaataaaaaataataaccatccctagtgggtctcaggtggtatctcattgtagttttggtttacattattaccctgatggctaatgatattgattatgttttctgctatttattttgcgatttacatatcttccttggtgaaatgtctgttcagattcttgcccattttacaaattgggttatttgcattttttatcagtgagttgtaagagtttttttgttttgttttttgacatggagtctcactctgtcacccaggctggagtgcagtggcgcaatctcggctcactgcaacctctgcctccaggattcaagcaattcttctgcctcagcctccagagtagctgggattacaggtatgtgccaccacgcccggctaatttttttgtatttttagtagagatgggatttcaccatattggccaggctggtctcgaactcctgaccttgtgatccacctgcctcaacctcccaaagtgctgggattacaggtgtcagccaccacgcccggccataagagtttttttatatattcaagatggaagtcctttattagataatgtgatctgcaatttttttttcacattctgtaggttgtattttcactttctttctttttctatttttttttgtggggggggggtgggggactgggtgtcactctgtcacccaagctgcaatgcagtggcatgatcacagctcactgcagcctcaacttcctgagctcaagccatcctcccacctcagcctcccaggtagctgggactacaggcgtacgctgccacacccagctaattttttggagattgagttttgccatgttgctcagactgggctcggactcctgggctcaagcaatctgcccacttcggcctcccagagtgctgggattacaggcgtgagccaccacacccagccttagttttgaccaaatgtctttttttctgttgcaggaactcatccaggataggacattacatttcattgtcatgtctctttaggttcctcatgcttatgacgatttctcacaatcaccttgttttttatttccttgacagtttcaaggaatactggtcagttttgtgtagaagtccctcagttaggattgtttgatgtttttctcatcattagatgggggatatggatctttggggaggaatatcatagaggtaaagtactattttcgtcatgtcatatctaggtacatactatcaacatgaatcaccactgttaatgttgaccttgttcacctgaccaaggtagtgtcaacagctttctccactgtaaagttactcttttttgctgccttttgctgcatgctacaagttttgatatacagcgttttcttaccattcacttctaaatattttcgttgaaatttgtcagtatgaacttgtatttatctcccaaattttgcagtttttccccagtatcctaagtgtagttacaaaattttaaaaagggaaatttaaggacaatccaggcctggggttttgtcaggaaagtacaccccatctactatatttcatttcatacctctcattccacatctcatgttctgcctgcatctcattaggtagtctttctttaattagagactccatctctcattacactcttcatttcaccattgcatctatcacacacatccatcactcaaagtcattgcctgaattgactcatgctactgtgggccatgagaatttcagctattaaagacaagaatgtttgcagggatggaagatggagttgaaactaggtaggaaggcaagtcaaaatagaaagggcctgaaaaataggtagaaggtagcgggatcgacggactggaagtcccagtgaagtaaaagaactggtgattaggagtagatagaaatacaggaggttgtggtttgagaatgggatatctgcatttattattttgcaggtagaacaattttaagtggcttgtcataatctagtcattgcatgctcatagaatgaatggatgaaggagagtggaagggaaggtcgttgaagaggaaggtccattagcggagcatagtggcctctagtcccagctacttgggtagttgaggaaggaggatcccttgagcccagaagttcaaggttagtgagctgtgatcacatccctgcactccagcctgggcaacagggagaccctgtctcaaagagaaagagaggggtgggggagggaggaaggaaggaaggaaggaaggaaggaaggaaggaaggaaggaaggaaggaaggaaggaagggagggagggaaaggaagaaggaagggagggagggaaggaggggaggggacatactgctttcactgtatcccataggtttcagtatgttgtgtttccattttcatttgtcttaagaaattttaaatatatatatatatatatatatatatatatttttttttttttttttttaattgtagagacgacatgttaccatattgcccaggctggtttcaaacttctgggctcaagcagtcctcccaccttggcctctcaaagtgctgggattatagtcatcagctaccacacccagcctatttcaagaaatttttcagtttccttctgaatttcttcattggcacacttgtcattccagagcatgttgtttaatttccatatgtttgtatagtttccaaagttcctctggttattggtttctagttttattctattctattatggtcagagaagatacttgaatcagatttcaattttgggggattttttaagacttattttgtggcctaacatgtggtctatccttgagaataatccatgtgctgaggagaagaatgtgtattctgcagctgttggatgaaatgctctataaatataggtccatttggtgtatagtgcagattaagtctgatgtttctttgttgattctctgtctgggagatctgtccaatgctgtaaatggggtgtcgagtctccagctattgttgtattgggttctatctctctctttagctctaacaatatttgctttatatatctaggttctccagtgttggggacatatatatgtgtgtgtatatatgggaagatgaagaagctctggagatggatgttgtgatagtggcacaataatatgaatgtacttaatgccacaaagcttttacacttaaaaacagtttaaatagggccgggtgcggtggctcaagcctttaatcccagcactttgggaggccagggcaggcggatcacgaggtcaagagttcaagaccattctggctaacacggtgaaactccatctctactaaaaatacaaaaaaaaaaattaggcgtggtggctggcgcctgtggtcccagctcctcgggaggctgaggcaggagaatggcatgaactagggaggtggagtgtgcagtgagctaagattgcgcaactgcactccagcctgggcgacagagcaagactctgtctaaaaaaaaaacaaaaaacaaagaacaaaaacagtttaataaattgtacgttacgtaaactaaacacattttagacaatctgtaagagaaatgaaggcaatcgaggctgttttcacaagtccttggctttagtatgatagcttccaagttgaacctgatgagcctgacctccttgtattaatgtttccatacgctggattggaataacttgtgcaaccagtgggatatgtcagaagtgaccagaaatgagtgggctgccatgttgtgaggacactcacagcctgtgaagaggtctaatgatgaggaagtgaggcctccagccaacagccagtgttaacttgccaaccatgtgagaagctaccttggaaggagatcctccagcagcccctctcatgagagaggtcaagccagagctaacctgctaaactcctaaattcctgaaccacagaaactgtgagataatggttattgttttaagccattatgttttgaggccatatgttatacaggaattgaaaactaatacagatagtatgaaggcttctttcatcaactgcctgaggttggtggtgtcttcagtcatttatatagatctatttgtttctggataatattacagctatttaaagatattttgtggctctatttagatacagctacattcgcctttatatgttttgaatacccagtaagtaacttgaaaatatttcctgatattggagggaggggcattgctgaatttcagaaagttaaggctagtaagagctatgactaatataatacatcttgttggatactgtgaatgcttttcatttaattctgtaggtaaaggaaatagaatctgaaggaaggccagtgttttaagtcttcttactctaacgtgaatgaattcattagacatatttatattttaaaaaaaagaggaagcaaaataaaataagggggcaaaataagcaaagccaacttaagaattttttaagggccaaatccagttatcttggctctgtatgtgtgtacctacctaaaattctaatctctgtatctgtgagtctccagtttttcaacccaagcttgacgagttgtgggacctcctccaaatgtttcaacaggctgctcaggctgccttgcacgtcacagccccagggcagcatcagtgcggtgagctgttctagcacgttcatcctgtcgactggaagaaacaaagagcagttcagggactggatggtctcaaaactgaggaagaacaaaggggtgttaggggaggaatgatctttatgtttggtggctctgcagcctactcaatctgtaatgagaatctacttaatttttggtttttttttggaaagtattcaagcatatacaaacattatgcagaagaatataatgaaactatatatactaataagacaccttcaaaaacattaaatcatgggcaatcttgcttaatcctgacctaattcctcctgtattattctaaagcaaatcatggacaatatgaatcagttctttccttttttttcttttaaccataatcacatatcactatcacacctaaaaaatcatatcaccaattccttaagcaaatttgtcttgcacatcggctactcttgacagttgcctcttcaaaggaggaaagcaggtgggataccgcctcaaagtgcagtgagcatatgtaaactggtgacttaaaagacatgggcctgtgttccttaagggcagtttaagaaaggcctaaatgattttcctaaggagggtgcatctagtaaggcacacatgggtataaaagacctcaggacccaggctatgtatttcgactacccagtatacatattcaagtatctaattttggctgaattgtcattcttactcagttcatgaagagcttcatttccatctttttccaggtaattttctgataaatcaagaatgctcagtttgaccaaattgtgaagattctgagctggggaaaaaaagtaatccaaaataaaaagattttcaggtaaatataaatgtattttgaagtatccttagaataattctgagttttatcttctctgctaatggtagtgcaaaccataacttgccttggttattttaattatttccaaaggctctggtgtaggtgtaacccccaaatcccatggttatgaccaaatgggcaaatagtcattggtcctaggttctgattaatgaattccaggtcacgtagaacctaaagcagcatgggatgtagttgttatgtcatcatggaaaaatcacttggtctctctaagcctcaatgtcttcctctatagaatgaggtagttggaccagataaaatgtaaagttgcttcaattataaaatgccgttaatcatgcaggagaaacaggaacaacaacaacaacaaaaatgaaatgagctggttttgtgtacctcaacttagatgattttattgacataatagttgagatattaataataaaaacatagtaaaaaatggatgagaaaaaaaacaaatagcaaaatggcagattcaaatttatccatatcaacaattacattaaatcttaatggactaaacactccaattaaaaggcagagataatcagatattcagaactttttttaaagcaagacccagttttatgctgtgtacaaaagacgtgtttgaatgacaaagacacaaatatgttgaggtaatggaaaactattttgcatgcaaacattaattatataatagtaccagtctagctaagaattgcttagtgcttttcttcacatattatcactcttgcttaatctagctgaagttttttctgtcagggctagaaaaatctcctttttaaaaaaatcagacaagtttttcatgaatatgtactcttgttataatattggctattattatttttaatcaatcatatgagcccttttcttaaagtatcttctgggttttgtgctctacaataaaaaacctgctgaacttctctttaaaagagtacgtttgctatttgcagttctaagcctgtctctccccatcagtaagtagagaaataaaggcatgtgctcattgttctcatattcccagtacttatccagcctttttcaactgtgggtttctctagctgtaactttatattagtatacaaatggcttccttagttatctttagagactcccagcagttatatagtttaactttaaaaagattataccactgttttccaaaatctaaattttaaaatatgtctgaattacacatgtatagtttatccagaaatatgcagttagtttccccgtagttgatatgcatccctttgggaactcagaaggctcaattatcatatcatgcacattaacttcatcttaacagggcaatgggtaggaattagaagcctgagatcatttaagaaaatctttatctctcacttctcaatcatttatccattcatttaaatgtttattaggcagtaaattatatgaccggttgtgtggcaagtttcaagcacctatttcttattttcttccttttcactttctctaaaaattacatcttcaattattctgaaattctcccctattatccatcaatagttgatttaattctaatatggagaaaaatcattaaaaacaatctgcttattatcgagaagtttttattttccagttttccttaaaattaaatttccatttgagacatttagtgtgaattagtataatagtatcacatgttctgttatactgtcctcattcagttaatggaagcaacagttacctaggattttcactgcatttgcagacaagcagcaggagactaattgaatttcttcaaggtcacagggttcacttgacagagacttgactatgtaatccattccctctccaatgtcagacaagtgggtcaaatgaaataaacacatcttcttcaggtttttcaggccttcagctgaaaaatgatagaaaggaatgcattaggataccaagttaattcgatttaagcatagattaatgaactgaaaagaaagcaaagaataattgtgcagagaccttgccatgttcttcctgcagcgactttaagttacaaagaatcaacgagagctttttttctttcaattctcactttccagtctcttggaccacacaaaaaatcacttatatggaggttattctcttagtagcatgagaaacactgtagtaaatttgtagtctttttaatgggcatcaatgtatactcttaccgtaattctttacatgaatgaagtcttctagagcactctcctttcaatcttctcaaaaatcttaaacagcgggggggctgagttcagggaggtagatgaggacttggctccttggagtgcttctagtgcaactgtctacagcctcaaaagccttgcctggactcatgatatggggcctgcctgaagctttagaatgaagaccacatccactgcagcatgtttaaccagaagaaagatttaccttatatcaacagtataattggaaacattctaaaatatcccccgttcttaagtctaaagctaatgtgcagtttaggattggttaggcctcactttgtgtcattaaaatactgtcttatcttgatggtactgtagcctacgggaaagaaatatatgattttaatgaccaggcatggtggctcacacctgtaatcccagcactatgggaggcagtgataggcgaatcacctgaggtcaggagttcaagaccagcctgtccaacatggcggaaccccatctctactaaaaatacaaaaattagctgggcgtgatggtgcacacctgtaatctcagctacttcggaggttgaggcattagaatcgcttgaacccaggaggcagaggttgcagtgagccaacatctcaccactgcactccagcctgggcgacagagcgagactcccatctcaaagaaaagaaaagaaaagaaataaaatatatgattctaataatatcagtcttgcagagctttcgggaaggttgcagataatgtacgttaacatatttaatgtggtgcctggcacatagtaagtgctccataaatgttcattgttgtcatgggagtatataccggttaaaggttgtgagcatgagctttgcagtcagttcctggatcccctacttaataattataaacttgggcaagttattcaatcttttagctgaagcgttagggatcattatatctatgtactaggactgttgtggggattcaatggaatgaggtatataaaactgccgaggctagtgtctaatctatagcagagtaactctttaataaagagtaaattattactgatataattagactggtttagtcaagttcacattttgattccttaatagcagaagcaggctatcctagagaggtactttttgacctctttctaccagttggtaagatcttgagcaagtcaataagctattttaggttctagtggagttttctgtgaaatgaatgagttgaattagatgctctcaatccccttccagctctgattttctgtgtaatttatacacatgcaataaatgtttattgaacactgaattaatttgattattctcacgtaggacatataaggaaaagaagtcagccatgttttgcttttgtttttgtttttgtttcaagatggagtctatctctgtcaccgaggctggagtgcagtggagcaatctcggctcactacaacctcctcctcctgagttcaagtgattatccttcctcagcctcccaagtagctggcattacaggtgcataccaccatgcccagctaatttttgtatttttagtagagacagggtttcaccatgttggccaggctggtctcgaactcctgaactcaggtgatccatctgcctcggcctcccagagtgctggaattacaggtgtgatccaccatgcccaggcttcagccatgtttggcttataggctagagttgtctttcggcaggaagcagaataagaaagaacaagatgaagggaagagaggagtattttagtgaggactcaagtagggaaaaaaagagccaaaaaaaaaaaaaaaaaaaatccaacacacgagaaaacagggacattcaaggaaagcagctttaacaggaatcctccctggcctgcagggcctggttccctgtggtaagccatgtgttctgcttgtgttcctgaagtttccttttccttttcatttttttgattggggaaacacaacctgcagtgtagaatgaaagcatgcttcccccaaagttttcttgattcacattgtttcctgtgtcctatttcatttatgaatttttttaactatgaaaccatagtataaactttaaaatattgtttctatgcaactatgaaactatactataaactttaaaatattgtttctatgcattaaataaaaacatagccaatgagccagggagacggaagttaaaaacacgtcaggggctctcttcccaaaagggttaccatctggtgttgtacaatttgaataaaatgatgctgaaggattttaatggcagtagggaaaatgtctggggaaaccaatgtagccacaagtacataaaaacatccttgccttgtgcagacacagccaatgtcagagcctgaagttaactcctcttattatcaaacttacattgatacaaatatgagaacagaaatctgacctagttttatagcatcttcttcattcatctttatgttatccattatgagctttgtaaggttcttcaagttacccaagctgtcagtcagaccacctgtcaaaagaaaaaagattggactctttcagcagatatttgctatttactatgtcatttactattactgtcatttttgttaccaatcaaaagattttaatgatcatcatgagccaaaaatgctcatgaaatagacataaaaatatactttttataagagatgggcattatacttcactgtaagcatgttctgcaaataatagactagataccaatttcccagataacagggaaaaaaatttcctttttttttttttttttttttttttgagacagagtcttgctctgtcgcccaggctagagtgcagtggcgcaatctcagctcactgccagctccacctcccgggttcacaccattctcctgcctcagcctcccaagtagctgggactacaggcacctgccaccacgcccggctaattttttttgtatttttagtagagacggggtttcaccatgttagccaggatggtctcaatctcctgacctcgtgatccgcctgcctcggcctcccgaagtgctgggattacaggcgtgagccactgcgcctggccgataacagggaaatttctaaacacttggaaattaaacaacacatttttaaataatcatgcattaaagaagaagtctcatggaaactttgataatattttgaaaaatataaaaataaaaacaaaacttcaaaatctgcagctctctcctcacaaaggggtgaaaagaaaaaaaaatctgcagctaacacagtgcttacagggacatttacagtattgcatacttatattagaaatgaggaaaggcctcaaatcaacaacctaggcatactacttaagaaattacagaaaagagagcaaaataaatgaaagaagaaagaaaataataaagataagggtgcaaatcaaagttattatgcctttattatacaaattaaaaacagaggcaaggtctcactatgttgcccaggctggtctcggactcctgagcacaagtgatcctttggcctcagcctcccaaagtgctaggattacaggcgtgagccaccatgcccagcccagaaatcaaaattataaacaggtaaacaatagaaaaaaatcaatgaagctaaaagttggatctttgaaaagatcaataaaatttaaaaatttctaccaagactgacaaagaaaaagaagacaaaaattaccaatatcagaaacaaaaaaggggatatcactacacacactgcagatattaaaaggacaattagagaataatataaacaaatctatgcacataaatttgacaacatatatgaaattgaccaattttttgaaaaccacaaactaccaacactcatgtgatacggagtaggtaaccggaataaccttatagctattaaagaaattgaatttgttatctaaaatttcccggaaaagacatctgtaggcacagatatgttcacttgcaaattctgccacacattttcatttttttccttctatcaactgtcttcatatctaccacacatttaaagaagaaataacaccaattctacacagtcacttccagaaaatagaagtacaaagaataattcccaactcattttatgaagccatcattaacttgatatgaaaaccagaaaaagacgtagaagaaaaacttttaggccaggcacagtggctcactcctataatccccgtgctttggggggcagaggtaggaggatcacttgaggccaggagtttgagaccagcctgggcaatatatccagaccctatccctacaaaatattttttaaattacccaggtgtggtggcaggtgtgagtagtcctggctactcaggaggctgaggcaagagaatcgcttgagcccaggagttcaagattgcaatgaagtgtgatgacaccactgcactccagccttggtgacagaatgagacaatgtctttaatgaaagaaagagagagagagagagaatagagaaagaaaggagggagggaaggacggaaaagaaaagaaagaaaattgaggctgggcgaggtggctcacacctgtaatcccagcactttgggagggcgaggcaggcaaatcacgaggtcaggagtttgacaccagcctggccaacatggtgaaactccgtctctactaaaaatacaaaaaatcagctgggtgtagtggcaggcgcctgtaatcccagctagtccagaggctgaggcaggagaatcgcttgaacccaggaggcagaggttgcagtgagctgagatcgcaccactgcactccagccctggtgacagagtgagaccccatctcgaaaagaaagaaagaaaattaaactttagaccaatatcattcatgaatacagaatcaaaaatcttcaacaaaatagaaaatggaattcagtcatgcataaaagaatattacggcaggcgtggtggctcacacttgtaatcccagcactttgggaggccgaggcaggtggatcacaaggtcaggagtttgagaccagcctggccaacatggtgaaaccctgtctctactaaaaatacaaaaattagctgggcgtggtggcgcgcctgtagtcccagctacttgggaggctgaggcaggagaattgcttgaacccaggaggcggcggttgcagtgagccgagatcgcatcattgcactcagcctggtgacacagcaagattccatctcaaaaaaaaaaaaaaaaagaatattacaccacctccaaatgggcttcatatagggaatgcaggatgctcaatatgtggaaatcaatccatataattcattatattggcagtctaaaagtaaaactacgtgatcccataaattgatgcagaaaacacatgtgacataatccaacatccaggctaggtggctcacgcctgtaatcccagcacttcgggaggcccaggcgggaaaatctcttgagcacaggagtccaagaccagcctgggcaacatagcgagaactcgtctctacaaaaaatttaaaaattaaccagatgtgatagttcacacttatggtcccagctagtcaggaggctgaggtgggtggatctgttgagcccaggaagtcaaggctacagtgagctatgatcacgccactgcactccagcctgggtgacagaacaagaccctgcctcaaaaataatctaaaaataatttaataaaaacaatccaacatccatccatgtaaaatgacatgatcatataaatggatacagaaaacatctttagcacaatccaacacctattcatgaccaaaaaaaaaaaattctcagcaacttgataaaagacacctacaagaaaactacatttaacattatacttaaaggtgaaagtctgaatgctttctccctaaggtcaggaacaaggcaagatgttaattcatgtcactattcaacattgtactacaagtcctagttagtgaaataaggcaaaaaaaaaaaataaataaaaggaatacagattggaagggaagaatttaaaatcattcttttcgaagataacatgattgtctatgataaaaatgtcaaggaatctacaacacccccttctgcaaaccccacaaaaaaaacccttctaaaactggctgggtgcagtggctcatacatataatcctagcagtttgcgagactgatggggaggatcacttgagcccaggagttcaagactggccttggcaacatagagagacctcctctctacaaaaaagaaggaggaggaggaggaggagagggagagagggggagggggaaggagaggggaagggagaggaagaaggaggaggaggaggagaaggaggaggaagaggaggagaatgagaagagaaaaaattagtgaggtagcgaggtgtggtggcacatgtcagtggtcccagcgacttaggaggctgagcattatgtagaaaatgggattatagaccgggcacggtggctcatgcctgtaatcccagcaatttgggtagccgaggtgggtggatcacttgaggtctggagttcaaggccagcctggtcaacatggtgaaaccctgtctctattaaaaaatacaaaaattagccaggcgtgttattgggcgcctgtaatcccagctactcaggaggctgaggtaagagaatcacttgaacctgggaggcagaggttgcagtaagccgagatcacaccactgcaccccagcctgggcgacagagtgagactccttctcaaaaaaaaaaaaaaaaaaaaaaacagatgaatagaggtcattatggtaagtgaaataagccaggcacagaaagacagacatcacgtgttcttacttatttgtaggatctaaaaatcaaaacaattgaactcacggagagtagaaggatggttaccagaggctgggaagggtagtagggaggaggtggaaatggttaatggatacaaaaaaatacttagaagggataaataagatctagtatttgatagcacaacatagtatctaagtcaaaataagttaactgtatatttaaaataactaacagtacaactggattgttcttaacacaaaacataaatggttgaagggatggatactccattttccatgatgtgattattacacattgcatgcctggatcaaagcatctcatgtaccccataaatatatatacctactatgtatccacaaaaatgaaaaatagaaaaaatttaccttatagggttaagacatctaaatgagttgatacacgaaatttgcttcaataatacctgtatgtgttcaataatgttggctatcgttatgtatacctttaaaaaatcaacaggttggggccaggtgtggtggctcacacctgtaatcccagccctttgggaggccgaggcgggtggatcacctgaggttgggagtttgaaaccagcctggccaacatggtgaaaccccgtctgtactaaaaatacaaaaattagccaggtgtggtggtgcatgcctgtaatcccagctacttgggattctgaggccggagacttgcttgaatccgggaggtggaggttgcagtgagccaagattgtgccactgcactccagcctgggtgacagagtgagaccctgtctcaaaaaaataataattaaataaagtaaatactttttttaaatggcaaacattaaaaaataattataaacaccatataggccaaattcagcacataggtgatcactttacaggatcagtataaaagaatagttgtcatgagtagatggtgagcttcctgacacagaaggtagtctaatacagtcttcgtgacacccagaatcttacagaagggattccctcattagggaggaggtttcaaagattatctgtacaaaaaattctagaatcttaaaatgataggaaatttctctgtagggtgacaagcaaggcagagctgggtgggaaattgctagcgtttgaaaactaaccccagactgctacagttaagtacagcaagattcctgcttcccatggcttcacaccacatagcagttcctgctcggggcaaccaggctggtctacacaggtagggcagacattctcctttagtgttatttggaatttggggaagtatccccgttacccagaaagattgccctcgcatatctgtgtctgaagtctaaaatctgaaatttcatcatgttagacaatattccccaaatcttctgtcattcattcttctttttcttttctttttggagatagggtcttgctgtgttgcccaggcacagatatgatcatatcttgctgcagcctgaaaattcctgggctcaagtgatcctcccacctcagcctctggagtatctgggattacaggcatgcaccatcacgcccagatgattaatttttgttggagacagggtcttcctattgtgtccaggctgatctcaagtaatcctcctgccttggcctcccaaagtgttggaattacaggtgtgagtcacctggcctggccccaaccaagtaaacaacagttagggtgggaacggagctgagtatcttctacaatttcccagatgagaatcttgtaacacaattagctcctagctcctgcaggtgattaatttacaggttggatttcctccaagacttgaagtagggcagggtgccacttggcagggaaggactgggtattgggtagagatgggggtgctcgcaggagaaggatttgctgaagacaagcttaacctgcgtatatatttattttttttaatttttttttttttttttagacagagtttcactcttgttgcccaggctggagtgcaatggcgtgatctcggcccaccgcaacctccacctcccaggttcaagtgattctcctgcctcagcctcccgagtagctgggactacaggcatgtgccaccacgcccggctaattttgtatttttagtagagatggggtttctccatgttggtcaggctggtcttgaactcccaacctcaggtgacccacctgcctcagccttccaatatattttttaataaaaatatttttagtatatttacatttttaataaaaatagttttaatatatttaaacacatacatatatgtatctatgtatgtatgtgtatatatatctttccaatcagactacagctctgggaatcttccctatggctcccaatctaacagctttcccccaacatagacctctctccacagcccttctaccttcctttcaagtcctgacacctggtagaaactactagaaaatttaaaacaaaactaataaaaatgaaatcatgtcttttgcagcaacattgatggaaccggaggccattatcttaggtgaaataactcagaaacagaaaatcaaataccatatatactcacttacaagtgggagctaaataatgtgtacacatggagatagaaagcagaatagacatggagacttggaaaggtgggagcgtgacagggaggcaagggatgagaaataatctgataatggtggttacactaaaagctcagatttcaccaccacgaaatatatcgatataacaaaactgcacttgtaccccctatatctataaaaataaataataaataataaagcaaaactatatatctaacattttcacagtattcctggctaatatttccagccagtcttgattatagctgtaaactaaaaatcctaagccccccaccaactgaatgcatcccctctgggctaaggagaccccagaaaaaaaccttaaactcagttcctggccatgacaggatgggaggtcaaacacacatcattatactccctctcttgtatggtttgaacacaactcatcagcattactgttgacatagagatcataagactaacagaacagactttttgtggcaataaattaccaagttataaagaggacataagaccatgccaggcaaaggctaagtcattcagctctacgcttaaagaataaactgtcctaggctgggcgtggtggctcacgcctgtaatcccaacagtttggaaggtggaggcagtagaactgcttgatcccaggagttcaagaccagcctgggaaacatagtgagacctcatctccccataaaaaatcaaacaatgaggatcaactgagcccaggaggttgaggctgcaatgagctgtgatcgcaccactgcactcccacctgggtgacagagcaagacccaacctcgaaaaaaaaaaaaaatttaaaaagaataaactctgtcgtaactgccacagatttttcttctttggtagctaaacaagcattggtctcaagataagcaatattgatagttgtgaatattaaacaattcgcaactcatccagctcacaaatgctaacaatccctgttccatctgccataactacagctttgattggagaagagagtgatttcagtaactttctcctgatcagaggaccaccaaccacagactggttctggctggtttacagagattgcgtacctgcttacctttgtgctctgaaaagaacttctgaagtataggcctaattgtaatacatttaaatcatttaaaggggtgtacaatcttttggtttccctgggccacattggaagaattgtcttgggctacacaaaaatgaatttgtgctgggccacattcaaagccgtcttgggctatgtgcagcccacggactgcaggttggataagcttgatttaatgctaaatctccaccccaaagtgaacatgggttgtatgttacatgcatgtttattcaatatgcatgtatcaagaccaccttcatgaatattcatagctcctcctgtaatctgttgaatatgtatgtttagccaacccattcaacataaagtgtctaccccaacccctccttcgaggtgcctgtctctggtcttggttggaggcatgtttctcagcctgtgggatggccaccttgcaggctgtaaccctttagaagaaataaagtctcctctctccttttccaaatttatacactgttatttttttttaagtgaacaaagcacaaaccactgatatttacaatacccggcagccgttgattctgtaggtcatgaatactcaaggttttcaggtttgttacagatgtgatgtgcctctcatcttctatggtgaggggactggcttccaccatgagagaataaatgttcttacaggtgctgaggaccaaactgaggcttccagccacaccagcacatctctttatttgcagcctgaggcttgtggcagagctgaatattttccccagatatctgatatcttgcttattcaacttgctgaaatcccggagtgtgacctccagagtcctgaattcctgcttccagttgaagaacaaagatacagccctgctgggaatgtaggtttctggggcctcttccatgtggattccacctgtgtcttctgcagccttttcccatgaagccatagctcccccataaaagtccagtttaatgaagtccagggcacttgcacaattgggcaaatgttcaaagaagtcaaataagtaatcggggatgttccctgagttgatatataagcttttaccttgaaagaaagcttcaaattcttggctcagggctgatttggatgtactctcttgatataaatggatgccacactctacaaaggaattgatgtttatggctttcagaatttcttgctcagtggtgtttttcacactttgcaaagattcctgtctccagagaggcctcttggcgatggaaagtccgagaaggcagccgtgttgatacactgctgcgaggtgcttcataacagccctggtggcttccacagatgacccacaggtgtaccggagcaggctgctataagtggatgtaatgtccgaaatggaaaccattttctgcaagtaaccattccccttggtcacctcctctggctcatgagacgtcaataaactgctgagtcttcgtcctgctgtgtactcctggaatgacttgtgaaagaatttatactttggcttgaacctttgagctgtatatttacagaggagcccagttgtcagcaggacatcctcattcacgctggacacatcctgcagttcgaaatcaaacttgtgggagaacacaccctccagagctaggtctccacagtggtccaggctccgaatgaagtcacttgcagccacacctttatgtttgtgtttgtttttctgtatcaacagatcatagaaggtatggaacagcgttgtttgtgtgtgagagtggaactcactttcacccatctggattgcacaagtgatgaccacaaagagaggggtcttcatgagattcctcaagcacctggatttctgaatttggagcaacaagccttcagcaagctccttgatcagcacttctcggatgagagcctgggcgctgtcttctgtcatatcccccacctcagcagtcagggcaccaaactgccgtatgtgcctcaggcactcagtggtagtggtgacgatgaccatgttcttgaagcggtggttttcctttatcagggcttcgatttctgggcagttctggggcttgaattcattgtagccatcaagaaggaaaagaaccctctgccgcagcttcagcagcatggccatgaatgtctgcttcctgattgtgccaggtatatccaggagttgatcacagagggtttcaaaaagtccaccctgggccctgctgagacggaggaagaagacgaatttgaacttggtcagagccttgcactttccggagccccagagcatggcaattcgctgcagcagagtggacttgcctttgccagattccccttcaatgatgcaggggctctgaagagcctgcaggaggccattcagggtcagctgctccacgcggtgatggtgttggtccttcctccacaggacaggttctgtgaaggtgcttttcaagttaaaaataatgtcaatatcttcaccaaggggataaaagttcagaaaagatggggtatggtacaagtcctttaaatcctgagccaaatcgtccaagtctccttctgatgtctgatgaaaaagacctattagagaagaggtgatgttaaagaagacccaattctgtgtctcctcaaaacctagagttcaggaggatgaacgggggggtgaggctgagaatctgccattggtgaatgtaatgtcctttcccagttctgagctggcacaaagggttctgtctgctccccctttccccagcatcctttaccccactcccctttttgctttctgtttcctcctttccacaaccaaatcttatagcagctggttggaaaagggaggagcttgtttttgggttaaggaaagtaaagaatttggcagagaaagatggttagggataattgtcatcatagtaggccttcactctgagtaaaatctgtcatgaccttatttactaattaaaaaaataaaaacaatattttatgaaacatagaatcatggttctgtgtcagtcaggctgtctttaccaggaggcctggacatggagtaggtagtcagctgggcctctctcccataggtagatctcatccaaccagggaatgctgagaaccactgctgcactggaagcttaactagtgcacttattctccagttttatcttgcagtgagacaatactcaatcatttatttcctggccttggggttatttgtttggcttcaccatcaattgatctactatgagtttttcctaaaatcatctaagcttttccttagcaggtatcaaaggccactgccaggtgatatgaagagaaggaaaagcagaggctctgccatggggaagatggatctttgttgtggtctattctacttgcagaaacagatgcaaaactaactgatacttactttgtccattcaagtcctgaaatagaggatagttccactccttaagggatttaagaaagaggttacaggactctgaaccctttttcaaaatcatgtgaatgatccctctagcagcatcctgctccaccttctcgcagcaaatgatgtttacttcttcgcgattcagaacattccatacaaataggtcatctgtgatttgctttataacagtcattcccattctttgaataagggctcggctattgtcctttatgaaattcactgaggagatggggagaaatatacatatttatttacttatataaaatgtgcatatccggctgggcacggtggctcacgcctgtaatcccagcactttgggaggccgaggcgggcagatcacgaggtcaggagatcgagaccatcctggctaacacagtgaaaccctgtctctactaaaaatacaaaaaattagccgggcgtggtggcgggcgcctgtagtcccagctacttgggaggctgaggcaggagaatggcgtgaacccaggaggcggagcttgcagtgagctgagatagcgccactgcactccggcctgggcgaaagagcgagactccgtctaaaaaaaaaaaattaaatatgcatatcagcatctgtctccagagcattagggccatgcatttttttcctgtgagcatctcctgagttatggagatgccaaatgcctgaattccaggccttcaagaaatgctctgccaagcattttttttctgagacggagtcttgctgtgtcacccaggctggagtgcagtgacgcgatctcggctcactgcaagctctgcctcctgggttcaagcaattctcctgcctccgcctcctgagtagctgggattacaggcacgcaccaccacactcagctaatttttctattatttgtagagacggggtttcaccattttggtcagactggtctcgaactcctgaccttgtgatccacctgccttggcttcccaaagtgctgggattacaggcgtgagccaccgtgcccggcctctgcaaagcatttctaaccccagagttattgatgagcaagatgttttgctttggtgaagaagtaaggtgagttatcttgtccctctgatataaagcagtccccagtgaggttgtagttgtaagaccgttggctttagaataatggcaatggcctaggatctgccacttgctaccatctatgtgaccttggcaagtcactaagcctctttgagtctatttcaattacgtgctgctggccgggtgcggtggctcacacctgtaaccccagcactttgggaggccaaggcgggcggatcaccagaggtcgggagttcgagaccagcctgaccaacatggagaaaccttgtctctactaaaaatgcaaaattagccaggtgtggtggtgcatgcctgtagtggcagctactcaggaggctgaggcaggagaatcgcttgaacctgggaggtggaggttgcggtgagccgagatggtgccattgcactccagcctgggcaacaagagcaaaactctgtctcaaaaaaaaaaaaaaaaaaaagtacgtgctgctaaatgtttcacaaactggccctggccctctgggagtaaaggccctaatttgtagcattcaccaatccccaaggtataaatattcctaccatggcctatttcaagctaacagcgtatgttaactggctaacaaaaatcctgaaaattcaataatcaggtttcacatcacagtaacaaccagctccagcacactggggattcctcatctgtacaatggtgtcaagagcattatttaacttaggaagttgttacaataattcatgtatagtatctcatacaaagtaataactcaatatatgttagctactatttttagcctttattcaggtgtcaccagacaaagagcacattgtatctccacagactttggtcttttctgaagagtatcacatcaaaacactggtttttatccaatgtaagctctctcgccaggtcttgagggtagctgtgtcctttttgtgtctgactctgcaaggtctaattctgaaacgtagaccacaccgtacccaggcactgtacccacgctatgtttgtgacagcttggagaaatgtcttcctggtttttaactctcagacaccgtctgcactagatttcttcctgggctaggctgctcctggttttttttttttttttttttttcagacgaagtttcactgttgctgcccaggctggagtgcaatggcgcgatctcagctcaccacaacctctgcctgccaggttcaagcaattcccctgcctcggcctcccaagcagctgggattacaggcatgcgccaccacacccagctaattttgtatttttagtagagatgagatttctctatgttggtcaggctggtctcgaactcccgacctcaggtgatctgcccgtctcagcttcccaaagtgctaggattacaggcatgagccaccgcacctggccgctcctggctttcaaacctgtgttgactgatcagagagggaatgcactcctctcaaagaccccagaacctctctggcctgaaatgcaccatcaatcactccaagcaccaggaccccaccccagccgtcctttctcaccattgcagagctctgctgctgacctcagctagaatattccctgtctacatgtcctgcaagagtcccatctctctccttctggggtctcatctgttctctagcttccacatcatccctatggaagtaacctctaagtctgtgtcccattgtgatcttcagtttagagctaaagaaatacagcctcacccgggcgcagtggctcacacctgtaatcccagcactttggaaggctgaggtgggcggattatctgaggtcgggagttcgagactagcctgaccaacatggagaaaccctgtctctactaaaaatacaaaattagccagtcgtggtggcacatgcctgtaatcccagctactcgggaggctgaggcaggcgaatcacttgaacctgggaagcagaggttgcggtgagcccagatggcgccattgcactccagcctgggcaacaagagcaaaactccgtctcaaaaaaaaaaaaaaaaaataagaaatacagcctcagaaaggcttagagacccacacacacacaagttcacagcctagccttcctgagactacctttcttcacctataaaatgaagacacgttatttaaaatactctaattatttaaaagactcattatattgaataagtcacataactctcatacccaaaaatgtcttaaaattggaaaagtggctaggcgtggtggctcacacctgtaatcccagcattttgggaggccgaggcgggtggatcacgaggtcaggagatcgagatcatcctggctaatatggtgaaacctcgtctctactaaaaatacaaaaaattagctgggcatggtggcacgcgcctgtggtcccagctactcaggaggctgaggcagaagcatcgcttgaacccaggaggtggaggttgcagtgagccaagatcacaccactgcactccagcctgggctacagagcgagactccatctcacacaaaaaaaaaaatttacaaaaaaaaatatatatataaacagtaagatattattttactatgttatatctccttgtatgtagaccatcatactccttccttatcaagtaattaggtggaaaaaatgctgctcatttattcattaattattcattcttttcagaatatctctttgtctagaccaatgcttttcaatagaactttctgtgataatgaacatgttctatatctgcattatacaatatggtagtcattagccacatgtgactactgagtgcttgaaatctggctacagtgactgtgcaactgaagtttacattttattttatttaaattcacctttaaatagctacagagggctagtggctactattaatatactagatagtgcaggtctacacccagccatttaaagtggaaggagctacattttggttgccacttagatctataccatgtttcttcacaatgagcttgacatgtatagctctctgctgtctggctgaacaggtgatgagaactaacagtttaaaacatacacctggtcactctttgtgtaagtcctatcctatctgtggttctgccttttatcacaggttaccatatttgtaactgaattcctaaaacaacagaagaatatttattggtaattccacatatgactggtcagaggaagccatgaactgattttccatttaaaatcaccagtatttggtagcagactgtataaccaggcagatgttatttctcatatacttacttgttctggatgaaagcttcccacctttctataacacaatagaaaatattatttccaaatggaaaggtcaaaggtgatcccaatattgtcctcttttttctgtaaaactactcttcattctgtaaaacaaacaaaacagaaccagagactatcaggtggaggggctgatgcaattatctaggtaatgccccgcttttcatagatgagaaaatggtgacccaaaccagaaaaaaactcgctcaaagcccctggctattcatggccaggccctaaagagaacccaggcggctggactccttgcctagagctctaaactatgttcagctggaactttgcccttctcttcaaagtttcttctcatttctgctgttcagagccaagaaggcaacatggaattaaatgtcaaaagacggtataagtgtcaacatgaatggtgcagagggtacgttctctccagtatttccaggaaagagtatatggactggaatcatccagggaggaagttttcatggaggagacagcacatgaaccaggtcttaaaggataagtagggctgggcgcggtggctcacgcctgtaatcccaacactttgggaggccgaggcaggcggatcacgtgaggtaaggagttcgagaccagcctgaccaacatggtgaatcctgtctctattaaaaatacaaaaattagcggggcgtggtggcacacgcctgtagtcccagctgttccggaggctgaggcaggagagtcacttgagcccgggagacggaggttgcagtgagccgagatcgtgccactgcatcccagcctggcagacagagcgagactctgcctcaaaaagaaaaaaaaaaaaaaaaaaggataagtaagatgaggccaggtagttgggctggggtggaggtggagatgaggatgtaaaacgccttgcaggtgagaggatgagatcagggagtatggaaaggggaaaagttctcttgtccccttcgcagggcttgcgatgggggtgtggctcacttcttcagtgcccgctgctcagacctctaggggatcatacagatgggcgggctgtggggttccaatcccacggcagtgtctagtggtgaatgtttacagctcctgaagccccagtgggtgtgtgttacagggtgctcttttagttcagctgtccgtaggcgtcttgtattagctcaatgggacccctgccttattgcaaggacagagggctttctgtattccggggttcttgccttggtgtaccggaggaattggatcacacgtggtcttggagaatgagcgcaaggtttcattgagtggaagaagctctcagcagatggggtagccagaagggagatggtttttccccggagtaagaccgccaccaactcttctccaaccctccaggccaaactccgagtcgttcctctggtggatggcctgctggcgtgccgatgtctgttgtgtgctcttccgccagcattctcccttcaacgtcctctggacgtccagctgcttgtatgttcttccgccgatgtgttcctctcgacgtccagccgcttgtgtgtctgcctgcaagggtctctgggatttttataagcataggatgacggtgtggcaggccagggtggccttgggaaatgcaacatttgggcgccaaggcaggagtgcctgtcctcacctaggtccgtgggcacaggcctgggggtggagcccttgccagggacgcgcccttctcttcccagcacttcccttccccccttccctatcaatatgagtaattgaggagacagaaaaaaggagttatgcttccagggtacaaaggggaaaagctatggaaagccttgtacgccaagatgaggcatttgttctttatcctatgagcaactgggagagattatggtataaggagtatgtttaaagtgatgttttaagataagaaacggatttcaatttcctggtatggtcctgtcatttcatcctcctagttgctttaaaagcaacttcctttctcccttcctcctccacacactctgaaaagcaggggcccagaagcctctgagactgctctgtgtgcattcccaaaccaagttagatgatctaccccggctcctcatacacacatacacgaccccctgcatcaggatgaagatgcaaagtctgaattaaagacagcatgagagggcagacaggaagtggggaagagaactagaatcactgggtggagagaaacaaaatgggagctatgtgagtgtgattgtggtatgtgaatggagttggcttgggaactcatgtggatggggttggcatgggaactcatgttatcctaacattaaaactctttttttgagacagggtctcactctgtcacccaggttggagtgcagtggccccatcatggctcacggcatccttaaccttctgggctcaggtgatcttcccacctcagcctcctgagtaactgggaccgcaggtgtgtgccaccatgcctggctaattttttttttttttttttttttttttttagagacagagttttgccgtgttgcccaggctggtctcaaactcctgggctaaagtgatctgtctgcctcagtctcccaaaatgctgagatcacaagaatgagccaccgcgtctggccattaccctaacattttattatgaacattttcaaacatagagaaaatccatccctctattcatttatcaatctattttacttattttcttgcatattcaatgtaagttgcagacgttagtacacttctatgttcatataattaactagaattcaatattggtttattattctttcttaggaaaaattcacctacagtgaaagcagagatcttaactgtaccctttgatgagctgaaaaatgcttctacctcaaacacctatcaagacagaaaacattaccctctccttagtatcctatgccccttcccagtcaaattccatctctgccacaccctcaaagaaaatcactcttctgatttttttaaaccgtaaattagcctgttgaagaacttcacataaacggaatcatacagtatgtgctactcctttcattccacacaatgtctgtgtaagtcactcatgctgttgcttgcagtataagtagtttgtaacatttcattgcttagtagtattgtactgtataaaatactagagtgtattggccgggcacggtggctcacgcctgtaatcccagcatattgggaggccgaggtgggcggatcacctgaggtcaggagttcaagaccagcctggccaacatggcgaaaccctgtctctactaaaaatacaaaaattacccgggcatggtggctcatgcctgtaattccagctacttgggaggctgaggcaggagaatcacttgaacccaggaagcggaggttgcagtgagccaagatcgtgccaccacactccagcctgggcaacgacaaaaaaaaaaaaaaaaaaaacaacgaaaaaaaaaaaactagagtttatttatctattctcctgttgatggattgggttgttttcagattggggctatcataaatacagaacaatgaatacttttgtacaagggggtccttccccacaaaaacttctctaagaatagcttactttgactctgatctttctaatttcacaagctctttgaataaggatctcctcagcttaaactagatgctcacagccatggcaagtttgctgtgaatgttgctgttgtgagagtgataagtgaggataagaaagtcctagataaagtttcctttcattcaaaaagcccccaaatcatatcttttctaataaaaagcagcctgaaaaatcaagctgcaagtatagataagctaaaagcttgcattggtaaatgccagtagctgtgcccatagaaaaaagccacctgggggccaggcatattcaacatggcggatccatcttcccttttctttttcaaccatgtgtacagtaggaacagacaacatagtgccggccagatagagaccccatctgcataataaaacataagggtggaatggccggcttcttcgtgcgctatgcaaacgttataccggttctgaccaatctctcagtccctatgtatatcagacaccaccttctcaagttcatctataaaaccccatgcattggctgggtgcagtggctcacgcctgtaatcccagcactttgggaggctgaggcaggcggatcacaaagtcaggagatcgagaccatcctggctaacaaggtgaaaccctgtctctactaaaaaattcaaaaatttagccaggcgtggtggtgggcgcctgtagtcccagctaatcgggaggctgaggcaggagaatggcgtgaacccggggggcggagcttgcagtgagccgagatcgcagcactgcactccagcctgggcgacagagcgagactccatctgaaaacaacaacaacaacaacaccatgtatttcaccacaaaaccactcactcaggttcccctctctctctgcaggagagagagctattctcttttctctttctttcgcctattaagcctccccccttttgtttttttttgagatggagcctcgctctgtagccaggctggagtgcagtggtgcgacctcagctcactgcaacctctgccatctgggttcaagcgattctcctgcctcagcctcccgagtagctgggattacaggtgcatgcctcctcacccagctaatttttgtatttttagtagagatggggtttcaccatgttggccaggatggtctcaacctcctgatcttgtgatctgcctgcctcggcctcccaaagtgctgggattacaggcgtgagccaccatgcccggcctaaaactccactctcaaactcacttcttgtgtgtctgtgtcctcgattcctttggcgtgagacaacgaacatcaggtatttaccccaatgatgctgcttcaaaagcatatctattttcagaaaataaagtttcccttttatgttaaaactgattcattaacaatataaaaaattgtcattgaaattggagcagccaggcgcggtggctcacgcctgtaatcctagcactttgggaggctgaggcaggtggatcacgaggtcaagagatcgagaccatcctggccaacatggtgaaaccccgtctctactaaaaatacaagaattagccaggcgtggtggcaggcgcctgtactcccagctactcgggaggctgaggcaggagaatcacttgaaccagggaggcggaggttgcagtgagccgagattgcgccactgcactccagcctggtgacagagcgagactctgggtcaaaaaaaagaaaaaaagaaagaaagaaaagaaaagaaattggggcagctcaggagcttaagcaagggcacattttggtgtcaggattgcgttcaaactacagctctaccactgacacactaagagtcctcaatcaaggggtaatgactggcacacaggaaggactcagtgaatggcggcaactgtagattcttctctccctttctacttccccaaaaaggggtgggtttgggaagaatcacaccatccctgactgggtcaaagtttaagtcagagtagaaaaagaggaagaagatagaggaaggagctaagatgtataaagtttttaattgctctcaagaacaaaatcaatccatatactgaagatcatgtaatttttctcagttacccactggcataaagaatagggctgtggaccaggcgtggtggttcacgcttgtaatcccagtgcttggggagactgaggagggtggatcacctgaagtcaggagtttgagaccagcctggccaacatggtgaaaccccatctctgctaaaagtacaagaaattagccaggcgtggaggtgcacacctgtaatcccagctacttgggaagctgggacaggagagtttcttgaacccaggaggtggaggtttcagtgagccaagatagcaccattgcactccagcctgggtgacagagagagactctgtctcagacaaaaaaaaaaaagaataggactgagaccagtgtactctcttggaatgtagctatggccctgcaacccctccccgcaagctgtccagtgaataactgaattgggtggaagaagtccttcccccacatttgtacattggaaaataatataataatatatattatatatatataggcaatctgcctgcctcggcctcccaaagtgctgggattacaggcataagccaccatgcccagctggaaaataatatttagtactaattctaaaattggcattttcttaaaaaaggttacatgagctcctcagagaactgaagtttctctggacccatataacccacgtctatggggtcattcccacacctcacagataaaataagggaaagagtacatataattaggagcagacaggaagcacacagaaatggaaaatgtgtgtgggctttggcattgcagatctgaattcaaatcctcactctgcaccttatgaggtaagtatccctagacatgttacttagcctttccgaatcttgctttccaaatcatgcataatattcacctccctggactattgtgaagattaaacatgaaagtagttgtgacaaagatggtcagtgggtattatctgtcttcctttctagtaaaaaggctctagactagaatgttcttaggtctttaataggcttcagcaatctcacatgttaatattagtgttatgtgctgaactgggcttcccccaaatccatatgttgaagccctgaacctcagaatgtgactgtatttgcagacagagcctttaaagaggtcattaagctcaaatgaggctgttatgagaagaggaaatcgggacacacaaagggagataccaggaatgtgcatacagagagaaaaggccaaggagggaggcgtggggagaagccaaccctgctgacaccttggtcttggacttgcagcctccagaactgtgggaatataaatttctgttgtttaagccacccagtctatggtattttaaacacattaatacgactaatattataaaagtgtgtgaacagttaagaagtgtgctgaccaggttctatcctagttttgtagacaattagcagtgtgatgtagggcaggacatttaactcctctctaccacattttccacctctcaaagccaggctgcaaggatctactgagataatgtacataaagaccctatcacgaaataggtgtcccgtaaagggtgatttccttcacttctgtctccaaatatcaggtttctcatcagtaacttgggagattggatggactaagtagtccacctcgttcctttcagctttgatcatctgtgattctaacaacagtcttagcaacaagagtgagtttcctggccgggcacgttggctcacacctgtaatcccagcactttgggaggctgaggtgggcagatcacgaggtcaggagttgagaccagtctggccaacatggtgaaaccctgtctctactaaaaatacaaaaattagctggggcgcggtgccgggtgcctgtaatcccagctacttgggaggctgaggcaggagaattgcttgaacccaggaggcagaggttgcagtgagccgagatcacgccactgcagtccagcctgggtgacagagcaagactctgtctcaaaaaaaaaaaaaaaaaaagagtgagtttcctttctgtaatgccaaaaagtgtttccaaagtcctttccatctcacagtagtccaaggggtacatgtaccccttgaacctgatgaagccccagcagacccgattaaccacccctaaaggtttctcggcaggcaaatccagccaggcatgcaaatcacactcgtcaatgttaaggcttttgtacatcccagacacaagctttaaatgaatgtaaacccagattttaatatttgggccccagaccttaaaaatcccattctctctacccacagtacctggctgagcaatccaattgccctcttcttgggagaccaagacatgtttttaaaataaagtttctttgtatttgctttccgtttcagtgaggcctcgagttcttgtagaccagataccttcttgttctgtgagaggacagtgt

SEQ ID NO: 731 - DNA, 41172 bp, Homo sapiens
ttactggcttcgagtacactttatttaagcagttactagtttaaaagcacctgtaataacactgagatcatcatcatcaaattgccacccaacaagcctagcttcttgcagaaaagttaacttggataacacttggctaagttttctgactaatgctggatcaggtagaaattctttagtactaaagtcaaaaaacactaattgcttaagattctcaaatacacccatgaaggcaagccatccatcactgctcacacgatttcccgccaaattcaactgctggaagtttttcagagggttctttccaaaaaatgcacctgggtaaagaaataagtatattagttggaagaaaaattttttttaaaaaaaaagagaaataggttctacatttattttacatacttttttttcactctgaaatggccatgtttgaaccagtgctttgcctcagaaagaaattattaatataattctctatagctagggcagtgattgtgaatatggtctattatattttcctagagtataagggaatctgataaatagtgattcgtagtgaggtagcaacaatatgtaaatgaattacttttttttccccttttccttactcctaggaaatggaaggttgctttaattaaatattcagtacttgttttcaaaactggagtcaatctttggcaatattaagtcgtttcctcttctgaaaaagtaaacaccacctaactgttgtttctatgggtatgttcctaactgtaaacttgagtaagtgagcctccttcagtatctaaagatttgggtgtttttgtttacctgtttatgtataaccctcccgagcctcttcaggaagttcctccattccttacagaatagggcacctaaagtatttcctacatagggtaggtggatatcctgtctttctgatacacaaagaatgcacacacacacacatacatacaaaggatgtgtgtgtgtgtgtgtgtgtgtgtgtgtgtgtgtgtatacatacacaaatagtttagtgttcattctttatcccatgttaccagtttaggtggtactggaacccaagtgagtcttgcaataagaaaaaatacctttctttcaggttatttaccatcatacagattggccagtatacaacattaggatttcacaaaactagctctgtgttaattacacatattaaattgtgcaaagcgttagccctacccacctacctggccctttctggatgactaagttcaccttgaagtacagagtggacagacaggcagactggacatgggaactcttacttacatgtttatactccagagtatcacacacaaaatgcagaagatgtatgcctggtttatcaatccacattactcggctcatccgagctcatcttagtcttagtgtacctcacccaactttggagggttaatttgttgtatattaaacttgtgtttcttgggagatgtgtaatattagataatgttccagaaactgacccttatggaaatgaaggtccatgattcagtttggattccaagtaggaaaagaggttttaaaagttcctttccattgtctcagtgagaagaccactaaagagttcaagttaaagaaggaaagattcggtgctgtacaaccttaaggttagcaagcaaagactaaaaggtatctgctaccagtaatgagggcttaatgacagaaatggacagtcttgtccgaccagcttacgtgggtgaggtcaacctagttatgcactgaaactatacccttacccactttcagtaaaggtgtttaccagctccgtagtgagaggagatctgtgaatttggtgtctgatgtcactgcatggccttgtgtagtttgttcagtgcaactaagtacattctagagtgtgtccttagtcaatgtcagccaatgcttttatcaccatcataaggtcttgagtttcgaaaggtcttcaggttcttctttacagacacctaaagtgattggccctgcctgaccgtggtcaagatgctagcggctaaagtgggcaaagccaggtaaggagatgattcacagggttctgccttcatgtctcttacccatggtcagtgtcactgacaccatctttgggccttctttgccacttttattaatttgaaaagtgagacagaggccgggtgcggtggctcatgcctataatcccagcactttgggaggccaaggcgggcagatcacctgaggtcaggagtttgagaccagcctgaccaacatggagaaaccccgtctctagtaaaaatacagaattagccaggcgtggtggtgcatgcctgtaatcccagctattcgggaggctgaggcaggaggatcacttgaacccaggaggcagaggttgcggtgagcagagatcacaccattgcactccagcctgggtaacgagtgaaactccatttcaaaaaaaaaaagagaagaaaagtgagacagactgctagttgttcccaaaactgtctctccttattccatagttaatagagttttatttcggcatatggccactcatatcccaacctcccttgctattaggtgtggctaaatttttgccaaggaagtataggcagaagtgatgtgtgcaacttccatgtcacttttccgcttttcccctcttctactaggttgaaatgatcacagggcagtgacctagctatggccataaagtcaaaaataacactcttaaggaatagaggagtaaaaaaaaaaagtaggggtctgggcctgaaagactgcacagaggaaaaccaccccacctgcctggactgctcatttctggactgttacatgatagagaatcaagttctgccttctgtaagccatggtatagttgggtctctgttatcacagcgtagcctatgcccagcccaaatagtacctaggtccttactttcccctgccttccacctcctctgttccttggaggatggctttctccctgctctctcttccatctcatgttcatgtcctttctgcctttgccccttctccatatgcttcccagcatggcatgcactcagtccaaatgctggttgccagttgtgtgtctatttaaggctctttccccaaagatcaactttttttctccttctcagctagcagaacatattttcaccacctaaaaggaatttaagaagaatttaaagcccattccaccctcacagggtgagcaatttatagtggttatctactaaggtataaggatcttatcatcaatttaagagagtttcttagataattattggaatgtgtgctagtgcaggaaccaagaacaaacaacatttgtcataagccaagggcatgccttttgttcatttaatctgcagtgcttatgttatgaggagcagactagatccaagagaaacagaatccatgacatttagagccataggctgtatgtgggctgtggagagtgcaaatggcttgattggaattccaggaaaaatctcagatgccctgggtagaagggttctgattcttgggggttcctgtatcccaaacacaactcttcatttgtgttgtcctgtagttcacctgaacgagtaccagagttctcactgtttattcattcagcaacatctttagtgctactatgtgctgcggattatgctgggtgctggggatatgtgtaaacgacagacatggtccctgtctaaatgggcttacaaaatagtgtgaagacatgcattataaagtaattagatgggtggtgggtgctatggtaggtcagggtaccctgggagcacacaaaagcaataggctttcccactccactttgttcccagaacacttgcaattgggcttatatgctccaggaggaagactggaggattcttaggagaaatggaactgccccccgggaaaaggccctacaaagaaggggccattttgcttgcccaatcaccccctagtggagttagcctgtcaaaaattcaccgcctcccttagacacacagaactccctatcaacttgtgtctccctctaaaatgtgaagaggacagtgcaggattatcagacatttgacaacagcctcccacaaggaagactgagactaaaagccaaaacaactcccaaagaaatcaggcactgtagaaaacaagaaaaatcaaactccaaagacctaagtttttcagagatcctaagtttttcagtagactgcatctactcagcaacaataagatgctaagaaagagcttttggaaaataaaatatgatagcgggatctatacagcagaatgattgggcccaggatttaacacagagcttctagaacatgaatagggtctgcgatggctttttttttttctttttttgagacaggttctggctctgttgcccaggagtgcagtggtgcaatctcagctcactgcaatctgccccactggctcaagtaagtgatcctgccaactcagcttcccgtatagctgggattataagtatgtgcactacgcccagctaatttttgtatttttagtagagacagggtttcaccatgttggccaggctggttttgaactcctgacctcaagtgatacacccaccttggcctcacgaagtgctgggattacaggcatgagctctctttgagaacaggctggatagcagagttcagcttcaaacatccaagttgaaagataccatttaacaaagggttttgttagagcaggtgaaattggtcaggcatggtggctcatgcctgtaagcccagcactttgggaggctgaagcaggcagatcacttgaggtcgggagtttgagaccagcctggccaacatgatgaaacctcgtctctactaaaaatacaaaaattagctgggcatagtgcacacacttataatggcacatacttatagtggcggcatggaccggtaatcccagctactggggaggctgaggcaggagaatcacttgagattcagagaagcgaatagagaacagagaatcccaggaagcggaggttgcagtgagccaagatcgcaccactgcactgcagcctggaacaaaacaaacaaaaaaacaggtgaaatagatacctgagctagcaatgatttttatgttgtagtctcagattgctgatgggtaagaaacaaaattttgggagtcaagcaaaacatggcaaagcttggagatcaaatgcaatctctgaggaagaacagcagatagtctagaccaagctttaaggaaaactagaaacatttaatatctgggtagaggaatcaccattgaaaagaagactgagaagtagccaaggtggcatggaggtcaagagaatgttttgaaaagaagggaatgctcagtgtcaactcctgcggaggaatcaaataaattaaacacttctgaaagtgtctattgaaattcagccacatggaggggtgtggagagtcagatgcaatgagtagaaagtagcagatggtcaggaaatggagatgtcataagggtacataaaatttgttttagagcttttaccttgaaggagaggagagatagaatgataaccaaaggaggaagataggactcagggagagttttatttaaaatggaagagatttgagcaactttaaaaactgacaggagggagtcagtaacaagaggcacagtcaataaaatgatgtccctgaactggagtgagggtgaggctggcatctcaagcactgctaaagagactgcccttaggtaggagaagagaaacctataagctctaaggagaaggagagaaaaaaataacagtcacatcctctgtgaaataggagacgctgagtactgattgagaagaaaaaagtgtgaaatagtttacatacagtgttgaatacagaaacacagtaagattgccaggaaatattaagagagattgtgtttattcactgttttttgtttgtttgtttgttttgtctcccaggccggagtgcagtggtgccatcctgacctcaggtgacccacccgccttggcctctcaaactgctgggattacaaacgtgagccactgggcccagcccccgctattttttttttttttttttgaggtagagtctcactctcccacccaggctggagttcagtggcgcgatcttggctcactgcagcctccaccttctcggttcaagagagtctcctgcctcagcctcccaagtagctgggattacaggcatgtgccaccacacacagctaatttttttcatactacattttttaatccattcattatttgatggacatttgagttgtttccacttttgagctactaaacatgctattataaacattaatatacaagtttttatgtggatattggttttcatttatcttgagtacctaggaagagagttgctgggtcatatgacaactctatgtttaacattttgaacaacttgccagaatgttttcctcagcagctgcatcattttacattctaactaccagcatatgaatttctccgtatccttgccaacaacacttgttattgtatgtcttttaataaaaaataataaccatccctagtgggtctcaggtggtatctcattgtagttttggtttacattattaccctgatggctaatgatattgattatgttttctgctatttattttgcgatttacatatcttccttggtgaaatgtctgttcagattcttgcccattttacaaattgggttatttgcattttttatcagtgagttgtaagagtttttttgttttgttttttgacatggagtctcactctgtcacccaggctggagtgcagtggcgcaatctcggctcactgcaacctctgcctccaggattcaagcaattcttctgcctcagcctccagagtagctgggattacaggtatgtgccaccacgcccggctaatttttttgtatttttagtagagatgggatttcaccatattggccaggctggtctcgaactcctgaccttgtgatccacctgcctcaacctcccaaagtgctgggattacaggtgtcagccaccacgcccggccataagagtttttttatatattcaagatggaagtcctttattagataatgtgatctgcaatttttttttcacattctgtaggttgtattttcactttctttctttttctatttttttttgtggggggggggtgggggactgggtgtcactctgtcacccaagctgcaatgcagtggcatgatcacagctcactgcagcctcaacttcctgagctcaagccatcctcccacctcagcctcccaggtagctgggactacaggcgtacgctgccacacccagctaattttttggagattgagttttgccatgttgctcagactgggctcggactcctgggctcaagcaatctgcccacttcggcctcccagagtgctgggattacaggcgtgagccaccacacccagccttagttttgaccaaatgtctttttttctgttgcaggaactcatccaggataggacattacatttcattgtcatgtctctttaggttcctcatgcttatgacgatttctcacaatcaccttgttttttatttccttgacagtttcaaggaatactggtcagttttgtgtagaagtccctcagttaggattgtttgatgtttttctcatcattagatgggggatatggatctttggggaggaatatcatagaggtaaagtactattttcgtcatgtcatatctaggtacatactatcaacatgaatcaccactgttaatgttgaccttgttcacctgaccaaggtagtgtcaacagctttctccactgtaaagttactcttttttgctgccttttgctgcatgctacaagttttgatatacagcgttttcttaccattcacttctaaatattttcgttgaaatttgtcagtatgaacttgtatttatctcccaaattttgcagtttttccccagtatcctaagtgtagttacaaaattttaaaaagggaaatttaaggacaatccaggcctggggttttgtcaggaaagtacaccccatctactatatttcatttcatacctctcattccacatctcatgttctgcctgcatctcattaggtagtctttctttaattagagactccatctctcattacactcttcatttcaccattgcatctatcacacacatccatcactcaaagtcattgcctgaattgactcatgctactgtgggccatgagaatttcagctattaaagacaagaatgtttgcagggatggaagatggagttgaaactaggtaggaaggcaagtcaaaatagaaagggcctgaaaaataggtagaaggtagcgggatcgacggactggaagtcccagtgaagtaaaagaactggtgattaggagtagatagaaatacaggaggttgtggtttgagaatgggatatctgcatttattattttgcaggtagaacaattttaagtggcttgtcataatctagtcattgcatgctcatagaatgaatggatgaaggagagtggaagggaaggtcgttgaagaggaaggtccattagcggagcatagtggcctctagtcccagctacttgggtagttgaggaaggaggatcccttgagcccagaagttcaaggttagtgagctgtgatcacatccctgcactccagcctgggcaacagggagaccctgtctcaaagagaaagagaggggtgggggagggaggaaggaaggaaggaaggaaggaaggaaggaaggaaggaaggaaggaaggaaggaaggaagggagggagggaaaggaagaaggaagggagggagggaaggaggggaggggacatactgctttcactgtatcccataggtttcagtatgttgtgtttccattttcatttgtcttaagaaattttaaatatatatatatatatatatatatatatatttttttttttttttttttaattgtagagacgacatgttaccatattgcccaggctggtttcaaacttctgggctcaagcagtcctcccaccttggcctctcaaagtgctgggattatagtcatcagctaccacacccagcctatttcaagaaatttttcagtttccttctgaatttcttcattggcacacttgtcattccagagcatgttgtttaatttccatatgtttgtatagtttccaaagttcctctggttattggtttctagttttattctattctattatggtcagagaagatacttgaatcagatttcaattttgggggattttttaagacttattttgtggcctaacatgtggtctatccttgagaataatccatgtgctgaggagaagaatgtgtattctgcagctgttggatgaaatgctctataaatataggtccatttggtgtatagtgcagattaagtctgatgtttctttgttgattctctgtctgggagatctgtccaatgctgtaaatggggtgtcgagtctccagctattgttgtattgggttctatctctctctttagctctaacaatatttgctttatatatctaggttctccagtgttggggacatatatatgtgtgtgtatatatgggaagatgaagaagctctggagatggatgttgtgatagtggcacaataatatgaatgtacttaatgccacaaagcttttacacttaaaaacagtttaaatagggccgggtgcggtggctcaagcctttaatcccagcactttgggaggccagggcaggcggatcacgaggtcaagagttcaagaccattctggctaacacggtgaaactccatctctactaaaaatacaaaaaaaaaaattaggcgtggtggctggcgcctgtggtcccagctcctcgggaggctgaggcaggagaatggcatgaactagggaggtggagtgtgcagtgagctaagattgcgcaactgcactccagcctgggcgacagagcaagactctgtctaaaaaaaaaacaaaaaacaaagaacaaaaacagtttaataaattgtacgttacgtaaactaaacacattttagacaatctgtaagagaaatgaaggcaatcgaggctgttttcacaagtccttggctttagtatgatagcttccaagttgaacctgatgagcctgacctccttgtattaatgtttccatacgctggattggaataacttgtgcaaccagtgggatatgtcagaagtgaccagaaatgagtgggctgccatgttgtgaggacactcacagcctgtgaagaggtctaatgatgaggaagtgaggcctccagccaacagccagtgttaacttgccaaccatgtgagaagctaccttggaaggagatcctccagcagcccctctcatgagagaggtcaagccagagctaacctgctaaactcctaaattcctgaaccacagaaactgtgagataatggttattgttttaagccattatgttttgaggccatatgttatacaggaattgaaaactaatacagatagtatgaaggcttctttcatcaactgcctgaggttggtggtgtcttcagtcatttatatagatctatttgtttctggataatattacagctatttaaagatattttgtggctctatttagatacagctacattcgcctttatatgttttgaatacccagtaagtaacttgaaaatatttcctgatattggagggaggggcattgctgaatttcagaaagttaaggctagtaagagctatgactaatataatacatcttgttggatactgtgaatgcttttcatttaattctgtaggtaaaggaaatagaatctgaaggaaggccagtgttttaagtcttcttactctaacgtgaatgaattcattagacatatttatattttaaaaaaaagaggaagcaaaataaaataagggggcaaaataagcaaagccaacttaagaattttttaagggccaaatccagttatcttggctctgtatgtgtgtacctacctaaaattctaatctctgtatctgtgagtctccagtttttcaacccaagcttgacgagttgtgggacctcctccaaatgtttcaacaggctgctcaggctgccttgcacgtcacagccccagggcagcatcagtgcggtgagctgttctagcacgttcatcctgtcgactggaagaaacaaagagcagttcagggactggatggtctcaaaactgaggaagaacaaaggggtgttaggggaggaatgatctttatgtttggtggctctgcagcctactcaatctgtaatgagaatctacttaatttttggtttttttttggaaagtattcaagcatatacaaacattatgcagaagaatataatgaaactatatatactaataagacaccttcaaaaacattaaatcatgggcaatcttgcttaatcctgacctaattcctcctgtattattctaaagcaaatcatggacaatatgaatcagttctttccttttttttcttttaaccataatcacatatcactatcacacctaaaaaatcatatcaccaattccttaagcaaatttgtcttgcacatcggctactcttgacagttgcctcttcaaaggaggaaagcaggtgggataccgcctcaaagtgcagtgagcatatgtaaactggtgacttaaaagacatgggcctgtgttccttaagggcagtttaagaaaggcctaaatgattttcctaaggagggtgcatctagtaaggcacacatgggtataaaagacctcaggacccaggctatgtatttcgactacccagtatacatattcaagtatctaattttggctgaattgtcattcttactcagttcatgaagagcttcatttccatctttttccaggtaattttctgataaatcaagaatgctcagtttgaccaaattgtgaagattctgagctggggaaaaaaagtaatccaaaataaaaagattttcaggtaaatataaatgtattttgaagtatccttagaataattctgagttttatcttctctgctaatggtagtgcaaaccataacttgccttggttattttaattatttccaaaggctctggtgtaggtgtaacccccaaatcccatggttatgaccaaatgggcaaatagtcattggtcctaggttctgattaatgaattccaggtcacgtagaacctaaagcagcatgggatgtagttgttatgtcatcatggaaaaatcacttggtctctctaagcctcaatgtcttcctctatagaatgaggtagttggaccagataaaatgtaaagttgcttcaattataaaatgccgttaatcatgcaggagaaacaggaacaacaacaacaacaaaaatgaaatgagctggttttgtgtacctcaacttagatgattttattgacataatagttgagatattaataataaaaacatagtaaaaaatggatgagaaaaaaaacaaatagcaaaatggcagattcaaatttatccatatcaacaattacattaaatcttaatggactaaacactccaattaaaaggcagagataatcagatattcagaactttttttaaagcaagacccagttttatgctgtgtacaaaagacgtgtttgaatgacaaagacacaaatatgttgaggtaatggaaaactattttgcatgcaaacattaattatataatagtaccagtctagctaagaattgcttagtgcttttcttcacatattatcactcttgcttaatctagctgaagttttttctgtcagggctagaaaaatctcctttttaaaaaaatcagacaagtttttcatgaatatgtactcttgttataatattggctattattatttttaatcaatcatatgagcccttttcttaaagtatcttctgggttttgtgctctacaataaaaaacctgctgaacttctctttaaaagagtacgtttgctatttgcagttctaagcctgtctctccccatcagtaagtagagaaataaaggcatgtgctcattgttctcatattcccagtacttatccagcctttttcaactgtgggtttctctagctgtaactttatattagtatacaaatggcttccttagttatctttagagactcccagcagttatatagtttaactttaaaaagattataccactgttttccaaaatctaaattttaaaatatgtctgaattacacatgtatagtttatccagaaatatgcagttagtttccccgtagttgatatgcatccctttgggaactcagaaggctcaattatcatatcatgcacattaacttcatcttaacagggcaatgggtaggaattagaagcctgagatcatttaagaaaatctttatctctcacttctcaatcatttatccattcatttaaatgtttattaggcagtaaattatatgaccggttgtgtggcaagtttcaagcacctatttcttattttcttccttttcactttctctaaaaattacatcttcaattattctgaaattctcccctattatccatcaatagttgatttaattctaatatggagaaaaatcattaaaaacaatctgcttattatcgagaagtttttattttccagttttccttaaaattaaatttccatttgagacatttagtgtgaattagtataatagtatcacatgttctgttatactgtcctcattcagttaatggaagcaacagttacctaggattttcactgcatttgcagacaagcagcaggagactaattgaatttcttcaaggtcacagggttcacttgacagagacttgactatgtaatccattccctctccaatgtcagacaagtgggtcaaatgaaataaacacatcttcttcaggtttttcaggccttcagctgaaaaatgatagaaaggaatgcattaggataccaagttaattcgatttaagcatagattaatgaactgaaaagaaagcaaagaataattgtgcagagaccttgccatgttcttcctgcagcgactttaagttacaaagaatcaacgagagctttttttctttcaattctcactttccagtctcttggaccacacaaaaaatcacttatatggaggttattctcttagtagcatgagaaacactgtagtaaatttgtagtctttttaatgggcatcaatgtatactcttaccgtaattctttacatgaatgaagtcttctagagcactctcctttcaatcttctcaaaaatcttaaacagcgggggggctgagttcagggaggtagatgaggacttggctccttggagtgcttctagtgcaactgtctacagcctcaaaagccttgcctggactcatgatatggggcctgcctgaagctttagaatgaagaccacatccactgcagcatgtttaaccagaagaaagatttaccttatatcaacagtataattggaaacattctaaaatatcccccgttcttaagtctaaagctaatgtgcagtttaggattggttaggcctcactttgtgtcattaaaatactgtcttatcttgatggtactgtagcctacgggaaagaaatatatgattttaatgaccaggcatggtggctcacacctgtaatcccagcactatgggaggcagtgataggcgaatcacctgaggtcaggagttcaagaccagcctgtccaacatggcggaaccccatctctactaaaaatacaaaaattagctgggcgtgatggtgcacacctgtaatctcagctacttcggaggttgaggcattagaatcgcttgaacccaggaggcagaggttgcagtgagccaacatctcaccactgcactccagcctgggcgacagagcgagactcccatctcaaagaaaagaaaagaaaagaaataaaatatatgattctaataatatcagtcttgcagagctttcgggaaggttgcagataatgtacgttaacatatttaatgtggtgcctggcacatagtaagtgctccataaatgttcattgttgtcatgggagtatataccggttaaaggttgtgagcatgagctttgcagtcagttcctggatcccctacttaataattataaacttgggcaagttattcaatcttttagctgaagcgttagggatcattatatctatgtactaggactgttgtggggattcaatggaatgaggtatataaaactgccgaggctagtgtctaatctatagcagagtaactctttaataaagagtaaattattactgatataattagactggtttagtcaagttcacattttgattccttaatagcagaagcaggctatcctagagaggtactttttgacctctttctaccagttggtaagatcttgagcaagtcaataagctattttaggttctagtggagttttctgtgaaatgaatgagttgaattagatgctctcaatccccttccagctctgattttctgtgtaatttatacacatgcaataaatgtttattgaacactgaattaatttgattattctcacgtaggacatataaggaaaagaagtcagccatgttttgcttttgtttttgtttttgtttcaagatggagtctatctctgtcaccgaggctggagtgcagtggagcaatctcggctcactacaacctcctcctcctgagttcaagtgattatccttcctcagcctcccaagtagctggcattacaggtgcataccaccatgcccagctaatttttgtatttttagtagagacagggtttcaccatgttggccaggctggtctcgaactcctgaactcaggtgatccatctgcctcggcctcccagagtgctggaattacaggtgtgatccaccatgcccaggcttcagccatgtttggcttataggctagagttgtctttcggcaggaagcagaataagaaagaacaagatgaagggaagagaggagtattttagtgaggactcaagtagggaaaaaaagagccaaaaaaaaaaaaaaaaaaaatccaacacacgagaaaacagggacattcaaggaaagcagctttaacaggaatcctccctggcctgcagggcctggttccctgtggtaagccatgtgttctgcttgtgttcctgaagtttccttttccttttcatttttttgattggggaaacacaacctgcagtgtagaatgaaagcatgcttcccccaaagttttcttgattcacattgtttcctgtgtcctatttcatttatgaatttttttaactatgaaaccatagtataaactttaaaatattgtttctatgcaactatgaaactatactataaactttaaaatattgtttctatgcattaaataaaaacatagccaatgagccagggagacggaagttaaaaacacgtcaggggctctcttcccaaaagggttaccatctggtgttgtacaatttgaataaaatgatgctgaaggattttaatggcagtagggaaaatgtctggggaaaccaatgtagccacaagtacataaaaacatccttgccttgtgcagacacagccaatgtcagagcctgaagttaactcctcttattatcaaacttacattgatacaaatatgagaacagaaatctgacctagttttatagcatcttcttcattcatctttatgttatccattatgagctttgtaaggttcttcaagttacccaagctgtcagtcagaccacctgtcaaaagaaaaaagattggactctttcagcagatatttgctatttactatgtcatttactattactgtcatttttgttaccaatcaaaagattttaatgatcatcatgagccaaaaatgctcatgaaatagacataaaaatatactttttataagagatgggcattatacttcactgtaagcatgttctgcaaataatagactagataccaatttcccagataacagggaaaaaaatttcctttttttttttttttttttttttttgagacagagtcttgctctgtcgcccaggctagagtgcagtggcgcaatctcagctcactgccagctccacctcccgggttcacaccattctcctgcctcagcctcccaagtagctgggactacaggcacctgccaccacgcccggctaattttttttgtatttttagtagagacggggtttcaccatgttagccaggatggtctcaatctcctgacctcgtgatccgcctgcctcggcctcccgaagtgctgggattacaggcgtgagccactgcgcctggccgataacagggaaatttctaaacacttggaaattaaacaacacatttttaaataatcatgcattaaagaagaagtctcatggaaactttgataatattttgaaaaatataaaaataaaaacaaaacttcaaaatctgcagctctctcctcacaaaggggtgaaaagaaaaaaaaatctgcagctaacacagtgcttacagggacatttacagtattgcatacttatattagaaatgaggaaaggcctcaaatcaacaacctaggcatactacttaagaaattacagaaaagagagcaaaataaatgaaagaagaaagaaaataataaagataagggtgcaaatcaaagttattatgcctttattatacaaattaaaaacagaggcaaggtctcactatgttgcccaggctggtctcggactcctgagcacaagtgatcctttggcctcagcctcccaaagtgctaggattacaggcgtgagccaccatgcccagcccagaaatcaaaattataaacaggtaaacaatagaaaaaaatcaatgaagctaaaagttggatctttgaaaagatcaataaaatttaaaaatttctaccaagactgacaaagaaaaagaagacaaaaattaccaatatcagaaacaaaaaaggggatatcactacacacactgcagatattaaaaggacaattagagaataatataaacaaatctatgcacataaatttgacaacatatatgaaattgaccaattttttgaaaaccacaaactaccaacactcatgtgatacggagtaggtaaccggaataaccttatagctattaaagaaattgaatttgttatctaaaatttcccggaaaagacatctgtaggcacagatatgttcacttgcaaattctgccacacattttcatttttttccttctatcaactgtcttcatatctaccacacatttaaagaagaaataacaccaattctacacagtcacttccagaaaatagaagtacaaagaataattcccaactcattttatgaagccatcattaacttgatatgaaaaccagaaaaagacgtagaagaaaaacttttaggccaggcacagtggctcactcctataatccccgtgctttggggggcagaggtaggaggatcacttgaggccaggagtttgagaccagcctgggcaatatatccagaccctatccctacaaaatattttttaaattacccaggtgtggtggcaggtgtgagtagtcctggctactcaggaggctgaggcaagagaatcgcttgagcccaggagttcaagattgcaatgaagtgtgatgacaccactgcactccagccttggtgacagaatgagacaatgtctttaatgaaagaaagagagagagagagagaatagagaaagaaaggagggagggaaggacggaaaagaaaagaaagaaaattgaggctgggcgaggtggctcacacctgtaatcccagcactttgggagggcgaggcaggcaaatcacgaggtcaggagtttgacaccagcctggccaacatggtgaaactccgtctctactaaaaatacaaaaaatcagctgggtgtagtggcaggcgcctgtaatcccagctagtccagaggctgaggcaggagaatcgcttgaacccaggaggcagaggttgcagtgagctgagatcgcaccactgcactccagccctggtgacagagtgagaccccatctcgaaaagaaagaaagaaaattaaactttagaccaatatcattcatgaatacagaatcaaaaatcttcaacaaaatagaaaatggaattcagtcatgcataaaagaatattacggcaggcgtggtggctcacacttgtaatcccagcactttgggaggccgaggcaggtggatcacaaggtcaggagtttgagaccagcctggccaacatggtgaaaccctgtctctactaaaaatacaaaaattagctgggcgtggtggcgcgcctgtagtcccagctacttgggaggctgaggcaggagaattgcttgaacccaggaggcggcggttgcagtgagccgagatcgcatcattgcactcagcctggtgacacagcaagattccatctcaaaaaaaaaaaaaaaaagaatattacaccacctccaaatgggcttcatatagggaatgcaggatgctcaatatgtggaaatcaatccatataattcattatattggcagtctaaaagtaaaactacgtgatcccataaattgatgcagaaaacacatgtgacataatccaacatccaggctaggtggctcacgcctgtaatcccagcacttcgggaggcccaggcgggaaaatctcttgagcacaggagtccaagaccagcctgggcaacatagcgagaactcgtctctacaaaaaatttaaaaattaaccagatgtgatagttcacacttatggtcccagctagtcaggaggctgaggtgggtggatctgttgagcccaggaagtcaaggctacagtgagctatgatcacgccactgcactccagcctgggtgacagaacaagaccctgcctcaaaaataatctaaaaataatttaataaaaacaatccaacatccatccatgtaaaatgacatgatcatataaatggatacagaaaacatctttagcacaatccaacacctattcatgaccaaaaaaaaaaaattctcagcaacttgataaaagacacctacaagaaaactacatttaacattatacttaaaggtgaaagtctgaatgctttctccctaaggtcaggaacaaggcaagatgttaattcatgtcactattcaacattgtactacaagtcctagttagtgaaataaggcaaaaaaaaaaaataaataaaaggaatacagattggaagggaagaatttaaaatcattcttttcgaagataacatgattgtctatgataaaaatgtcaaggaatctacaacacccccttctgcaaaccccacaaaaaaaacccttctaaaactggctgggtgcagtggctcatacatataatcctagcagtttgcgagactgatggggaggatcacttgagcccaggagttcaagactggccttggcaacatagagagacctcctctctacaaaaaagaaggaggaggaggaggaggagagggagagagggggagggggaaggagaggggaagggagaggaagaaggaggaggaggaggagaaggaggaggaagaggaggagaatgagaagagaaaaaattagtgaggtagcgaggtgtggtggcacatgtcagtggtcccagcgacttaggaggctgagcattatgtagaaaatgggattatagaccgggcacggtggctcatgcctgtaatcccagcaatttgggtagccgaggtgggtggatcacttgaggtctggagttcaaggccagcctggtcaacatggtgaaaccctgtctctattaaaaaatacaaaaattagccaggcgtgttattgggcgcctgtaatcccagctactcaggaggctgaggtaagagaatcacttgaacctgggaggcagaggttgcagtaagccgagatcacaccactgcaccccagcctgggcgacagagtgagactccttctcaaaaaaaaaaaaaaaaaaaaaaacagatgaatagaggtcattatggtaagtgaaataagccaggcacagaaagacagacatcacgtgttcttacttatttgtaggatctaaaaatcaaaacaattgaactcacggagagtagaaggatggttaccagaggctgggaagggtagtagggaggaggtggaaatggttaatggatacaaaaaaatacttagaagggataaataagatctagtatttgatagcacaacatagtatctaagtcaaaataagttaactgtatatttaaaataactaacagtacaactggattgttcttaacacaaaacataaatggttgaagggatggatactccattttccatgatgtgattattacacattgcatgcctggatcaaagcatctcatgtaccccataaatatatatacctactatgtatccacaaaaatgaaaaatagaaaaaatttaccttatagggttaagacatctaaatgagttgatacacgaaatttgcttcaataatacctgtatgtgttcaataatgttggctatcgttatgtatacctttaaaaaatcaacaggttggggccaggtgtggtggctcacacctgtaatcccagccctttgggaggccgaggcgggtggatcacctgaggttgggagtttgaaaccagcctggccaacatggtgaaaccccgtctgtactaaaaatacaaaaattagccaggtgtggtggtgcatgcctgtaatcccagctacttgggattctgaggccggagacttgcttgaatccgggaggtggaggttgcagtgagccaagattgtgccactgcactccagcctgggtgacagagtgagaccctgtctcaaaaaaataataattaaataaagtaaatactttttttaaatggcaaacattaaaaaataattataaacaccatataggccaaattcagcacataggtgatcactttacaggatcagtataaaagaatagttgtcatgagtagatggtgagcttcctgacacagaaggtagtctaatacagtcttcgtgacacccagaatcttacagaagggattccctcattagggaggaggtttcaaagattatctgtacaaaaaattctagaatcttaaaatgataggaaatttctctgtagggtgacaagcaaggcagagctgggtgggaaattgctagcgtttgaaaactaaccccagactgctacagttaagtacagcaagattcctgcttcccatggcttcacaccacatagcagttcctgctcggggcaaccaggctggtctacacaggtagggcagacattctcctttagtgttatttggaatttggggaagtatccccgttacccagaaagattgccctcgcatatctgtgtctgaagtctaaaatctgaaatttcatcatgttagacaatattccccaaatcttctgtcattcattcttctttttcttttctttttggagatagggtcttgctgtgttgcccaggcacagatatgatcatatcttgctgcagcctgaaaattcctgggctcaagtgatcctcccacctcagcctctggagtatctgggattacaggcatgcaccatcacgcccagatgattaatttttgttggagacagggtcttcctattgtgtccaggctgatctcaagtaatcctcctgccttggcctcccaaagtgttggaattacaggtgtgagtcacctggcctggccccaaccaagtaaacaacagttagggtgggaacggagctgagtatcttctacaatttcccagatgagaatcttgtaacacaattagctcctagctcctgcaggtgattaatttacaggttggatttcctccaagacttgaagtagggcagggtgccacttggcagggaaggactgggtattgggtagagatgggggtgctcgcaggagaaggatttgctgaagacaagcttaacctgcgtatatatttattttttttaatttttttttttttttttagacagagtttcactcttgttgcccaggctggagtgcaatggcgtgatctcggcccaccgcaacctccacctcccaggttcaagtgattctcctgcctcagcctcccgagtagctgggactacaggcatgtgccaccacgcccggctaattttgtatttttagtagagatggggtttctccatgttggtcaggctggtcttgaactcccaacctcaggtgacccacctgcctcagccttccaatatattttttaataaaaatatttttagtatatttacatttttaataaaaatagttttaatatatttaaacacatacatatatgtatctatgtatgtatgtgtatatatatctttccaatcagactacagctctgggaatcttccctatggctcccaatctaacagctttcccccaacatagacctctctccacagcccttctaccttcctttcaagtcctgacacctggtagaaactactagaaaatttaaaacaaaactaataaaaatgaaatcatgtcttttgcagcaacattgatggaaccggaggccattatcttaggtgaaataactcagaaacagaaaatcaaataccatatatactcacttacaagtgggagctaaataatgtgtacacatggagatagaaagcagaatagacatggagacttggaaaggtgggagcgtgacagggaggcaagggatgagaaataatctgataatggtggttacactaaaagctcagatttcaccaccacgaaatatatcgatataacaaaactgcacttgtaccccctatatctataaaaataaataataaataataaagcaaaactatatatctaacattttcacagtattcctggctaatatttccagccagtcttgattatagctgtaaactaaaaatcctaagccccccaccaactgaatgcatcccctctgggctaaggagaccccagaaaaaaaccttaaactcagttcctggccatgacaggatgggaggtcaaacacacatcattatactccctctcttgtatggtttgaacacaactcatcagcattactgttgacatagagatcataagactaacagaacagactttttgtggcaataaattaccaagttataaagaggacataagaccatgccaggcaaaggctaagtcattcagctctacgcttaaagaataaactgtcctaggctgggcgtggtggctcacgcctgtaatcccaacagtttggaaggtggaggcagtagaactgcttgatcccaggagttcaagaccagcctgggaaacatagtgagacctcatctccccataaaaaatcaaacaatgaggatcaactgagcccaggaggttgaggctgcaatgagctgtgatcgcaccactgcactcccacctgggtgacagagcaagacccaacctcgaaaaaaaaaaaaaatttaaaaagaataaactctgtcgtaactgccacagatttttcttctttggtagctaaacaagcattggtctcaagataagcaatattgatagttgtgaatattaaacaattcgcaactcatccagctcacaaatgctaacaatccctgttccatctgccataactacagctttgattggagaagagagtgatttcagtaactttctcctgatcagaggaccaccaaccacagactggttctggctggtttacagagattgcgtacctgcttacctttgtgctctgaaaagaacttctgaagtataggcctaattgtaatacatttaaatcatttaaaggggtgtacaatcttttggtttccctgggccacattggaagaattgtcttgggctacacaaaaatgaatttgtgctgggccacattcaaagccgtcttgggctatgtgcagcccacggactgcaggttggataagcttgatttaatgctaaatctccaccccaaagtgaacatgggttgtatgttacatgcatgtttattcaatatgcatgtatcaagaccaccttcatgaatattcatagctcctcctgtaatctgttgaatatgtatgtttagccaacccattcaacataaagtgtctaccccaacccctccttcgaggtgcctgtctctggtcttggttggaggcatgtttctcagcctgtgggatggccaccttgcaggctgtaaccctttagaagaaataaagtctcctctctccttttccaaatttatacactgttatttttttttaagtgaacaaagcacaaaccactgatatttacaatacccggcagccgttgattctgtaggtcatgaatactcaaggttttcaggtttgttacagatgtgatgtgcctctcatcttctatggtgaggggactggcttccaccatgagagaataaatgttcttacaggtgctgaggaccaaactgaggcttccagccacaccagcacatctctttatttgcagcctgaggcttgtggcagagctgaatattttccccagatatctgatatcttgcttattcaacttgctgaaatcccggagtgtgacctccagagtcctgaattcctgcttccagttgaagaacaaagatacagccctgctgggaatgtaggtttctggggcctcttccatgtggattccacctgtgtcttctgcagccttttcccatgaagccatagctcccccataaaagtccagtttaatgaagtccagggcacttgcacaattgggcaaatgttcaaagaagtcaaataagtaatcggggatgttccctgagttgatatataagcttttaccttgaaagaaagcttcaaattcttggctcagggctgatttggatgtactctcttgatataaatggatgccacactctacaaaggaattgatgtttatggctttcagaatttcttgctcagtggtgtttttcacactttgcaaagattcctgtctccagagaggcctcttggcgatggaaagtccgagaaggcagccgtgttgatacactgctgcgaggtgcttcataacagccctggtggcttccacagatgacccacaggtgtaccggagcaggctgctataagtggatgtaatgtccgaaatggaaaccattttctgcaagtaaccattccccttggtcacctcctctggctcatgagacgtcaataaactgctgagtcttcgtcctgctgtgtactcctggaatgacttgtgaaagaatttatactttggcttgaacctttgagctgtatatttacagaggagcccagttgtcagcaggacatcctcattcacgctggacacatcctgcagttcgaaatcaaacttgtgggagaacacaccctccagagctaggtctccacagtggtccaggctccgaatgaagtcacttgcagccacacctttatgtttgtgtttgtttttctgtatcaacagatcatagaaggtatggaacagcgttgtttgtgtgtgagagtggaactcactttcacccatctggattgcacaagtgatgaccacaaagagaggggtcttcatgagattcctcaagcacctggatttctgaatttggagcaacaagccttcagcaagctccttgatcagcacttctcggatgagagcctgggcgctgtcttctgtcatatcccccacctcagcagtcagggcaccaaactgccgtatgtgcctcaggcactcagtggtagtggtgacgatgaccatgttcttgaagcggtggttttcctttatcagggcttcgatttctgggcagttctggggcttgaattcattgtagccatcaagaaggaaaagaaccctctgccgcagcttcagcagcatggccatgaatgtctgcttcctgattgtgccaggtatatccaggagttgatcacagagggtttcaaaaagtccaccctgggccctgctgagacggaggaagaagacgaatttgaacttggtcagagccttgcactttccggagccccagagcatggcaattcgctgcagcagagtggacttgcctttgccagattccccttcaatgatgcaggggctctgaagagcctgcaggaggccattcagggtcagctgctccacgcggtgatggtgttggtccttcctccacaggacaggttctgtgaaggtgcttttcaagttaaaaataatgtcaatatcttcaccaaggggataaaagttcagaaaagatggggtatggtacaagtcctttaaatcctgagccaaatcgtccaagtctccttctgatgtctgatgaaaaagacctattagagaagaggtgatgttaaagaagacccaattctgtgtctcctcaaaacctagagttcaggaggatgaacgggggggtgaggctgagaatctgccattggtgaatgtaatgtcctttcccagttctgagctggcacaaagggttctgtctgctccccctttccccagcatcctttaccccactcccctttttgctttctgtttcctcctttccacaaccaaatcttatagcagctggttggaaaagggaggagcttgtttttgggttaaggaaagtaaagaatttggcagagaaagatggttagggataattgtcatcatagtaggccttcactctgagtaaaatctgtcatgaccttatttactaattaaaaaaataaaaacaatattttatgaaacatagaatcatggttctgtgtcagtcaggctgtctttaccaggaggcctggacatggagtaggtagtcagctgggcctctctcccataggtagatctcatccaaccagggaatgctgagaaccactgctgcactggaagcttaactagtgcacttattctccagttttatcttgcagtgagacaatactcaatcatttatttcctggccttggggttatttgtttggcttcaccatcaattgatctactatgagtttttcctaaaatcatctaagcttttccttagcaggtatcaaaggccactgccaggtgatatgaagagaaggaaaagcagaggctctgccatggggaagatggatctttgttgtggtctattctacttgcagaaacagatgcaaaactaactgatacttactttgtccattcaagtcctgaaatagaggatagttccactccttaagggatttaagaaagaggttacaggactctgaaccctttttcaaaatcatgtgaatgatccctctagcagcatcctgctccaccttctcgcagcaaatgatgtttacttcttcgcgattcagaacattccatacaaataggtcatctgtgatttgctttataacagtcattcccattctttgaataagggctcggctattgtcctttatgaaattcactgaggagatggggagaaatatacatatttatttacttatataaaatgtgcatatccggctgggcacggtggctcacgcctgtaatcccagcactttgggaggccgaggcgggcagatcacgaggtcaggagatcgagaccatcctggctaacacagtgaaaccctgtctctactaaaaatacaaaaaattagccgggcgtggtggcgggcgcctgtagtcccagctacttgggaggctgaggcaggagaatggcgtgaacccaggaggcggagcttgcagtgagctgagatagcgccactgcactccggcctgggcgaaagagcgagactccgtctaaaaaaaaaaaattaaatatgcatatcagcatctgtctccagagcattagggccatgcatttttttcctgtgagcatctcctgagttatggagatgccaaatgcctgaattccaggccttcaagaaatgctctgccaagcattttttttctgagacggagtcttgctgtgtcacccaggctggagtgcagtgacgcgatctcggctcactgcaagctctgcctcctgggttcaagcaattctcctgcctccgcctcctgagtagctgggattacaggcacgcaccaccacactcagctaatttttctattatttgtagagacggggtttcaccattttggtcagactggtctcgaactcctgaccttgtgatccacctgccttggcttcccaaagtgctgggattacaggcgtgagccaccgtgcccggcctctgcaaagcatttctaaccccagagttattgatgagcaagatgttttgctttggtgaagaagtaaggtgagttatcttgtccctctgatataaagcagtccccagtgaggttgtagttgtaagaccgttggctttagaataatggcaatggcctaggatctgccacttgctaccatctatgtgaccttggcaagtcactaagcctctttgagtctatttcaattacgtgctgctggccgggtgcggtggctcacacctgtaaccccagcactttgggaggccaaggcgggcggatcaccagaggtcgggagttcgagaccagcctgaccaacatggagaaaccttgtctctactaaaaatgcaaaattagccaggtgtggtggtgcatgcctgtagtggcagctactcaggaggctgaggcaggagaatcgcttgaacctgggaggtggaggttgcggtgagccgagatggtgccattgcactccagcctgggcaacaagagcaaaactctgtctcaaaaaaaaaaaaaaaaaaaagtacgtgctgctaaatgtttcacaaactggccctggccctctgggagtaaaggccctaatttgtagcattcaccaatccccaaggtataaatattcctaccatggcctatttcaagctaacagcgtatgttaactggctaacaaaaatcctgaaaattcaataatcaggtttcacatcacagtaacaaccagctccagcacactggggattcctcatctgtacaatggtgtcaagagcattatttaacttaggaagttgttacaataattcatgtatagtatctcatacaaagtaataactcaatatatgttagctactatttttagcctttattcaggtgtcaccagacaaagagcacattgtatctccacagactttggtcttttctgaagagtatcacatcaaaacactggtttttatccaatgtaagctctctcgccaggtcttgagggtagctgtgtcctttttgtgtctgactctgcaaggtctaattctgaaacgtagaccacaccgtacccaggcactgtacccacgctatgtttgtgacagcttggagaaatgtcttcctggtttttaactctcagacaccgtctgcactagatttcttcctgggctaggctgctcctggttttttttttttttttttttttcagacgaagtttcactgttgctgcccaggctggagtgcaatggcgcgatctcagctcaccacaacctctgcctgccaggttcaagcaattcccctgcctcggcctcccaagcagctgggattacaggcatgcgccaccacacccagctaattttgtatttttagtagagatgagatttctctatgttggtcaggctggtctcgaactcccgacctcaggtgatctgcccgtctcagcttcccaaagtgctaggattacaggcatgagccaccgcacctggccgctcctggctttcaaacctgtgttgactgatcagagagggaatgcactcctctcaaagaccccagaacctctctggcctgaaatgcaccatcaatcactccaagcaccaggaccccaccccagccgtcctttctcaccattgcagagctctgctgctgacctcagctagaatattccctgtctacatgtcctgcaagagtcccatctctctccttctggggtctcatctgttctctagcttccacatcatccctatggaagtaacctctaagtctgtgtcccattgtgatcttcagtttagagctaaagaaatacagcctcacccgggcgcagtggctcacacctgtaatcccagcactttggaaggctgaggtgggcggattatctgaggtcgggagttcgagactagcctgaccaacatggagaaaccctgtctctactaaaaatacaaaattagccagtcgtggtggcacatgcctgtaatcccagctactcgggaggctgaggcaggcgaatcacttgaacctgggaagcagaggttgcggtgagcccagatggcgccattgcactccagcctgggcaacaagagcaaaactccgtctcaaaaaaaaaaaaaaaaaataagaaatacagcctcagaaaggcttagagacccacacacacacaagttcacagcctagccttcctgagactacctttcttcacctataaaatgaagacacgttatttaaaatactctaattatttaaaagactcattatattgaataagtcacataactctcatacccaaaaatgtcttaaaattggaaaagtggctaggcgtggtggctcacacctgtaatcccagcattttgggaggccgaggcgggtggatcacgaggtcaggagatcgagatcatcctggctaatatggtgaaacctcgtctctactaaaaatacaaaaaattagctgggcatggtggcacgcgcctgtggtcccagctactcaggaggctgaggcagaagcatcgcttgaacccaggaggtggaggttgcagtgagccaagatcacaccactgcactccagcctgggctacagagcgagactccatctcacacaaaaaaaaaaatttacaaaaaaaaatatatatataaacagtaagatattattttactatgttatatctccttgtatgtagaccatcatactccttccttatcaagtaattaggtggaaaaaatgctgctcatttattcattaattattcattcttttcagaatatctctttgtctagaccaatgcttttcaatagaactttctgtgataatgaacatgttctatatctgcattatacaatatggtagtcattagccacatgtgactactgagtgcttgaaatctggctacagtgactgtgcaactgaagtttacattttattttatttaaattcacctttaaatagctacagagggctagtggctactattaatatactagatagtgcaggtctacacccagccatttaaagtggaaggagctacattttggttgccacttagatctataccatgtttcttcacaatgagcttgacatgtatagctctctgctgtctggctgaacaggtgatgagaactaacagtttaaaacatacacctggtcactctttgtgtaagtcctatcctatctgtggttctgccttttatcacaggttaccatatttgtaactgaattcctaaaacaacagaagaatatttattggtaattccacatatgactggtcagaggaagccatgaactgattttccatttaaaatcaccagtatttggtagcagactgtataaccaggcagatgttatttctcatatacttacttgttctggatgaaagcttcccacctttctataacacaatagaaaatattatttccaaatggaaaggtcaaaggtgatcccaatattgtcctcttttttctgtaaaactactcttcattctgtaaaacaaacaaaacagaaccagagactatcaggtggaggggctgatgcaattatctaggtaatgccccgcttttcatagatgagaaaatggtgacccaaaccagaaaaaaactcgctcaaagcccctggctattcatggccaggccctaaagagaacccaggcggctggactccttgcctagagctctaaactatgttcagctggaactttgcccttctcttcaaagtttcttctcatttctgctgttcagagccaagaaggcaacatggaattaaatgtcaaaagacggtataagtgtcaacatgaatggtgcagagggtacgttctctccagtatttccaggaaagagtatatggactggaatcatccagggaggaagttttcatggaggagacagcacatgaaccaggtcttaaaggataagtagggctgggcgcggtggctcacgcctgtaatcccaacactttgggaggccgaggcaggcggatcacgtgaggtaaggagttcgagaccagcctgaccaacatggtgaatcctgtctctattaaaaatacaaaaattagcggggcgtggtggcacacgcctgtagtcccagctgttccggaggctgaggcaggagagtcacttgagcccgggagacggaggttgcagtgagccgagatcgtgccactgcatcccagcctggcagacagagcgagactctgcctcaaaaagaaaaaaaaaaaaaaaaaaggataagtaagatgaggccaggtagttgggctggggtggaggtggagatgaggatgtaaaacgccttgcaggtgagaggatgagatcagggagtatggaaaggggaaaagttctcttgtccccttcgcagggcttgcgatgggggtgtggctcacttcttcagtgcccgctgctcagacctctaggggatcatacagatgggcgggctgtggggttccaatcccacggcagtgtctagtggtgaatgtttacagctcctgaagccccagtgggtgtgtgttacagggtgctcttttagttcagctgtccgtaggcgtcttgtattagctcaatgggacccctgccttattgcaaggacagagggctttctgtattccggggttcttgccttggtgtaccggaggaattggatcacacgtggtcttggagaatgagcgcaaggtttcattgagtggaagaagctctcagcagatggggtagccagaagggagatggtttttccccggagtaagaccgccaccaactcttctccaaccctccaggccaaactccgagtcgttcctctggtggatggcctgctggcgtgccgatgtctgttgtgtgctcttccgccagcattctcccttcaacgtcctctggacgtccagctgcttgtatgttcttccgccgatgtgttcctctcgacgtccagccgcttgtgtgtctgcctgcaagggtctctgggatttttataagcataggatgacggtgtggcaggccagggtggccttgggaaatgcaacatttgggcgccaaggcaggagtgcctgtcctcacctaggtccgtgggcacaggcctgggggtggagcccttgccagggacgcgcccttctcttcccagcacttcccttccccccttccctatcaatatgagtaattgaggagacagaaaaaaggagttatgcttccagggtacaaaggggaaaagctatggaaagccttgtacgccaagatgaggcatttgttctttatcctatgagcaactgggagagattatggtataaggagtatgtttaaagtgatgttttaagataagaaacggatttcaatttcctggtatggtcctgtcatttcatcctcctagttgctttaaaagcaacttcctttctcccttcctcctccacacactctgaaaagcaggggcccagaagcctctgagactgctctgtgtgcattcccaaaccaagttagatgatctaccccggctcctcatacacacatacacgaccccctgcatcaggatgaagatgcaaagtctgaattaaagacagcatgagagggcagacaggaagtggggaagagaactagaatcactgggtggagagaaacaaaatgggagctatgtgagtgtgattgtggtatgtgaatggagttggcttgggaactcatgtggatggggttggcatgggaactcatgttatcctaacattaaaactctttttttgagacagggtctcactctgtcacccaggttggagtgcagtggccccatcatggctcacggcatccttaaccttctgggctcaggtgatcttcccacctcagcctcctgagtaactgggaccgcaggtgtgtgccaccatgcctggctaattttttttttttttttttttttttttttagagacagagttttgccgtgttgcccaggctggtctcaaactcctgggctaaagtgatctgtctgcctcagtctcccaaaatgctgagatcacaagaatgagccaccgcgtctggccattaccctaacattttattatgaacattttcaaacatagagaaaatccatccctctattcatttatcaatctattttacttattttcttgcatattcaatgtaagttgcagacgttagtacacttctatgttcatataattaactagaattcaatattggtttattattctttcttaggaaaaattcacctacagtgaaagcagagatcttaactgtaccctttgatgagctgaaaaatgcttctacctcaaacacctatcaagacagaaaacattaccctctccttagtatcctatgccccttcccagtcaaattccatctctgccacaccctcaaagaaaatcactcttctgatttttttaaaccgtaaattagcctgttgaagaacttcacataaacggaatcatacagtatgtgctactcctttcattccacacaatgtctgtgtaagtcactcatgctgttgcttgcagtataagtagtttgtaacatttcattgcttagtagtattgtactgtataaaatactagagtgtattggccgggcacggtggctcacgcctgtaatcccagcatattgggaggccgaggtgggcggatcacctgaggtcaggagttcaagaccagcctggccaacatggcgaaaccctgtctctactaaaaatacaaaaattacccgggcatggtggctcatgcctgtaattccagctacttgggaggctgaggcaggagaatcacttgaacccaggaagcggaggttgcagtgagccaagatcgtgccaccacactccagcctgggcaacgacaaaaaaaaaaaaaaaaaaaacaacgaaaaaaaaaaaactagagtttatttatctattctcctgttgatggattgggttgttttcagattggggctatcataaatacagaacaatgaatacttttgtacaagggggtccttccccacaaaaacttctctaagaatagcttactttgactctgatctttctaatttcacaagctctttgaataaggatctcctcagcttaaactagatgctcacagccatggcaagtttgctgtgaatgttgctgttgtgagagtgataagtgaggataagaaagtcctagataaagtttcctttcattcaaaaagcccccaaatcatatcttttctaataaaaagcagcctgaaaaatcaagctgcaagtatagataagctaaaagcttgcattggtaaatgccagtagctgtgcccatagaaaaaagccacctgggggccaggcatattcaacatggcggatccatcttcccttttctttttcaaccatgtgtacagtaggaacagacaacatagtgccggccagatagagaccccatctgcataataaaacataagggtggaatggccggcttcttcgtgcgctatgcaaacgttataccggttctgaccaatctctcagtccctatgtatatcagacaccaccttctcaagttcatctataaaaccccatgcattggctgggtgcagtggctcacgcctgtaatcccagcactttgggaggctgaggcaggcggatcacaaagtcaggagatcgagaccatcctggctaacaaggtgaaaccctgtctctactaaaaaattcaaaaatttagccaggcgtggtggtgggcgcctgtagtcccagctaatcgggaggctgaggcaggagaatggcgtgaacccggggggcggagcttgcagtgagccgagatcgcagcactgcactccagcctgggcgacagagcgagactccatctgaaaacaacaacaacaacaacaccatgtatttcaccacaaaaccactcactcaggttcccctctctctctgcaggagagagagctattctcttttctctttctttcgcctattaagcctccccccttttgtttttttttgagatggagcctcgctctgtagccaggctggagtgcagtggtgcgacctcagctcactgcaacctctgccatctgggttcaagcgattctcctgcctcagcctcccgagtagctgggattacaggtgcatgcctcctcacccagctaatttttgtatttttagtagagatggggtttcaccatgttggccaggatggtctcaacctcctgatcttgtgatctgcctgcctcggcctcccaaagtgctgggattacaggcgtgagccaccatgcccggcctaaaactccactctcaaactcacttcttgtgtgtctgtgtcctcgattcctttggcgtgagacaacgaacatcaggtatttaccccaatgatgctgcttcaaaagcatatctattttcagaaaataaagtttcccttttatgttaaaactgattcattaacaatataaaaaattgtcattgaaattggagcagccaggcgcggtggctcacgcctgtaatcctagcactttgggaggctgaggcaggtggatcacgaggtcaagagatcgagaccatcctggccaacatggtgaaaccccgtctctactaaaaatacaagaattagccaggcgtggtggcaggcgcctgtactcccagctactcgggaggctgaggcaggagaatcacttgaaccagggaggcggaggttgcagtgagccgagattgcgccactgcactccagcctggtgacagagcgagactctgggtcaaaaaaaagaaaaaaagaaagaaagaaaagaaaagaaattggggcagctcaggagcttaagcaagggcacattttggtgtcaggattgcgttcaaactacagctctaccactgacacactaagagtcctcaatcaaggggtaatgactggcacacaggaaggactcagtgaatggcggcaactgtagattcttctctccctttctacttccccaaaaaggggtgggtttgggaagaatcacaccatccctgactgggtcaaagtttaagtcagagtagaaaaagaggaagaagatagaggaaggagctaagatgtataaagtttttaattgctctcaagaacaaaatcaatccatatactgaagatcatgtaatttttctcagttacccactggcataaagaatagggctgtggaccaggcgtggtggttcacgcttgtaatcccagtgcttggggagactgaggagggtggatcacctgaagtcaggagtttgagaccagcctggccaacatggtgaaaccccatctctgctaaaagtacaagaaattagccaggcgtggaggtgcacacctgtaatcccagctacttgggaagctgggacaggagagtttcttgaacccaggaggtggaggtttcagtgagccaagatagcaccattgcactccagcctgggtgacagagagagactctgtctcagacaaaaaaaaaaaagaataggactgagaccagtgtactctcttggaatgtagctatggccctgcaacccctccccgcaagctgtccagtgaataactgaattgggtggaagaagtccttcccccacatttgtacattggaaaataatataataatatatattatatatatataggcaatctgcctgcctcggcctcccaaagtgctgggattacaggcataagccaccatgcccagctggaaaataatatttagtactaattctaaaattggcattttcttaaaaaaggttacatgagctcctcagagaactgaagtttctctggacccatataacccacgtctatggggtcattcccacacctcacagataaaataagggaaagagtacatataattaggagcagacaggaagcacacagaaatggaaaatgtgtgtgggctttggcattgcagatctgaattcaaatcctcactctgcaccttatgaggtaagtatccctagacatgttacttagcctttccgaatcttgctttccaaatcatgcataatattcacctccctggactattgtgaagattaaacatgaaagtagttgtgacaaagatggtcagtgggtattatctgtcttcctttctagtaaaaaggctctagactagaatgttcttaggtctttaataggcttcagcaatctcacatgttaatattagtgttatgtgctgaactgggcttcccccaaatccatatgttgaagccctgaacctcagaatgtgactgtatttgcagacagagcctttaaagaggtcattaagctcaaatgaggctgttatgagaagaggaaatcgggacacacaaagggagataccaggaatgtgcatacagagagaaaaggccaaggagggaggcgtggggagaagccaaccctgctgacaccttggtcttggacttgcagcctccagaactgtgggaatataaatttctgttgtttaagccacccagtctatggtattttaaacacattaatacgactaatattataaaagtgtgtgaacagttaagaagtgtgctgaccaggttctatcctagttttgtagacaattagcagtgtgatgtagggcaggacatttaactcctctctaccacattttccacctctcaaagccaggctgcaaggatctactgagataatgtacataaagaccctatcacgaaataggtgtcccgtaaagggtgatttccttcacttctgtctccaaatatcaggtttctcatcagtaacttgggagattggatggactaagtagtccacctcgttcctttcagctttgatcatctgtgattctaacaacagtcttagcaacaagagtgagtttcctggccgggcacgttggctcacacctgtaatcccagcactttgggaggctgaggtgggcagatcacgaggtcaggagttgagaccagtctggccaacatggtgaaaccctgtctctactaaaaatacaaaaattagctggggcgcggtgccgggtgcctgtaatcccagctacttgggaggctgaggcaggagaattgcttgaacccaggaggcagaggttgcagtgagccgagatcacgccactgcagtccagcctgggtgacagagcaagactctgtctcaaaaaaaaaaaaaaaaaaagagtgagtttcctttctgtaatgccaaaaagtgtttccaaagtcctttccatctcacagtagtccaaggggtacatgtaccccttgaacctgatgaagccccagcagacccgattaaccacccctaaaggtttctcggcaggcaaatccagccaggcatgcaaatcacactcgtcaatgttaaggcttttgtacatcccagacacaagctttaaatgaatgtaaacccagattttaatatttgggccccagaccttaaaaatcccattctctctacccacagtacctggctgagcaatccaattgccctcttcttgggagaccaagacatgtttttaaaataaagtttctttgtatttgctttccgtttcagtgaggcctcgagttcttgtagaccagataccttcttgttctgtgagaggacagtgtacagagaggggaactgctgagcagttccttttttttttttcaaagcacagtaagagtggtttggacacaagtactaccagttcagaaagggaagatgggtgtaggcaggagtagccggggaagaagtagaacttcagagtaaaagatgcaagagctagaaattccgtcaagaaaggaattactcatttgtttcctgtttgttcacaacatatgaattcattgctgttgagttacttattctataccttaaaatgaaacaaagtcttctgaacatccaacatatattttttttctttttctttcttttttcttttttttgagacagagtcttgttctgtcacccaagctggagggcagtggcacaatctcagctcactgcaacctctgcctcccgggttcaagcgttcctcccgcctcagtcctcccagtagctaagactacaggcgtgcaccaccatgcccggctaatttttgtatttttagtagagacagaatttcaccatgttggccaggctggtctcgaactcctgacctcaggcaatctgccagcctcagcctcccaaagtgctgggattacaggcgtgagccaccatgcccagccacaacatgtatttttaatgcttaaccatgggagatagagcggtaaatgaaatgagccagcttagttggctaaagcacattgctactgcattcaaggtcatgcttacccctgtaccttgaatcccagaggacttccagcag

SEQ ID NO: 732 - DNA, 41295 bp, Homo sapiens
ttactggcttcgagtacactttatttaagcagttactagtttaaaagcacctgtaataacactgagatcatcatcatcaaattgccacccaacaagcctagcttcttgcagaaaagttaacttggataacacttggctaagttttctgactaatgctggatcaggtagaaattctttagtactaaagtcaaaaaacactaattgcttaagattctcaaatacacccatgaaggcaagccatccatcactgctcacacgatttcccgccaaattcaactgctggaagtttttcagagggttctttccaaaaaatgcacctgggtaaagaaataagtatattagttggaagaaaaattttttttaaaaaaaaagagaaataggttctacatttattttacatacttttttttcactctgaaatggccatgtttgaaccagtgctttgcctcagaaagaaattattaatataattctctatagctagggcagtgattgtgaatatggtctattatattttcctagagtataagggaatctgataaatagtgattcgtagtgaggtagcaacaatatgtaaatgaattacttttttttccccttttccttactcctaggaaatggaaggttgctttaattaaatattcagtacttgttttcaaaactggagtcaatctttggcaatattaagtcgtttcctcttctgaaaaagtaaacaccacctaactgttgtttctatgggtatgttcctaactgtaaacttgagtaagtgagcctccttcagtatctaaagatttgggtgtttttgtttacctgtttatgtataaccctcccgagcctcttcaggaagttcctccattccttacagaatagggcacctaaagtatttcctacatagggtaggtggatatcctgtctttctgatacacaaagaatgcacacacacacacatacatacaaaggatgtgtgtgtgtgtgtgtgtgtgtgtgtgtgtgtgtgtatacatacacaaatagtttagtgttcattctttatcccatgttaccagtttaggtggtactggaacccaagtgagtcttgcaataagaaaaaatacctttctttcaggttatttaccatcatacagattggccagtatacaacattaggatttcacaaaactagctctgtgttaattacacatattaaattgtgcaaagcgttagccctacccacctacctggccctttctggatgactaagttcaccttgaagtacagagtggacagacaggcagactggacatgggaactcttacttacatgtttatactccagagtatcacacacaaaatgcagaagatgtatgcctggtttatcaatccacattactcggctcatccgagctcatcttagtcttagtgtacctcacccaactttggagggttaatttgttgtatattaaacttgtgtttcttgggagatgtgtaatattagataatgttccagaaactgacccttatggaaatgaaggtccatgattcagtttggattccaagtaggaaaagaggttttaaaagttcctttccattgtctcagtgagaagaccactaaagagttcaagttaaagaaggaaagattcggtgctgtacaaccttaaggttagcaagcaaagactaaaaggtatctgctaccagtaatgagggcttaatgacagaaatggacagtcttgtccgaccagcttacgtgggtgaggtcaacctagttatgcactgaaactatacccttacccactttcagtaaaggtgtttaccagctccgtagtgagaggagatctgtgaatttggtgtctgatgtcactgcatggccttgtgtagtttgttcagtgcaactaagtacattctagagtgtgtccttagtcaatgtcagccaatgcttttatcaccatcataaggtcttgagtttcgaaaggtcttcaggttcttctttacagacacctaaagtgattggccctgcctgaccgtggtcaagatgctagcggctaaagtgggcaaagccaggtaaggagatgattcacagggttctgccttcatgtctcttacccatggtcagtgtcactgacaccatctttgggccttctttgccacttttattaatttgaaaagtgagacagaggccgggtgcggtggctcatgcctataatcccagcactttgggaggccaaggcgggcagatcacctgaggtcaggagtttgagaccagcctgaccaacatggagaaaccccgtctctagtaaaaatacagaattagccaggcgtggtggtgcatgcctgtaatcccagctattcgggaggctgaggcaggaggatcacttgaacccaggaggcagaggttgcggtgagcagagatcacaccattgcactccagcctgggtaacgagtgaaactccatttcaaaaaaaaaaagagaagaaaagtgagacagactgctagttgttcccaaaactgtctctccttattccatagttaatagagttttatttcggcatatggccactcatatcccaacctcccttgctattaggtgtggctaaatttttgccaaggaagtataggcagaagtgatgtgtgcaacttccatgtcacttttccgcttttcccctcttctactaggttgaaatgatcacagggcagtgacctagctatggccataaagtcaaaaataacactcttaaggaatagaggagtaaaaaaaaaaagtaggggtctgggcctgaaagactgcacagaggaaaaccaccccacctgcctggactgctcatttctggactgttacatgatagagaatcaagttctgccttctgtaagccatggtatagttgggtctctgttatcacagcgtagcctatgcccagcccaaatagtacctaggtccttactttcccctgccttccacctcctctgttccttggaggatggctttctccctgctctctcttccatctcatgttcatgtcctttctgcctttgccccttctccatatgcttcccagcatggcatgcactcagtccaaatgctggttgccagttgtgtgtctatttaaggctctttccccaaagatcaactttttttctccttctcagctagcagaacatattttcaccacctaaaaggaatttaagaagaatttaaagcccattccaccctcacagggtgagcaatttatagtggttatctactaaggtataaggatcttatcatcaatttaagagagtttcttagataattattggaatgtgtgctagtgcaggaaccaagaacaaacaacatttgtcataagccaagggcatgccttttgttcatttaatctgcagtgcttatgttatgaggagcagactagatccaagagaaacagaatccatgacatttagagccataggctgtatgtgggctgtggagagtgcaaatggcttgattggaattccaggaaaaatctcagatgccctgggtagaagggttctgattcttgggggttcctgtatcccaaacacaactcttcatttgtgttgtcctgtagttcacctgaacgagtaccagagttctcactgtttattcattcagcaacatctttagtgctactatgtgctgcggattatgctgggtgctggggatatgtgtaaacgacagacatggtccctgtctaaatgggcttacaaaatagtgtgaagacatgcattataaagtaattagatgggtggtgggtgctatggtaggtcagggtaccctgggagcacacaaaagcaataggctttcccactccactttgttcccagaacacttgcaattgggcttatatgctccaggaggaagactggaggattcttaggagaaatggaactgccccccgggaaaaggccctacaaagaaggggccattttgcttgcccaatcaccccctagtggagttagcctgtcaaaaattcaccgcctcccttagacacacagaactccctatcaacttgtgtctccctctaaaatgtgaagaggacagtgcaggattatcagacatttgacaacagcctcccacaaggaagactgagactaaaagccaaaacaactcccaaagaaatcaggcactgtagaaaacaagaaaaatcaaactccaaagacctaagtttttcagagatcctaagtttttcagtagactgcatctactcagcaacaataagatgctaagaaagagcttttggaaaataaaatatgatagcgggatctatacagcagaatgattgggcccaggatttaacacagagcttctagaacatgaatagggtctgcgatggctttttttttttctttttttgagacaggttctggctctgttgcccaggagtgcagtggtgcaatctcagctcactgcaatctgccccactggctcaagtaagtgatcctgccaactcagcttcccgtatagctgggattataagtatgtgcactacgcccagctaatttttgtatttttagtagagacagggtttcaccatgttggccaggctggttttgaactcctgacctcaagtgatacacccaccttggcctcacgaagtgctgggattacaggcatgagctctctttgagaacaggctggatagcagagttcagcttcaaacatccaagttgaaagataccatttaacaaagggttttgttagagcaggtgaaattggtcaggcatggtggctcatgcctgtaagcccagcactttgggaggctgaagcaggcagatcacttgaggtcgggagtttgagaccagcctggccaacatgatgaaacctcgtctctactaaaaatacaaaaattagctgggcatagtgcacacacttataatggcacatacttatagtggcggcatggaccggtaatcccagctactggggaggctgaggcaggagaatcacttgagattcagagaagcgaatagagaacagagaatcccaggaagcggaggttgcagtgagccaagatcgcaccactgcactgcagcctggaacaaaacaaacaaaaaaacaggtgaaatagatacctgagctagcaatgatttttatgttgtagtctcagattgctgatgggtaagaaacaaaattttgggagtcaagcaaaacatggcaaagcttggagatcaaatgcaatctctgaggaagaacagcagatagtctagaccaagctttaaggaaaactagaaacatttaatatctgggtagaggaatcaccattgaaaagaagactgagaagtagccaaggtggcatggaggtcaagagaatgttttgaaaagaagggaatgctcagtgtcaactcctgcggaggaatcaaataaattaaacacttctgaaagtgtctattgaaattcagccacatggaggggtgtggagagtcagatgcaatgagtagaaagtagcagatggtcaggaaatggagatgtcataagggtacataaaatttgttttagagcttttaccttgaaggagaggagagatagaatgataaccaaaggaggaagataggactcagggagagttttatttaaaatggaagagatttgagcaactttaaaaactgacaggagggagtcagtaacaagaggcacagtcaataaaatgatgtccctgaactggagtgagggtgaggctggcatctcaagcactgctaaagagactgcccttaggtaggagaagagaaacctataagctctaaggagaaggagagaaaaaaataacagtcacatcctctgtgaaataggagacgctgagtactgattgagaagaaaaaagtgtgaaatagtttacatacagtgttgaatacagaaacacagtaagattgccaggaaatattaagagagattgtgtttattcactgttttttgtttgtttgtttgttttgtctcccaggccggagtgcagtggtgccatcctgacctcaggtgacccacccgccttggcctctcaaactgctgggattacaaacgtgagccactgggcccagcccccgctattttttttttttttttttgaggtagagtctcactctcccacccaggctggagttcagtggcgcgatcttggctcactgcagcctccaccttctcggttcaagagagtctcctgcctcagcctcccaagtagctgggattacaggcatgtgccaccacacacagctaatttttttcatactacattttttaatccattcattatttgatggacatttgagttgtttccacttttgagctactaaacatgctattataaacattaatatacaagtttttatgtggatattggttttcatttatcttgagtacctaggaagagagttgctgggtcatatgacaactctatgtttaacattttgaacaacttgccagaatgttttcctcagcagctgcatcattttacattctaactaccagcatatgaatttctccgtatccttgccaacaacacttgttattgtatgtcttttaataaaaaataataaccatccctagtgggtctcaggtggtatctcattgtagttttggtttacattattaccctgatggctaatgatattgattatgttttctgctatttattttgcgatttacatatcttccttggtgaaatgtctgttcagattcttgcccattttacaaattgggttatttgcattttttatcagtgagttgtaagagtttttttgttttgttttttgacatggagtctcactctgtcacccaggctggagtgcagtggcgcaatctcggctcactgcaacctctgcctccaggattcaagcaattcttctgcctcagcctccagagtagctgggattacaggtatgtgccaccacgcccggctaatttttttgtatttttagtagagatgggatttcaccatattggccaggctggtctcgaactcctgaccttgtgatccacctgcctcaacctcccaaagtgctgggattacaggtgtcagccaccacgcccggccataagagtttttttatatattcaagatggaagtcctttattagataatgtgatctgcaatttttttttcacattctgtaggttgtattttcactttctttctttttctatttttttttgtggggggggggtgggggactgggtgtcactctgtcacccaagctgcaatgcagtggcatgatcacagctcactgcagcctcaacttcctgagctcaagccatcctcccacctcagcctcccaggtagctgggactacaggcgtacgctgccacacccagctaattttttggagattgagttttgccatgttgctcagactgggctcggactcctgggctcaagcaatctgcccacttcggcctcccagagtgctgggattacaggcgtgagccaccacacccagccttagttttgaccaaatgtctttttttctgttgcaggaactcatccaggataggacattacatttcattgtcatgtctctttaggttcctcatgcttatgacgatttctcacaatcaccttgttttttatttccttgacagtttcaaggaatactggtcagttttgtgtagaagtccctcagttaggattgtttgatgtttttctcatcattagatgggggatatggatctttggggaggaatatcatagaggtaaagtactattttcgtcatgtcatatctaggtacatactatcaacatgaatcaccactgttaatgttgaccttgttcacctgaccaaggtagtgtcaacagctttctccactgtaaagttactcttttttgctgccttttgctgcatgctacaagttttgatatacagcgttttcttaccattcacttctaaatattttcgttgaaatttgtcagtatgaacttgtatttatctcccaaattttgcagtttttccccagtatcctaagtgtagttacaaaattttaaaaagggaaatttaaggacaatccaggcctggggttttgtcaggaaagtacaccccatctactatatttcatttcatacctctcattccacatctcatgttctgcctgcatctcattaggtagtctttctttaattagagactccatctctcattacactcttcatttcaccattgcatctatcacacacatccatcactcaaagtcattgcctgaattgactcatgctactgtgggccatgagaatttcagctattaaagacaagaatgtttgcagggatggaagatggagttgaaactaggtaggaaggcaagtcaaaatagaaagggcctgaaaaataggtagaaggtagcgggatcgacggactggaagtcccagtgaagtaaaagaactggtgattaggagtagatagaaatacaggaggttgtggtttgagaatgggatatctgcatttattattttgcaggtagaacaattttaagtggcttgtcataatctagtcattgcatgctcatagaatgaatggatgaaggagagtggaagggaaggtcgttgaagaggaaggtccattagcggagcatagtggcctctagtcccagctacttgggtagttgaggaaggaggatcccttgagcccagaagttcaaggttagtgagctgtgatcacatccctgcactccagcctgggcaacagggagaccctgtctcaaagagaaagagaggggtgggggagggaggaaggaaggaaggaaggaaggaaggaaggaaggaaggaaggaaggaaggaaggaaggaagggagggagggaaaggaagaaggaagggagggagggaaggaggggaggggacatactgctttcactgtatcccataggtttcagtatgttgtgtttccattttcatttgtcttaagaaattttaaatatatatatatatatatatatatatatatttttttttttttttttttaattgtagagacgacatgttaccatattgcccaggctggtttcaaacttctgggctcaagcagtcctcccaccttggcctctcaaagtgctgggattatagtcatcagctaccacacccagcctatttcaagaaatttttcagtttccttctgaatttcttcattggcacacttgtcattccagagcatgttgtttaatttccatatgtttgtatagtttccaaagttcctctggttattggtttctagttttattctattctattatggtcagagaagatacttgaatcagatttcaattttgggggattttttaagacttattttgtggcctaacatgtggtctatccttgagaataatccatgtgctgaggagaagaatgtgtattctgcagctgttggatgaaatgctctataaatataggtccatttggtgtatagtgcagattaagtctgatgtttctttgttgattctctgtctgggagatctgtccaatgctgtaaatggggtgtcgagtctccagctattgttgtattgggttctatctctctctttagctctaacaatatttgctttatatatctaggttctccagtgttggggacatatatatgtgtgtgtatatatgggaagatgaagaagctctggagatggatgttgtgatagtggcacaataatatgaatgtacttaatgccacaaagcttttacacttaaaaacagtttaaatagggccgggtgcggtggctcaagcctttaatcccagcactttgggaggccagggcaggcggatcacgaggtcaagagttcaagaccattctggctaacacggtgaaactccatctctactaaaaatacaaaaaaaaaaattaggcgtggtggctggcgcctgtggtcccagctcctcgggaggctgaggcaggagaatggcatgaactagggaggtggagtgtgcagtgagctaagattgcgcaactgcactccagcctgggcgacagagcaagactctgtctaaaaaaaaaacaaaaaacaaagaacaaaaacagtttaataaattgtacgttacgtaaactaaacacattttagacaatctgtaagagaaatgaaggcaatcgaggctgttttcacaagtccttggctttagtatgatagcttccaagttgaacctgatgagcctgacctccttgtattaatgtttccatacgctggattggaataacttgtgcaaccagtgggatatgtcagaagtgaccagaaatgagtgggctgccatgttgtgaggacactcacagcctgtgaagaggtctaatgatgaggaagtgaggcctccagccaacagccagtgttaacttgccaaccatgtgagaagctaccttggaaggagatcctccagcagcccctctcatgagagaggtcaagccagagctaacctgctaaactcctaaattcctgaaccacagaaactgtgagataatggttattgttttaagccattatgttttgaggccatatgttatacaggaattgaaaactaatacagatagtatgaaggcttctttcatcaactgcctgaggttggtggtgtcttcagtcatttatatagatctatttgtttctggataatattacagctatttaaagatattttgtggctctatttagatacagctacattcgcctttatatgttttgaatacccagtaagtaacttgaaaatatttcctgatattggagggaggggcattgctgaatttcagaaagttaaggctagtaagagctatgactaatataatacatcttgttggatactgtgaatgcttttcatttaattctgtaggtaaaggaaatagaatctgaaggaaggccagtgttttaagtcttcttactctaacgtgaatgaattcattagacatatttatattttaaaaaaaagaggaagcaaaataaaataagggggcaaaataagcaaagccaacttaagaattttttaagggccaaatccagttatcttggctctgtatgtgtgtacctacctaaaattctaatctctgtatctgtgagtctccagtttttcaacccaagcttgacgagttgtgggacctcctccaaatgtttcaacaggctgctcaggctgccttgcacgtcacagccccagggcagcatcagtgcggtgagctgttctagcacgttcatcctgtcgactggaagaaacaaagagcagttcagggactggatggtctcaaaactgaggaagaacaaaggggtgttaggggaggaatgatctttatgtttggtggctctgcagcctactcaatctgtaatgagaatctacttaatttttggtttttttttggaaagtattcaagcatatacaaacattatgcagaagaatataatgaaactatatatactaataagacaccttcaaaaacattaaatcatgggcaatcttgcttaatcctgacctaattcctcctgtattattctaaagcaaatcatggacaatatgaatcagttctttccttttttttcttttaaccataatcacatatcactatcacacctaaaaaatcatatcaccaattccttaagcaaatttgtcttgcacatcggctactcttgacagttgcctcttcaaaggaggaaagcaggtgggataccgcctcaaagtgcagtgagcatatgtaaactggtgacttaaaagacatgggcctgtgttccttaagggcagtttaagaaaggcctaaatgattttcctaaggagggtgcatctagtaaggcacacatgggtataaaagacctcaggacccaggctatgtatttcgactacccagtatacatattcaagtatctaattttggctgaattgtcattcttactcagttcatgaagagcttcatttccatctttttccaggtaattttctgataaatcaagaatgctcagtttgaccaaattgtgaagattctgagctggggaaaaaaagtaatccaaaataaaaagattttcaggtaaatataaatgtattttgaagtatccttagaataattctgagttttatcttctctgctaatggtagtgcaaaccataacttgccttggttattttaattatttccaaaggctctggtgtaggtgtaacccccaaatcccatggttatgaccaaatgggcaaatagtcattggtcctaggttctgattaatgaattccaggtcacgtagaacctaaagcagcatgggatgtagttgttatgtcatcatggaaaaatcacttggtctctctaagcctcaatgtcttcctctatagaatgaggtagttggaccagataaaatgtaaagttgcttcaattataaaatgccgttaatcatgcaggagaaacaggaacaacaacaacaacaaaaatgaaatgagctggttttgtgtacctcaacttagatgattttattgacataatagttgagatattaataataaaaacatagtaaaaaatggatgagaaaaaaaacaaatagcaaaatggcagattcaaatttatccatatcaacaattacattaaatcttaatggactaaacactccaattaaaaggcagagataatcagatattcagaactttttttaaagcaagacccagttttatgctgtgtacaaaagacgtgtttgaatgacaaagacacaaatatgttgaggtaatggaaaactattttgcatgcaaacattaattatataatagtaccagtctagctaagaattgcttagtgcttttcttcacatattatcactcttgcttaatctagctgaagttttttctgtcagggctagaaaaatctcctttttaaaaaaatcagacaagtttttcatgaatatgtactcttgttataatattggctattattatttttaatcaatcatatgagcccttttcttaaagtatcttctgggttttgtgctctacaataaaaaacctgctgaacttctctttaaaagagtacgtttgctatttgcagttctaagcctgtctctccccatcagtaagtagagaaataaaggcatgtgctcattgttctcatattcccagtacttatccagcctttttcaactgtgggtttctctagctgtaactttatattagtatacaaatggcttccttagttatctttagagactcccagcagttatatagtttaactttaaaaagattataccactgttttccaaaatctaaattttaaaatatgtctgaattacacatgtatagtttatccagaaatatgcagttagtttccccgtagttgatatgcatccctttgggaactcagaaggctcaattatcatatcatgcacattaacttcatcttaacagggcaatgggtaggaattagaagcctgagatcatttaagaaaatctttatctctcacttctcaatcatttatccattcatttaaatgtttattaggcagtaaattatatgaccggttgtgtggcaagtttcaagcacctatttcttattttcttccttttcactttctctaaaaattacatcttcaattattctgaaattctcccctattatccatcaatagttgatttaattctaatatggagaaaaatcattaaaaacaatctgcttattatcgagaagtttttattttccagttttccttaaaattaaatttccatttgagacatttagtgtgaattagtataatagtatcacatgttctgttatactgtcctcattcagttaatggaagcaacagttacctaggattttcactgcatttgcagacaagcagcaggagactaattgaatttcttcaaggtcacagggttcacttgacagagacttgactatgtaatccattccctctccaatgtcagacaagtgggtcaaatgaaataaacacatcttcttcaggtttttcaggccttcagctgaaaaatgatagaaaggaatgcattaggataccaagttaattcgatttaagcatagattaatgaactgaaaagaaagcaaagaataattgtgcagagaccttgccatgttcttcctgcagcgactttaagttacaaagaatcaacgagagctttttttctttcaattctcactttccagtctcttggaccacacaaaaaatcacttatatggaggttattctcttagtagcatgagaaacactgtagtaaatttgtagtctttttaatgggcatcaatgtatactcttaccgtaattctttacatgaatgaagtcttctagagcactctcctttcaatcttctcaaaaatcttaaacagcgggggggctgagttcagggaggtagatgaggacttggctccttggagtgcttctagtgcaactgtctacagcctcaaaagccttgcctggactcatgatatggggcctgcctgaagctttagaatgaagaccacatccactgcagcatgtttaaccagaagaaagatttaccttatatcaacagtataattggaaacattctaaaatatcccccgttcttaagtctaaagctaatgtgcagtttaggattggttaggcctcactttgtgtcattaaaatactgtcttatcttgatggtactgtagcctacgggaaagaaatatatgattttaatgaccaggcatggtggctcacacctgtaatcccagcactatgggaggcagtgataggcgaatcacctgaggtcaggagttcaagaccagcctgtccaacatggcggaaccccatctctactaaaaatacaaaaattagctgggcgtgatggtgcacacctgtaatctcagctacttcggaggttgaggcattagaatcgcttgaacccaggaggcagaggttgcagtgagccaacatctcaccactgcactccagcctgggcgacagagcgagactcccatctcaaagaaaagaaaagaaaagaaataaaatatatgattctaataatatcagtcttgcagagctttcgggaaggttgcagataatgtacgttaacatatttaatgtggtgcctggcacatagtaagtgctccataaatgttcattgttgtcatgggagtatataccggttaaaggttgtgagcatgagctttgcagtcagttcctggatcccctacttaataattataaacttgggcaagttattcaatcttttagctgaagcgttagggatcattatatctatgtactaggactgttgtggggattcaatggaatgaggtatataaaactgccgaggctagtgtctaatctatagcagagtaactctttaataaagagtaaattattactgatataattagactggtttagtcaagttcacattttgattccttaatagcagaagcaggctatcctagagaggtactttttgacctctttctaccagttggtaagatcttgagcaagtcaataagctattttaggttctagtggagttttctgtgaaatgaatgagttgaattagatgctctcaatccccttccagctctgattttctgtgtaatttatacacatgcaataaatgtttattgaacactgaattaatttgattattctcacgtaggacatataaggaaaagaagtcagccatgttttgcttttgtttttgtttttgtttcaagatggagtctatctctgtcaccgaggctggagtgcagtggagcaatctcggctcactacaacctcctcctcctgagttcaagtgattatccttcctcagcctcccaagtagctggcattacaggtgcataccaccatgcccagctaatttttgtatttttagtagagacagggtttcaccatgttggccaggctggtctcgaactcctgaactcaggtgatccatctgcctcggcctcccagagtgctggaattacaggtgtgatccaccatgcccaggcttcagccatgtttggcttataggctagagttgtctttcggcaggaagcagaataagaaagaacaagatgaagggaagagaggagtattttagtgaggactcaagtagggaaaaaaagagccaaaaaaaaaaaaaaaaaaaatccaacacacgagaaaacagggacattcaaggaaagcagctttaacaggaatcctccctggcctgcagggcctggttccctgtggtaagccatgtgttctgcttgtgttcctgaagtttccttttccttttcatttttttgattggggaaacacaacctgcagtgtagaatgaaagcatgcttcccccaaagttttcttgattcacattgtttcctgtgtcctatttcatttatgaatttttttaactatgaaaccatagtataaactttaaaatattgtttctatgcaactatgaaactatactataaactttaaaatattgtttctatgcattaaataaaaacatagccaatgagccagggagacggaagttaaaaacacgtcaggggctctcttcccaaaagggttaccatctggtgttgtacaatttgaataaaatgatgctgaaggattttaatggcagtagggaaaatgtctggggaaaccaatgtagccacaagtacataaaaacatccttgccttgtgcagacacagccaatgtcagagcctgaagttaactcctcttattatcaaacttacattgatacaaatatgagaacagaaatctgacctagttttatagcatcttcttcattcatctttatgttatccattatgagctttgtaaggttcttcaagttacccaagctgtcagtcagaccacctgtcaaaagaaaaaagattggactctttcagcagatatttgctatttactatgtcatttactattactgtcatttttgttaccaatcaaaagattttaatgatcatcatgagccaaaaatgctcatgaaatagacataaaaatatactttttataagagatgggcattatacttcactgtaagcatgttctgcaaataatagactagataccaatttcccagataacagggaaaaaaatttcctttttttttttttttttttttttttgagacagagtcttgctctgtcgcccaggctagagtgcagtggcgcaatctcagctcactgccagctccacctcccgggttcacaccattctcctgcctcagcctcccaagtagctgggactacaggcacctgccaccacgcccggctaattttttttgtatttttagtagagacggggtttcaccatgttagccaggatggtctcaatctcctgacctcgtgatccgcctgcctcggcctcccgaagtgctgggattacaggcgtgagccactgcgcctggccgataacagggaaatttctaaacacttggaaattaaacaacacatttttaaataatcatgcattaaagaagaagtctcatggaaactttgataatattttgaaaaatataaaaataaaaacaaaacttcaaaatctgcagctctctcctcacaaaggggtgaaaagaaaaaaaaatctgcagctaacacagtgcttacagggacatttacagtattgcatacttatattagaaatgaggaaaggcctcaaatcaacaacctaggcatactacttaagaaattacagaaaagagagcaaaataaatgaaagaagaaagaaaataataaagataagggtgcaaatcaaagttattatgcctttattatacaaattaaaaacagaggcaaggtctcactatgttgcccaggctggtctcggactcctgagcacaagtgatcctttggcctcagcctcccaaagtgctaggattacaggcgtgagccaccatgcccagcccagaaatcaaaattataaacaggtaaacaatagaaaaaaatcaatgaagctaaaagttggatctttgaaaagatcaataaaatttaaaaatttctaccaagactgacaaagaaaaagaagacaaaaattaccaatatcagaaacaaaaaaggggatatcactacacacactgcagatattaaaaggacaattagagaataatataaacaaatctatgcacataaatttgacaacatatatgaaattgaccaattttttgaaaaccacaaactaccaacactcatgtgatacggagtaggtaaccggaataaccttatagctattaaagaaattgaatttgttatctaaaatttcccggaaaagacatctgtaggcacagatatgttcacttgcaaattctgccacacattttcatttttttccttctatcaactgtcttcatatctaccacacatttaaagaagaaataacaccaattctacacagtcacttccagaaaatagaagtacaaagaataattcccaactcattttatgaagccatcattaacttgatatgaaaaccagaaaaagacgtagaagaaaaacttttaggccaggcacagtggctcactcctataatccccgtgctttggggggcagaggtaggaggatcacttgaggccaggagtttgagaccagcctgggcaatatatccagaccctatccctacaaaatattttttaaattacccaggtgtggtggcaggtgtgagtagtcctggctactcaggaggctgaggcaagagaatcgcttgagcccaggagttcaagattgcaatgaagtgtgatgacaccactgcactccagccttggtgacagaatgagacaatgtctttaatgaaagaaagagagagagagagagaatagagaaagaaaggagggagggaaggacggaaaagaaaagaaagaaaattgaggctgggcgaggtggctcacacctgtaatcccagcactttgggagggcgaggcaggcaaatcacgaggtcaggagtttgacaccagcctggccaacatggtgaaactccgtctctactaaaaatacaaaaaatcagctgggtgtagtggcaggcgcctgtaatcccagctagtccagaggctgaggcaggagaatcgcttgaacccaggaggcagaggttgcagtgagctgagatcgcaccactgcactccagccctggtgacagagtgagaccccatctcgaaaagaaagaaagaaaattaaactttagaccaatatcattcatgaatacagaatcaaaaatcttcaacaaaatagaaaatggaattcagtcatgcataaaagaatattacggcaggcgtggtggctcacacttgtaatcccagcactttgggaggccgaggcaggtggatcacaaggtcaggagtttgagaccagcctggccaacatggtgaaaccctgtctctactaaaaatacaaaaattagctgggcgtggtggcgcgcctgtagtcccagctacttgggaggctgaggcaggagaattgcttgaacccaggaggcggcggttgcagtgagccgagatcgcatcattgcactcagcctggtgacacagcaagattccatctcaaaaaaaaaaaaaaaaagaatattacaccacctccaaatgggcttcatatagggaatgcaggatgctcaatatgtggaaatcaatccatataattcattatattggcagtctaaaagtaaaactacgtgatcccataaattgatgcagaaaacacatgtgacataatccaacatccaggctaggtggctcacgcctgtaatcccagcacttcgggaggcccaggcgggaaaatctcttgagcacaggagtccaagaccagcctgggcaacatagcgagaactcgtctctacaaaaaatttaaaaattaaccagatgtgatagttcacacttatggtcccagctagtcaggaggctgaggtgggtggatctgttgagcccaggaagtcaaggctacagtgagctatgatcacgccactgcactccagcctgggtgacagaacaagaccctgcctcaaaaataatctaaaaataatttaataaaaacaatccaacatccatccatgtaaaatgacatgatcatataaatggatacagaaaacatctttagcacaatccaacacctattcatgaccaaaaaaaaaaaattctcagcaacttgataaaagacacctacaagaaaactacatttaacattatacttaaaggtgaaagtctgaatgctttctccctaaggtcaggaacaaggcaagatgttaattcatgtcactattcaacattgtactacaagtcctagttagtgaaataaggcaaaaaaaaaaaataaataaaaggaatacagattggaagggaagaatttaaaatcattcttttcgaagataacatgattgtctatgataaaaatgtcaaggaatctacaacacccccttctgcaaaccccacaaaaaaaacccttctaaaactggctgggtgcagtggctcatacatataatcctagcagtttgcgagactgatggggaggatcacttgagcccaggagttcaagactggccttggcaacatagagagacctcctctctacaaaaaagaaggaggaggaggaggaggagagggagagagggggagggggaaggagaggggaagggagaggaagaaggaggaggaggaggagaaggaggaggaagaggaggagaatgagaagagaaaaaattagtgaggtagcgaggtgtggtggcacatgtcagtggtcccagcgacttaggaggctgagcattatgtagaaaatgggattatagaccgggcacggtggctcatgcctgtaatcccagcaatttgggtagccgaggtgggtggatcacttgaggtctggagttcaaggccagcctggtcaacatggtgaaaccctgtctctattaaaaaatacaaaaattagccaggcgtgttattgggcgcctgtaatcccagctactcaggaggctgaggtaagagaatcacttgaacctgggaggcagaggttgcagtaagccgagatcacaccactgcaccccagcctgggcgacagagtgagactccttctcaaaaaaaaaaaaaaaaaaaaaaacagatgaatagaggtcattatggtaagtgaaataagccaggcacagaaagacagacatcacgtgttcttacttatttgtaggatctaaaaatcaaaacaattgaactcacggagagtagaaggatggttaccagaggctgggaagggtagtagggaggaggtggaaatggttaatggatacaaaaaaatacttagaagggataaataagatctagtatttgatagcacaacatagtatctaagtcaaaataagttaactgtatatttaaaataactaacagtacaactggattgttcttaacacaaaacataaatggttgaagggatggatactccattttccatgatgtgattattacacattgcatgcctggatcaaagcatctcatgtaccccataaatatatatacctactatgtatccacaaaaatgaaaaatagaaaaaatttaccttatagggttaagacatctaaatgagttgatacacgaaatttgcttcaataatacctgtatgtgttcaataatgttggctatcgttatgtatacctttaaaaaatcaacaggttggggccaggtgtggtggctcacacctgtaatcccagccctttgggaggccgaggcgggtggatcacctgaggttgggagtttgaaaccagcctggccaacatggtgaaaccccgtctgtactaaaaatacaaaaattagccaggtgtggtggtgcatgcctgtaatcccagctacttgggattctgaggccggagacttgcttgaatccgggaggtggaggttgcagtgagccaagattgtgccactgcactccagcctgggtgacagagtgagaccctgtctcaaaaaaataataattaaataaagtaaatactttttttaaatggcaaacattaaaaaataattataaacaccatataggccaaattcagcacataggtgatcactttacaggatcagtataaaagaatagttgtcatgagtagatggtgagcttcctgacacagaaggtagtctaatacagtcttcgtgacacccagaatcttacagaagggattccctcattagggaggaggtttcaaagattatctgtacaaaaaattctagaatcttaaaatgataggaaatttctctgtagggtgacaagcaaggcagagctgggtgggaaattgctagcgtttgaaaactaaccccagactgctacagttaagtacagcaagattcctgcttcccatggcttcacaccacatagcagttcctgctcggggcaaccaggctggtctacacaggtagggcagacattctcctttagtgttatttggaatttggggaagtatccccgttacccagaaagattgccctcgcatatctgtgtctgaagtctaaaatctgaaatttcatcatgttagacaatattccccaaatcttctgtcattcattcttctttttcttttctttttggagatagggtcttgctgtgttgcccaggcacagatatgatcatatcttgctgcagcctgaaaattcctgggctcaagtgatcctcccacctcagcctctggagtatctgggattacaggcatgcaccatcacgcccagatgattaatttttgttggagacagggtcttcctattgtgtccaggctgatctcaagtaatcctcctgccttggcctcccaaagtgttggaattacaggtgtgagtcacctggcctggccccaaccaagtaaacaacagttagggtgggaacggagctgagtatcttctacaatttcccagatgagaatcttgtaacacaattagctcctagctcctgcaggtgattaatttacaggttggatttcctccaagacttgaagtagggcagggtgccacttggcagggaaggactgggtattgggtagagatgggggtgctcgcaggagaaggatttgctgaagacaagcttaacctgcgtatatatttattttttttaatttttttttttttttttagacagagtttcactcttgttgcccaggctggagtgcaatggcgtgatctcggcccaccgcaacctccacctcccaggttcaagtgattctcctgcctcagcctcccgagtagctgggactacaggcatgtgccaccacgcccggctaattttgtatttttagtagagatggggtttctccatgttggtcaggctggtcttgaactcccaacctcaggtgacccacctgcctcagccttccaatatattttttaataaaaatatttttagtatatttacatttttaataaaaatagttttaatatatttaaacacatacatatatgtatctatgtatgtatgtgtatatatatctttccaatcagactacagctctgggaatcttccctatggctcccaatctaacagctttcccccaacatagacctctctccacagcccttctaccttcctttcaagtcctgacacctggtagaaactactagaaaatttaaaacaaaactaataaaaatgaaatcatgtcttttgcagcaacattgatggaaccggaggccattatcttaggtgaaataactcagaaacagaaaatcaaataccatatatactcacttacaagtgggagctaaataatgtgtacacatggagatagaaagcagaatagacatggagacttggaaaggtgggagcgtgacagggaggcaagggatgagaaataatctgataatggtggttacactaaaagctcagatttcaccaccacgaaatatatcgatataacaaaactgcacttgtaccccctatatctataaaaataaataataaataataaagcaaaactatatatctaacattttcacagtattcctggctaatatttccagccagtcttgattatagctgtaaactaaaaatcctaagccccccaccaactgaatgcatcccctctgggctaaggagaccccagaaaaaaaccttaaactcagttcctggccatgacaggatgggaggtcaaacacacatcattatactccctctcttgtatggtttgaacacaactcatcagcattactgttgacatagagatcataagactaacagaacagactttttgtggcaataaattaccaagttataaagaggacataagaccatgccaggcaaaggctaagtcattcagctctacgcttaaagaataaactgtcctaggctgggcgtggtggctcacgcctgtaatcccaacagtttggaaggtggaggcagtagaactgcttgatcccaggagttcaagaccagcctgggaaacatagtgagacctcatctccccataaaaaatcaaacaatgaggatcaactgagcccaggaggttgaggctgcaatgagctgtgatcgcaccactgcactcccacctgggtgacagagcaagacccaacctcgaaaaaaaaaaaaaatttaaaaagaataaactctgtcgtaactgccacagatttttcttctttggtagctaaacaagcattggtctcaagataagcaatattgatagttgtgaatattaaacaattcgcaactcatccagctcacaaatgctaacaatccctgttccatctgccataactacagctttgattggagaagagagtgatttcagtaactttctcctgatcagaggaccaccaaccacagactggttctggctggtttacagagattgcgtacctgcttacctttgtgctctgaaaagaacttctgaagtataggcctaattgtaatacatttaaatcatttaaaggggtgtacaatcttttggtttccctgggccacattggaagaattgtcttgggctacacaaaaatgaatttgtgctgggccacattcaaagccgtcttgggctatgtgcagcccacggactgcaggttggataagcttgatttaatgctaaatctccaccccaaagtgaacatgggttgtatgttacatgcatgtttattcaatatgcatgtatcaagaccaccttcatgaatattcatagctcctcctgtaatctgttgaatatgtatgtttagccaacccattcaacataaagtgtctaccccaacccctccttcgaggtgcctgtctctggtcttggttggaggcatgtttctcagcctgtgggatggccaccttgcaggctgtaaccctttagaagaaataaagtctcctctctccttttccaaatttatacactgttatttttttttaagtgaacaaagcacaaaccactgatatttacaatacccggcagccgttgattctgtaggtcatgaatactcaaggttttcaggtttgttacagatgtgatgtgcctctcatcttctatggtgaggggactggcttccaccatgagagaataaatgttcttacaggtgctgaggaccaaactgaggcttccagccacaccagcacatctctttatttgcagcctgaggcttgtggcagagctgaatattttccccagatatctgatatcttgcttattcaacttgctgaaatcccggagtgtgacctccagagtcctgaattcctgcttccagttgaagaacaaagatacagccctgctgggaatgtaggtttctggggcctcttccatgtggattccacctgtgtcttctgcagccttttcccatgaagccatagctcccccataaaagtccagtttaatgaagtccagggcacttgcacaattgggcaaatgttcaaagaagtcaaataagtaatcggggatgttccctgagttgatatataagcttttaccttgaaagaaagcttcaaattcttggctcagggctgatttggatgtactctcttgatataaatggatgccacactctacaaaggaattgatgtttatggctttcagaatttcttgctcagtggtgtttttcacactttgcaaagattcctgtctccagagaggcctcttggcgatggaaagtccgagaaggcagccgtgttgatacactgctgcgaggtgcttcataacagccctggtggcttccacagatgacccacaggtgtaccggagcaggctgctataagtggatgtaatgtccgaaatggaaaccattttctgcaagtaaccattccccttggtcacctcctctggctcatgagacgtcaataaactgctgagtcttcgtcctgctgtgtactcctggaatgacttgtgaaagaatttatactttggcttgaacctttgagctgtatatttacagaggagcccagttgtcagcaggacatcctcattcacgctggacacatcctgcagttcgaaatcaaacttgtgggagaacacaccctccagagctaggtctccacagtggtccaggctccgaatgaagtcacttgcagccacacctttatgtttgtgtttgtttttctgtatcaacagatcatagaaggtatggaacagcgttgtttgtgtgtgagagtggaactcactttcacccatctggattgcacaagtgatgaccacaaagagaggggtcttcatgagattcctcaagcacctggatttctgaatttggagcaacaagccttcagcaagctccttgatcagcacttctcggatgagagcctgggcgctgtcttctgtcatatcccccacctcagcagtcagggcaccaaactgccgtatgtgcctcaggcactcagtggtagtggtgacgatgaccatgttcttgaagcggtggttttcctttatcagggcttcgatttctgggcagttctggggcttgaattcattgtagccatcaagaaggaaaagaaccctctgccgcagcttcagcagcatggccatgaatgtctgcttcctgattgtgccaggtatatccaggagttgatcacagagggtttcaaaaagtccaccctgggccctgctgagacggaggaagaagacgaatttgaacttggtcagagccttgcactttccggagccccagagcatggcaattcgctgcagcagagtggacttgcctttgccagattccccttcaatgatgcaggggctctgaagagcctgcaggaggccattcagggtcagctgctccacgcggtgatggtgttggtccttcctccacaggacaggttctgtgaaggtgcttttcaagttaaaaataatgtcaatatcttcaccaaggggataaaagttcagaaaagatggggtatggtacaagtcctttaaatcctgagccaaatcgtccaagtctccttctgatgtctgatgaaaaagacctattagagaagaggtgatgttaaagaagacccaattctgtgtctcctcaaaacctagagttcaggaggatgaacgggggggtgaggctgagaatctgccattggtgaatgtaatgtcctttcccagttctgagctggcacaaagggttctgtctgctccccctttccccagcatcctttaccccactcccctttttgctttctgtttcctcctttccacaaccaaatcttatagcagctggttggaaaagggaggagcttgtttttgggttaaggaaagtaaagaatttggcagagaaagatggttagggataattgtcatcatagtaggccttcactctgagtaaaatctgtcatgaccttatttactaattaaaaaaataaaaacaatattttatgaaacatagaatcatggttctgtgtcagtcaggctgtctttaccaggaggcctggacatggagtaggtagtcagctgggcctctctcccataggtagatctcatccaaccagggaatgctgagaaccactgctgcactggaagcttaactagtgcacttattctccagttttatcttgcagtgagacaatactcaatcatttatttcctggccttggggttatttgtttggcttcaccatcaattgatctactatgagtttttcctaaaatcatctaagcttttccttagcaggtatcaaaggccactgccaggtgatatgaagagaaggaaaagcagaggctctgccatggggaagatggatctttgttgtggtctattctacttgcagaaacagatgcaaaactaactgatacttactttgtccattcaagtcctgaaatagaggatagttccactccttaagggatttaagaaagaggttacaggactctgaaccctttttcaaaatcatgtgaatgatccctctagcagcatcctgctccaccttctcgcagcaaatgatgtttacttcttcgcgattcagaacattccatacaaataggtcatctgtgatttgctttataacagtcattcccattctttgaataagggctcggctattgtcctttatgaaattcactgaggagatggggagaaatatacatatttatttacttatataaaatgtgcatatccggctgggcacggtggctcacgcctgtaatcccagcactttgggaggccgaggcgggcagatcacgaggtcaggagatcgagaccatcctggctaacacagtgaaaccctgtctctactaaaaatacaaaaaattagccgggcgtggtggcgggcgcctgtagtcccagctacttgggaggctgaggcaggagaatggcgtgaacccaggaggcggagcttgcagtgagctgagatagcgccactgcactccggcctgggcgaaagagcgagactccgtctaaaaaaaaaaaattaaatatgcatatcagcatctgtctccagagcattagggccatgcatttttttcctgtgagcatctcctgagttatggagatgccaaatgcctgaattccaggccttcaagaaatgctctgccaagcattttttttctgagacggagtcttgctgtgtcacccaggctggagtgcagtgacgcgatctcggctcactgcaagctctgcctcctgggttcaagcaattctcctgcctccgcctcctgagtagctgggattacaggcacgcaccaccacactcagctaatttttctattatttgtagagacggggtttcaccattttggtcagactggtctcgaactcctgaccttgtgatccacctgccttggcttcccaaagtgctgggattacaggcgtgagccaccgtgcccggcctctgcaaagcatttctaaccccagagttattgatgagcaagatgttttgctttggtgaagaagtaaggtgagttatcttgtccctctgatataaagcagtccccagtgaggttgtagttgtaagaccgttggctttagaataatggcaatggcctaggatctgccacttgctaccatctatgtgaccttggcaagtcactaagcctctttgagtctatttcaattacgtgctgctggccgggtgcggtggctcacacctgtaaccccagcactttgggaggccaaggcgggcggatcaccagaggtcgggagttcgagaccagcctgaccaacatggagaaaccttgtctctactaaaaatgcaaaattagccaggtgtggtggtgcatgcctgtagtggcagctactcaggaggctgaggcaggagaatcgcttgaacctgggaggtggaggttgcggtgagccgagatggtgccattgcactccagcctgggcaacaagagcaaaactctgtctcaaaaaaaaaaaaaaaaaaaagtacgtgctgctaaatgtttcacaaactggccctggccctctgggagtaaaggccctaatttgtagcattcaccaatccccaaggtataaatattcctaccatggcctatttcaagctaacagcgtatgttaactggctaacaaaaatcctgaaaattcaataatcaggtttcacatcacagtaacaaccagctccagcacactggggattcctcatctgtacaatggtgtcaagagcattatttaacttaggaagttgttacaataattcatgtatagtatctcatacaaagtaataactcaatatatgttagctactatttttagcctttattcaggtgtcaccagacaaagagcacattgtatctccacagactttggtcttttctgaagagtatcacatcaaaacactggtttttatccaatgtaagctctctcgccaggtcttgagggtagctgtgtcctttttgtgtctgactctgcaaggtctaattctgaaacgtagaccacaccgtacccaggcactgtacccacgctatgtttgtgacagcttggagaaatgtcttcctggtttttaactctcagacaccgtctgcactagatttcttcctgggctaggctgctcctggttttttttttttttttttttttcagacgaagtttcactgttgctgcccaggctggagtgcaatggcgcgatctcagctcaccacaacctctgcctgccaggttcaagcaattcccctgcctcggcctcccaagcagctgggattacaggcatgcgccaccacacccagctaattttgtatttttagtagagatgagatttctctatgttggtcaggctggtctcgaactcccgacctcaggtgatctgcccgtctcagcttcccaaagtgctaggattacaggcatgagccaccgcacctggccgctcctggctttcaaacctgtgttgactgatcagagagggaatgcactcctctcaaagaccccagaacctctctggcctgaaatgcaccatcaatcactccaagcaccaggaccccaccccagccgtcctttctcaccattgcagagctctgctgctgacctcagctagaatattccctgtctacatgtcctgcaagagtcccatctctctccttctggggtctcatctgttctctagcttccacatcatccctatggaagtaacctctaagtctgtgtcccattgtgatcttcagtttagagctaaagaaatacagcctcacccgggcgcagtggctcacacctgtaatcccagcactttggaaggctgaggtgggcggattatctgaggtcgggagttcgagactagcctgaccaacatggagaaaccctgtctctactaaaaatacaaaattagccagtcgtggtggcacatgcctgtaatcccagctactcgggaggctgaggcaggcgaatcacttgaacctgggaagcagaggttgcggtgagcccagatggcgccattgcactccagcctgggcaacaagagcaaaactccgtctcaaaaaaaaaaaaaaaaaataagaaatacagcctcagaaaggcttagagacccacacacacacaagttcacagcctagccttcctgagactacctttcttcacctataaaatgaagacacgttatttaaaatactctaattatttaaaagactcattatattgaataagtcacataactctcatacccaaaaatgtcttaaaattggaaaagtggctaggcgtggtggctcacacctgtaatcccagcattttgggaggccgaggcgggtggatcacgaggtcaggagatcgagatcatcctggctaatatggtgaaacctcgtctctactaaaaatacaaaaaattagctgggcatggtggcacgcgcctgtggtcccagctactcaggaggctgaggcagaagcatcgcttgaacccaggaggtggaggttgcagtgagccaagatcacaccactgcactccagcctgggctacagagcgagactccatctcacacaaaaaaaaaaatttacaaaaaaaaatatatatataaacagtaagatattattttactatgttatatctccttgtatgtagaccatcatactccttccttatcaagtaattaggtggaaaaaatgctgctcatttattcattaattattcattcttttcagaatatctctttgtctagaccaatgcttttcaatagaactttctgtgataatgaacatgttctatatctgcattatacaatatggtagtcattagccacatgtgactactgagtgcttgaaatctggctacagtgactgtgcaactgaagtttacattttattttatttaaattcacctttaaatagctacagagggctagtggctactattaatatactagatagtgcaggtctacacccagccatttaaagtggaaggagctacattttggttgccacttagatctataccatgtttcttcacaatgagcttgacatgtatagctctctgctgtctggctgaacaggtgatgagaactaacagtttaaaacatacacctggtcactctttgtgtaagtcctatcctatctgtggttctgccttttatcacaggttaccatatttgtaactgaattcctaaaacaacagaagaatatttattggtaattccacatatgactggtcagaggaagccatgaactgattttccatttaaaatcaccagtatttggtagcagactgtataaccaggcagatgttatttctcatatacttacttgttctggatgaaagcttcccacctttctataacacaatagaaaatattatttccaaatggaaaggtcaaaggtgatcccaatattgtcctcttttttctgtaaaactactcttcattctgtaaaacaaacaaaacagaaccagagactatcaggtggaggggctgatgcaattatctaggtaatgccccgcttttcatagatgagaaaatggtgacccaaaccagaaaaaaactcgctcaaagcccctggctattcatggccaggccctaaagagaacccaggcggctggactccttgcctagagctctaaactatgttcagctggaactttgcccttctcttcaaagtttcttctcatttctgctgttcagagccaagaaggcaacatggaattaaatgtcaaaagacggtataagtgtcaacatgaatggtgcagagggtacgttctctccagtatttccaggaaagagtatatggactggaatcatccagggaggaagttttcatggaggagacagcacatgaaccaggtcttaaaggataagtagggctgggcgcggtggctcacgcctgtaatcccaacactttgggaggccgaggcaggcggatcacgtgaggtaaggagttcgagaccagcctgaccaacatggtgaatcctgtctctattaaaaatacaaaaattagcggggcgtggtggcacacgcctgtagtcccagctgttccggaggctgaggcaggagagtcacttgagcccgggagacggaggttgcagtgagccgagatcgtgccactgcatcccagcctggcagacagagcgagactctgcctcaaaaagaaaaaaaaaaaaaaaaaaggataagtaagatgaggccaggtagttgggctggggtggaggtggagatgaggatgtaaaacgccttgcaggtgagaggatgagatcagggagtatggaaaggggaaaagttctcttgtccccttcgcagggcttgcgatgggggtgtggctcacttcttcagtgcccgctgctcagacctctaggggatcatacagatgggcgggctgtggggttccaatcccacggcagtgtctagtggtgaatgtttacagctcctgaagccccagtgggtgtgtgttacagggtgctcttttagttcagctgtccgtaggcgtcttgtattagctcaatgggacccctgccttattgcaaggacagagggctttctgtattccggggttcttgccttggtgtaccggaggaattggatcacacgtggtcttggagaatgagcgcaaggtttcattgagtggaagaagctctcagcagatggggtagccagaagggagatggtttttccccggagtaagaccgccaccaactcttctccaaccctccaggccaaactccgagtcgttcctctggtggatggcctgctggcgtgccgatgtctgttgtgtgctcttccgccagcattctcccttcaacgtcctctggacgtccagctgcttgtatgttcttccgccgatgtgttcctctcgacgtccagccgcttgtgtgtctgcctgcaagggtctctgggatttttataagcataggatgacggtgtggcaggccagggtggccttgggaaatgcaacatttgggcgccaaggcaggagtgcctgtcctcacctaggtccgtgggcacaggcctgggggtggagcccttgccagggacgcgcccttctcttcccagcacttcccttccccccttccctatcaatatgagtaattgaggagacagaaaaaaggagttatgcttccagggtacaaaggggaaaagctatggaaagccttgtacgccaagatgaggcatttgttctttatcctatgagcaactgggagagattatggtataaggagtatgtttaaagtgatgttttaagataagaaacggatttcaatttcctggtatggtcctgtcatttcatcctcctagttgctttaaaagcaacttcctttctcccttcctcctccacacactctgaaaagcaggggcccagaagcctctgagactgctctgtgtgcattcccaaaccaagttagatgatctaccccggctcctcatacacacatacacgaccccctgcatcaggatgaagatgcaaagtctgaattaaagacagcatgagagggcagacaggaagtggggaagagaactagaatcactgggtggagagaaacaaaatgggagctatgtgagtgtgattgtggtatgtgaatggagttggcttgggaactcatgtggatggggttggcatgggaactcatgttatcctaacattaaaactctttttttgagacagggtctcactctgtcacccaggttggagtgcagtggccccatcatggctcacggcatccttaaccttctgggctcaggtgatcttcccacctcagcctcctgagtaactgggaccgcaggtgtgtgccaccatgcctggctaattttttttttttttttttttttttttttagagacagagttttgccgtgttgcccaggctggtctcaaactcctgggctaaagtgatctgtctgcctcagtctcccaaaatgctgagatcacaagaatgagccaccgcgtctggccattaccctaacattttattatgaacattttcaaacatagagaaaatccatccctctattcatttatcaatctattttacttattttcttgcatattcaatgtaagttgcagacgttagtacacttctatgttcatataattaactagaattcaatattggtttattattctttcttaggaaaaattcacctacagtgaaagcagagatcttaactgtaccctttgatgagctgaaaaatgcttctacctcaaacacctatcaagacagaaaacattaccctctccttagtatcctatgccccttcccagtcaaattccatctctgccacaccctcaaagaaaatcactcttctgatttttttaaaccgtaaattagcctgttgaagaacttcacataaacggaatcatacagtatgtgctactcctttcattccacacaatgtctgtgtaagtcactcatgctgttgcttgcagtataagtagtttgtaacatttcattgcttagtagtattgtactgtataaaatactagagtgtattggccgggcacggtggctcacgcctgtaatcccagcatattgggaggccgaggtgggcggatcacctgaggtcaggagttcaagaccagcctggccaacatggcgaaaccctgtctctactaaaaatacaaaaattacccgggcatggtggctcatgcctgtaattccagctacttgggaggctgaggcaggagaatcacttgaacccaggaagcggaggttgcagtgagccaagatcgtgccaccacactccagcctgggcaacgacaaaaaaaaaaaaaaaaaaaacaacgaaaaaaaaaaaactagagtttatttatctattctcctgttgatggattgggttgttttcagattggggctatcataaatacagaacaatgaatacttttgtacaagggggtccttccccacaaaaacttctctaagaatagcttactttgactctgatctttctaatttcacaagctctttgaataaggatctcctcagcttaaactagatgctcacagccatggcaagtttgctgtgaatgttgctgttgtgagagtgataagtgaggataagaaagtcctagataaagtttcctttcattcaaaaagcccccaaatcatatcttttctaataaaaagcagcctgaaaaatcaagctgcaagtatagataagctaaaagcttgcattggtaaatgccagtagctgtgcccatagaaaaaagccacctgggggccaggcatattcaacatggcggatccatcttcccttttctttttcaaccatgtgtacagtaggaacagacaacatagtgccggccagatagagaccccatctgcataataaaacataagggtggaatggccggcttcttcgtgcgctatgcaaacgttataccggttctgaccaatctctcagtccctatgtatatcagacaccaccttctcaagttcatctataaaaccccatgcattggctgggtgcagtggctcacgcctgtaatcccagcactttgggaggctgaggcaggcggatcacaaagtcaggagatcgagaccatcctggctaacaaggtgaaaccctgtctctactaaaaaattcaaaaatttagccaggcgtggtggtgggcgcctgtagtcccagctaatcgggaggctgaggcaggagaatggcgtgaacccggggggcggagcttgcagtgagccgagatcgcagcactgcactccagcctgggcgacagagcgagactccatctgaaaacaacaacaacaacaacaccatgtatttcaccacaaaaccactcactcaggttcccctctctctctgcaggagagagagctattctcttttctctttctttcgcctattaagcctccccccttttgtttttttttgagatggagcctcgctctgtagccaggctggagtgcagtggtgcgacctcagctcactgcaacctctgccatctgggttcaagcgattctcctgcctcagcctcccgagtagctgggattacaggtgcatgcctcctcacccagctaatttttgtatttttagtagagatggggtttcaccatgttggccaggatggtctcaacctcctgatcttgtgatctgcctgcctcggcctcccaaagtgctgggattacaggcgtgagccaccatgcccggcctaaaactccactctcaaactcacttcttgtgtgtctgtgtcctcgattcctttggcgtgagacaacgaacatcaggtatttaccccaatgatgctgcttcaaaagcatatctattttcagaaaataaagtttcccttttatgttaaaactgattcattaacaatataaaaaattgtcattgaaattggagcagccaggcgcggtggctcacgcctgtaatcctagcactttgggaggctgaggcaggtggatcacgaggtcaagagatcgagaccatcctggccaacatggtgaaaccccgtctctactaaaaatacaagaattagccaggcgtggtggcaggcgcctgtactcccagctactcgggaggctgaggcaggagaatcacttgaaccagggaggcggaggttgcagtgagccgagattgcgccactgcactccagcctggtgacagagcgagactctgggtcaaaaaaaagaaaaaaagaaagaaagaaaagaaaagaaattggggcagctcaggagcttaagcaagggcacattttggtgtcaggattgcgttcaaactacagctctaccactgacacactaagagtcctcaatcaaggggtaatgactggcacacaggaaggactcagtgaatggcggcaactgtagattcttctctccctttctacttccccaaaaaggggtgggtttgggaagaatcacaccatccctgactgggtcaaagtttaagtcagagtagaaaaagaggaagaagatagaggaaggagctaagatgtataaagtttttaattgctctcaagaacaaaatcaatccatatactgaagatcatgtaatttttctcagttacccactggcataaagaatagggctgtggaccaggcgtggtggttcacgcttgtaatcccagtgcttggggagactgaggagggtggatcacctgaagtcaggagtttgagaccagcctggccaacatggtgaaaccccatctctgctaaaagtacaagaaattagccaggcgtggaggtgcacacctgtaatcccagctacttgggaagctgggacaggagagtttcttgaacccaggaggtggaggtttcagtgagccaagatagcaccattgcactccagcctgggtgacagagagagactctgtctcagacaaaaaaaaaaaagaataggactgagaccagtgtactctcttggaatgtagctatggccctgcaacccctccccgcaagctgtccagtgaataactgaattgggtggaagaagtccttcccccacatttgtacattggaaaataatataataatatatattatatatatataggcaatctgcctgcctcggcctcccaaagtgctgggattacaggcataagccaccatgcccagctggaaaataatatttagtactaattctaaaattggcattttcttaaaaaaggttacatgagctcctcagagaactgaagtttctctggacccatataacccacgtctatggggtcattcccacacctcacagataaaataagggaaagagtacatataattaggagcagacaggaagcacacagaaatggaaaatgtgtgtgggctttggcattgcagatctgaattcaaatcctcactctgcaccttatgaggtaagtatccctagacatgttacttagcctttccgaatcttgctttccaaatcatgcataatattcacctccctggactattgtgaagattaaacatgaaagtagttgtgacaaagatggtcagtgggtattatctgtcttcctttctagtaaaaaggctctagactagaatgttcttaggtctttaataggcttcagcaatctcacatgttaatattagtgttatgtgctgaactgggcttcccccaaatccatatgttgaagccctgaacctcagaatgtgactgtatttgcagacagagcctttaaagaggtcattaagctcaaatgaggctgttatgagaagaggaaatcgggacacacaaagggagataccaggaatgtgcatacagagagaaaaggccaaggagggaggcgtggggagaagccaaccctgctgacaccttggtcttggacttgcagcctccagaactgtgggaatataaatttctgttgtttaagccacccagtctatggtattttaaacacattaatacgactaatattataaaagtgtgtgaacagttaagaagtgtgctgaccaggttctatcctagttttgtagacaattagcagtgtgatgtagggcaggacatttaactcctctctaccacattttccacctctcaaagccaggctgcaaggatctactgagataatgtacataaagaccctatcacgaaataggtgtcccgtaaagggtgatttccttcacttctgtctccaaatatcaggtttctcatcagtaacttgggagattggatggactaagtagtccacctcgttcctttcagctttgatcatctgtgattctaacaacagtcttagcaacaagagtgagtttcctggccgggcacgttggctcacacctgtaatcccagcactttgggaggctgaggtgggcagatcacgaggtcaggagttgagaccagtctggccaacatggtgaaaccctgtctctactaaaaatacaaaaattagctggggcgcggtgccgggtgcctgtaatcccagctacttgggaggctgaggcaggagaattgcttgaacccaggaggcagaggttgcagtgagccgagatcacgccactgcagtccagcctgggtgacagagcaagactctgtctcaaaaaaaaaaaaaaaaaaagagtgagtttcctttctgtaatgccaaaaagtgtttccaaagtcctttccatctcacagtagtccaaggggtacatgtaccccttgaacctgatgaagccccagcagacccgattaaccacccctaaaggtttctcggcaggcaaatccagccaggcatgcaaatcacactcgtcaatgttaaggcttttgtacatcccagacacaagctttaaatgaatgtaaacccagattttaatatttgggccccagaccttaaaaatcccattctctctacccacagtacctggctgagcaatccaattgccctcttcttgggagaccaagacatgtttttaaaataaagtttctttgtatttgctttccgtttcagtgaggcctcgagttcttgtagaccagataccttcttgttctgtgagaggacagtgtacagagaggggaactgctgagcagttccttttttttttttcaaagcacagtaagagtggtttggacacaagtactaccagttcagaaagggaagatgggtgtaggcaggagtagccggggaagaagtagaacttcagagtaaaagatgcaagagctagaaattccgtcaagaaaggaattactcatttgtttcctgtttgttcacaacatatgaattcattgctgttgagttacttattctataccttaaaatgaaacaaagtcttctgaacatccaacatatattttttttctttttctttcttttttcttttttttgagacagagtcttgttctgtcacccaagctggagggcagtggcacaatctcagctcactgcaacctctgcctcccgggttcaagcgttcctcccgcctcagtcctcccagtagctaagactacaggcgtgcaccaccatgcccggctaatttttgtatttttagtagagacagaatttcaccatgttggccaggctggtctcgaactcctgacctcaggcaatctgccagcctcagcctcccaaagtgctgggattacaggcgtgagccaccatgcccagccacaacatgtatttttaatgcttaaccatgggagatagagcggtaaatgaaatgagccagcttagttggctaaagcacattgctactgcattcaaggtcatgcttacccctgtaccttgaatcccagaggacttccagcagatgtgttctctcagtcagcagggttctgggcaaggtcacacagggcaaacagatcaccagttttggtccactccaccgatgacgcacggggacaccctccggagtataaacagccaggggctt

SEQ ID NO: 733 - DNA, 28701 bp, Homo sapiens
aatcccagcgccgctgtcactgttatggtcctgtcagggtgccggcgtcgtggtgcttgggtggtcgccaccaagaagactttggtggggtagtctcggggcagctcagcggcccgctgtgcccgtttctggcctcgctcgcagcttgcacgtcgagactcgtaggccgcaccgtagggcgagcgtgcgggtcgccgccgcggccgcctcggggtctgggcccagccgcagcctcttctaccgcggccggttgggagtcgccgcgagatgcagcctccgggcccgcccccggcctatgcccccactaacggggacttcacctttgtctcctcagcagacgcggaaggtgaggctgagcccctggaagggctatcacccggaggaagccagggcccgacgccgtagggtctttctggtgccgaggtggtcgtggccgggtggggacaggcaggaagctgactggtgactgcagcccaccacgcctgccgggccttccgagaggccccgaaggacggagggaggggtgtagggagctgctttttaaagcatcaagttactcggtcagcccttggttttccccataccgtctggtggctggtttttctgggtggcttagtctcttcaattggacccacaaaatcctaagcttttagttctggaattactcgcccttactcagaaaaaggacagattggccaagggagatctcaaagaatgagaaaaaggaaggagggctgttttcttctgttatgtatcaacagataattttttggggggggtctgggatcagattcggcactgcaaatacaaactaaatggtttttattgaatttgatgtcttgcccgagtccccgttttcctcgcattttgtaatgtttcacctcagtattcagagaaattgacgcaggtatattggaagtttagtgtaaaccaacaatgtgtttccagtagcctctacagatttccttgtattattctgaggaagcgattgtgctggagatattttcctacagcacaggagaatgtttccctcctattctcagttccctatccaactcataacctggatattattctgctagtcattttcaatttttttttttttcttgagctctgtcgcccaggctggagtgcagtggcgcgatctcggctcactgcaagctccgcctcccgggttcacgccattctcctgcctcagcctcccgagtagctggggctacaggcacccgccaccacccccgactaattttttttgtatttttagtagagatgaggtttcaccgtgttagccatgatggtctctcgatctcctgacctcgtgatccgcccgcctcggcctcccaaagtgctgggattaccggcgtgagccaccgcgccccggccattttcaaatttttattacacttcgtgcaccagttattttccagtgaccagacttactggctgctatgaaatcataaattatgtttacagaaatttcagtctgagaaagaacctagattttcctttttttttttttttttttttgagactgagtctcgctctgtcgcccaggctggagtgcagtgatgccatctcggctcactgcgagctctgcctcccgggttcacgccattctctggcctcagcctcccgtgtagctgggactacaggcgcccgccaccacgcccggctaattttttttttttttgtatttttttttagtagagacggggtttcatagtgttagccaggatggtctcgatctcctgacctcgtgatccgtccgcctcggcctcccaaagtgctgggattacaggcgtgagccaccgcgcccggccgaaagaacctagattttcctaagaaattttatggtgtatcagtatagcttgttttcccttttgtttttcttgttgtgctgtttggcattgttttttaaaaatagtactggtcataatttaaaatgtacaataaaatttttgtctatcaaagggaacatagctgagacatttatttttttttctcttatgttctttttttttttttttgaggtgtggtctcactcggttgccaggctggagtgcagtggtttgatcatagcttactataacctcaaattcctgggctccagtgatcctcccgcttcagtctcctgagtagctggagaccgtctggtggctggtttttctgggtggcttattctcttcaagtggacccatgaaaccctaaggtctgtgccaccgtgcccagctaatatatatatatatattttttttttgaggcggagtctcactttgtcacccaggctggagtgcagtggtgcagtcttggctcactgcaagctccgcttcccaggttcatgctattctcctgcctcagcctcccgagtagctggaactacaggtgccagccaccacacccagctaatttttttgtatttttttagtagagacggggtttcactgtgttagccaggatggtcttgatctcctgatcttgtgatccgcccaggctaattttttttttttttgagacagagtcttgctctgtcgcccaggctggagtgcagtggcgcagtctcagctcactgcaagctccgcctcccgggttcacgccattctctgcctcagcctcccgagtagctaggactacaggcgcccggcaccacgcgcggctaattttttttttgtatttttagtagagacggggtttcactgtgttagccaggatggtctcgatctcctgacctcgtgatctgcctgcctcggcctcccaaagtgctgggattacaggcgtgagccaccgcgcccggcctaatttttgaacattttgtagatctcactaggttgcctaggcttgtctcagattcttggcctcccaaattgctgggattacagatgtgagctaccagccaagccgtaaatttcttttaaactgagatacagcaccccaaaatatttcaatttgtttcatctacatttggtagcatggtgcttagggaggaatatcaactttaatttcccaggtttaaaaaaattgtttaagtgtcagaacatgatgtttgttcaaactcatgtttccatgtatttgtttatttttttcattctcccttccctgaggaattactttttttaaatatgcctaagaaatccgacagaataatgtaagtagataacccattgattccacatactaagaaacctgaaataagtaaaaatccatgaagtttattcaaacttctctgtatttcctcaggagacatataggtctgtatatccacggagctatatgtatatgcataatatcctcacacaatattatatcgtacagtttaaatttagagtattttaagtatactactcatttgatctttttttttttttccttttttgagacagagtttcactccccttgcctagggtggagtgcagtggcttgatctcagctcactgcaatctccacctcctgggatcaagtgattctcctgcctcagcctcctgagtaactgggactacaggtgtacgccaccatgcctggttaatttttgtattttttgtagagacagggtttcgccatgtttcacaggctggtcttgaactcctgggctcaagtgatccacccaccttggcctcccaaagtactgggattacaggcatgagccaccacacccagcctcatttgttctttataagactcccagtgagctttattattcctgtattctataaagaaactgaggtgagctgggtgtggtggcttacacctgtaatcccagcactttaggctgaggtgggcagttggcttaagctcgagagtttgataccagcctgggcaacatggcaaaaccccatctctacaaaacatacaaaaaattagccgggcatggtggcacgcacctgcaatcccaatcccagctacctaggaggctgaggcaggagaatcacttgaacccagaaggcagaggttgcagtgagccaagatcatgccatcacacttcagcctgggtgacagggtgagactctgtctcaaaaaaaaaaaaaaaaaaaaaggcaaccatggtagtgcacacctgtggtcccagctaccatggggtcagctactctgagtctcacttgagactgggaggtctaggctgcagtgagctgtgattgtgccagtgtgctccagcctaggcaacaaagcaagaccctggctgaaaaaaaaaaaggaaaaaaagaaactgaggcttagagaggtttagcaattttcacatgctagatctggaattaagagctagtctacagccaggtgtgatagcatgcacctgcgatcccagctactcaggaggctgaagcaagatgattgcttgagcccaggagtctgaggccacccaggggaacgtagtgacaccccatctcaaaaaaacaaaaccaaagagctattctgctatctcctcaagtttctttctactgtctctttcttacatttttctaaattgtgtatctgaagtatggaagagtcctggatttgcatcctggctttatcaattactctccatgtgatcttgggcaagctacttaccttttttgttttgttttgtttttgagacggagtctcgccctgtcgcccaggctggagtgcaatggcaccatcttggctcactgcaacctctgcctcccgggttcaagcgattcttctgcctcagcctcccaagtagctgggattacaggctcgcgccaccacacccagctaatgttttgtatcgttagtagacacggggtttcaccacattggccaagctgttctcgaactcctgacctcgtgatccacccgcctcagcttcccaaagtgctgggattacaggtgtgagccactgtgccccgccaacttaccctttcttaacctcattttcctcatatacaaattgggaataagaatacccaagtgcaggccaggtgggtggctcacgcctgtaatcccagaactttgggaggccgaggtgggcggatcacgaggtcaggagatcaagaccatcctggctaacaaggtgaaacccagtctctactaaaaatacaaaaaaattagccgggggtggtggcgggtgcctgtagtcccagctactctggaggctgaggcaggagaatggcgtgaacctgggaggtggggcttgcagtgagccaagatcgcgccactgcactcccgcctgggcgacagagtgagactgtctcaaaaaaaaaaaaaaaaaaggaatacccaagtgctcaaatactttgtaaatgtaaaacatttactactatatctggcagagttaagtgttcaacatatgtgagtaatgatgttgctgcttgggtttcagtgttaactgaccccacactttttttttattgttttccaacatgaacattttactgtacaactccgggtcttttccctggtttctacacgtcatataaattcttgcttctcccctttttatagtgttttttaaccatgaatattttcaacttacagatgttttcagtgtataaccttccttctagattctgtccaaatccctcattcttaatgatagctatccttactatttctccacacataccctttattctaaaatgtgctttggtgttttgtctccatgtggatgcagattctgatcatcatgcttagaatgtctttctcctcctcgccttaagttaaaacctaagactgaactcaaatgctctttccttggtaaaacttgctttaactgtccctcagaaacggaaacttcctaatattttctataccccagtacctatcatagaacccatggtataaatatcacaaaagaattatttgttgaataaattatttttgctttcatttatctcatgtctttttttttttttgagacaagagtctcgctgtgttgcccgggctggagtgcaatggcgcaatcttggctcattgcaacctctgcctcccaggttcaagcaattctcctgcctcagcctcccaagtagctgggattacaggtgcctgccaccatgctcggctaatttttgtatttttttaatagagacggggttttaccacgttggtcaggctggtctcaaactcctgacctcaagtgatccgcccacctctgcctcccaaagtgctgggattgattacaggcatgagtcaccacgccaggcctaatatcacttcttaatttaagctttatggtattgtttgcccttccatcaattaattcattcaataagcatgcacatttgttgattgcctactatggatcaggcactattataagtactggggatatatgtaccaagacaaatgccaccaaaaatcccaaatagtctctcctttcatagattttataaacaaccaagtaattacacaaatatataattatatatagtgataaatatcgtgaaggaaaagtggagggaactgtgaaaggaacttacatagtctagtctgcaggatcaaggaaaatttgcttaagcgagtgtaatggtttggatttgtgtccctgcccaaatctcatgttgaattgtaatcttcagtgttggaggagaggcctggtgggaggtgactggatcatgggggtggacttccctcttgctgttcttgtcatagtgagttctcacaaggtctggttttttaaaagggtgtagcacctccactgtctgtctctccctcctctggccatgtaaaactgcctgcttcccctttgcaatctgccgtgattgtaagtttcctaaggcatacccagccatgcttcctgtagagcctgtggaactgtgagtcaaacctcttttgtttataaattactcagtctcaggtagttctttagagcaatgcaagaatggactaatacagcaagtatatctgagaactgaagaatggatggcatttaattatctgaagttggaggaaacagcctggcacaaggtccctgagacaaacagaatccaggttcattcagagaaatgagaggcttagtgtggctagggtatagagtccagattgagaggagagcaggtaagtgggcctggataagatagggcatgtagagattattggacttgagctagaaaagcaactgggggagggagatgaaggattctaaacaaaagagtgaaatatttgcatcttagaaagagtctccggggtacagtgaagagtatggattggaaggagacaagaatgactggggggagggcagtttgtacaccattataatcatgcagacaggagttgatggtttgcatgagcttgctactggtggtagaaatggtaagtggacagacatttaaaaatatttagaggtaaaactgacaatttagtggtggtttggatggagaggaagcatgcaaataaagcaaactgtcaaggataagcttctagcttacaatgctggatagattagtagtatcatttaatgaaaaaaatggaggaagacctgagatatatcagttttggaatattgaattttagatgcctttgagatagatgcaaggaaatgttgacaataggttatataaatctagtgaagaggactggactcaatatattgcatttcaaccttggccttcttcagtctttttatccctatataaaaattataatacctgcagctcacaatacagtgatcagtaaattgtagataattactatcagtgttcttttgagtgatacttttctgtcactctgttattgtgaccatttcagcctattctttgtttgaaattcccccttcccagaaaggatgtcacctctaatacaagttagtaatgtagacagaggaatctttagtttttccttttttttttttttttggagacggagtcttgctgtgtcacccaggctagagtgcagtggtgcgatctcagctcattgcaacctccacctcccaggctcaagcaattctcctgcctcagcctcccaagtagctgggattacaggtgctcgccaccgcacccggctaatttttgtatttttggtagagatggggtttcactgtcttggccaggttggtctcgaagtctatgattcctacttatgaaaaataatatccatataggtctagtcttatcacaaatgttttctatacaatatgctggtgaagtatgatatatagtatgtaatgggtgcaagaataacttttatttcctttttgaaaactgaaaatgacattttagccaacctttcttaggggagttaaacaaggtttacttttttcattaattaatctacttatttgcatgagttttaaaactcataaggcattacacaaatctacaaatgtgattaaattgcatagaactataaacacatatacacacacacaaatgagtgcatgtcaaactggtgaaatctgaataaggtctgtggattgtaccagtgtcagtgtcctgaatttgatagttatgtgagtttgtactattgggaaaaactgggtaaagggtacataagacctctcttttccatttttgtaactttctatgaatctataatttttcaaaataaaaatttaaagacataagacaaaagaaatttcatctttttgtttatcagataaattacagaatttaattatttacagtatgaaaatttacctataatatttgatagaaaaactactaaaaccataaaccagaacaacatgattaaaaatataacctaagacaaaaatttatacaagactttgaaaaaaacatttttttttttgagatggagttgcgctctgttggcaggctggagtgcagtggcgcgatctcagctcagtgcaacctccacctcccgggctcaagtgattctcctgcctcagcctcccgagtagctgggactacaggcgcacgccaccacacccagctaatttttgcatttttagtagagacagggttttaccacgttggccaggattgtctcgatctcttgacctcgtgatctgcccacctcgactgggattacagacctgagccaccccaccctgctgaaaaaaacattttcttacagagtaacgtgatcaagctccagtataggtctagcagttacaagattatgcacatgcattagtttcttgatctctttcataggcctatgtatacattaaaatggtatccttaggccaggcacagtggctcgtgtctttaatcccagcactttgggaggccaaggcaggtgtattacatgaggccaggagttcaggaccagactggccaacatgttgaaaccccatctctactaaaaatacaaaacttagctgggcatggtggtgcatgcctgtaatcccagctactcgagaggctgaggtagttgaatcgcttgaacctgggaggtggagattgcagtgagttgtgatcatggcactgcactccagcctggacaagagagtctgtctctaaaataaataaaatggtatccttataactcaaatgaaataatgaaatttattaatatcttttagtgcaaaaacatatgcttgtttttgtttctgtggcacatatacacaactctgggtcatactgaagcacacatagacttcattttcaagtctgagatgagatgaaacgagatgatttttgtccttgctcttgttgcttattaaataaggaaaagcttctttacgtatataagaatgtgtcaagtgccacaaaatgttcattgtttattgcaggatactcttctttcacagaaatcgggaacttgtctaggggcagatcagtagtaaatttcatcttcagtgtactatcacactgcactgtgagaatttttcacattctcaggctgagcagaagattcagagaaaggaccccatacccagtcatacatttgagttgaaagggaagaaaaattcctgttaaattttgttgtgtgggttttccaaaggtggctttcagtaagacttgaaatttactgatactcttcactctgagccaaaacagctgtagaaacatttttaaaatttccttttacaatagattttttaaaagattgtatctttttaaatccacttttatatttattatcctttacattgtttttacttaggaaatgacaagaatattttatatatagtatagtaaggaagaattaacctaaaattcatgttttactatctggacgtctatccaagagctgacaaccaagctagcttgttcttactctggtttaaattaaatcagccatgctcctggagtaatttttaattgtttttcttgctctctgacatcattctccacttgttaacttgataacatgttaaactactactaattttttggactttcctgttctttctcactgacagttatgtcttgggggtcctgggggaggtgtcaaactgctattgttggcattcctacatatgtccttgatattttttctactttacatggaacagaaagtactagaaaatttgtaagctgaagatgcctttttgaggttcttgcatctgcgctatgacaaactgctaaacatgtacagttcttgagcacaacattccttagcactataatttatatatccttttttggtttagattaaggactttaagtacagtcctttctagaaaccaggaaacagttgttaaggtcctttccagcctcataactgcaaaacctctaatgtcactgctgtactaatgatttctggatgtaaatcttcttcttgttaagaaaaaacactcttggcctggcgcggtggctcacacctgtaatcccagcacttggggaaggccagggtgggcagattatctgaggtcaggagttcgagaccagcctggccaacatggcaaaaccccatctctactaaaaatacaaaaattagccaggcatgctggtacacgccagtaatctcagctactcaggaggccgaggcaggagaattacttgaacccaggaggtggaggttgcagtgagccgagattgccccactgcactccagcctgggagacagagcaataaataaataaataaataaaaattagccgggcatggttgtgtgcacctgtaatcccaactcaggaggctggggcaggagaatggcttgaacctaggagacagaggttgcggtgagccgagatgacaccactgcactccagcctgacaacagagtgaggctctgatacaaaaaaaagaagaaataacactctttgtatctattagaaatagacttttaaattccacctctctcatttcaacttagacaaagaagtagcaagcacttataagagagtattttcactatgcaattatatgataacatgtacagggattatttttgaactttaagtggtgaattcaaatctggttatattttatctctgagtgagcgcctttataaaaactttttagaattatataatgtttaacctggaaagaactttgaataggaaactagggcccggaaaacatgaatgatttgctgtatcagttagtagctaagctgggacttagcttcagaatgtaaacatttgtcaaacttaattgcaggagttgtcataagccgaccaggatgtgactcatagagtattgtgcaaattaagctctttgtactgtatatgaaaaatggttttttgttttttaaggaagctaactttggtattggttggacatgatctccagagaggtatctatctgtgttagagtgttctggtttggtgtttccaaaagtatttttctgaaataatactataatcatgtgacttgcactgacagtattgatggttgtttattaatgtatattatctggtcctacaaatgtgctttttctttttaatccctatgtgacctcaggcaaatccttaactatttccattttttaactagcaaagatggcattagtactaccatgattatctgtaacccctgagatactgtgcagactctacatggaatttattttttaatgtggataactgaatctcttcacctcttgttagagccgacctaaaaaataaaaacaaaaagaaaacatagcctttatttatttttgccaaaactgaagatgaatgatgtaattatgtgaagaaaagggaagttttggctgaaataacaggggactcttactcatcagacttatcaagaattaagcattaatatatgaaacacttagcatagatatgtgatgatttaaatgaaagaatatatgaataaataaatacatgaaaaggtagagaaaaattatctacgaatttcctttagtaaataaattgtctaatagtttgtatatatacatatgtaatgcctctgaaaagaatttattcagttactttgttctgaggcacatgatatgtgtaagaatgaaggaatccaaaatgatgtcatgtaatgtattttgcatatattttccatggaaattttaaggaattactgttgttaagtctagattctggtaccagtctggctaattagctgtgaaaccttttgtacgttttttcacttctttcatctttcattttattcttataaaataaatgatggtttttagatgtctgtcaactataaaatttgaagattatatgcaatagcagatgttcttagagatcttcaaatgataattattttagttgaatatctgctcactttggttaagattcacatgttgtgccttagtttatatagttttatcctcttttctcctaagatctcagtggttcaatagcatccccagatgtcaaattaaatcttggtggagattttatcaaagaatctacagctactacatttctgagacaaagaggttatggctggcttctggaagttgaagatgatgatcctgaagataacaagccactcttgtatgtaaaaataataatatatattttttgttttttgagctagtctgtgggatgattatattcttcttgttatttagagagaaagcattaaccttttttggtcaaaagctatagtgattgtcaattttactagtaatttaaaaaactgaaataataatgagagaatattttttaaccaattaaaagacaaaaattaaaagaatggtaatcctgtatctcacacacatgtgtgtctactccagcttacctgggtctgtcagctatctgaagtaatcatgcaatttaaaaaagcagggctcttaggtactagctgttgaaattaaggttcggacaaattaagatttccaagaagattaccactccaaaatctcttcaacatagaaattctagagctgccactgggaggagagctacatataaagaggctttcactttctttatagtacttgaaattttgtggttatctggagaaaaaagtaaagaaataaataattttgaaaagaagaacctatagctttgtaaaattgaggcatttccagattcttctttgtattaattatcagtagagtaagtgctgaaacatcctgtgtttcttcatgttaatacaccatatatcggccaggcatagtggcccacgccagtaatcccggcactttgggaggccgaggtgggcgaatcacttgagattagaagttcaagatgagcctggccaacatggcgaaaccccatctctactaaaaatacaaaaaaagaaaaaattagccgggcgtggtgtcaggggcctgtagtcccagctgctcgggtggctgaggcatgagaatcgcttgaacccaggagacggaggttgcagtgagccgaaattgccccaccgcactccagcctgggtgaaaaagcaagactcttgtctcaaaaacaaagaaacaaaccgtataccatcaaatctaagacactattgattataagatgaagttattttacatattaattaaacagaaaagtgcgtaagacggcataaagctgggacatcaaagggctatctccttattagtgtaaggatgaatgagaaataacccacaacacaaagacagcaaggaagtttgcttcagtttgacagtggataagatgttgaaagaaagaatttccccagagaatataaaacctacactggttctcatatgggtttgcaatctgaattaggcccaaaaagtcacaagcagaaaattttacttaaagttttcttaaattgatagggcttccaggagactggcaaaaggaaaggtaaatattagaaacacttggcgtcactccaggctgacgattgtaagactccagtgatagagatatgtcccacatttagagatattggaatgttaaaaatgtacagcttggaattagtgaaatgtggcacttcaaatgcaaatgttttgttgacctatggagattataactgtcttatttaaagttttcttaatttttttttggaattgttttagtattcagaaatgtgtgccttttgagaatttttattttaaaattatagggaagaattggacattgatctaaaggatatttactacaaaatccgatgtgttttgatgccaatgccatcacttggttttaatagacaagtggtgagagacaatcctgacttttggggtcctctggctgttgttcttttcttttccatgatatcattatatggacagtttagggtaagtatatcttattttatacaaattctaaatattttgagagtttcaaaaattaaatataataagatattaactgtaatataccatattatgtttgagaaatgctttacccattatttctcacttgttcatccctaaaaccgttccataattaaataagtgaggagtaccttagattaatgctttcaaacttttccacatcatgattcacatagaaagtattagtatttgtgggcgggtgtggtggctcacgcctgtaatcccagcactttgggaggccgaggtgggtggatcacggggtcaggagattgagaccatcctggccaacatggtggaagccctgtctctactaaaactacaaaaaaagtatctgggtgtggtggtgcacgcctgtaatcccagctactcgggaagctgaggcaggagaatcacttgaacccgggaggccgaggttgcagtgagccaagatcacgccactgcactccagcctggcgacagagtgagactccatctcaaaaaaaaaaaaaaaaaaaaagaaaatattagtatttgtatggcacactggggtaaatgaatagaaccacttccagctgaccagaagtcactagaaggtgcaccttctgattttcccaagagatgaacagtttgaaatgtaatactcatattcatatttcttaccttttttttgattatttttatttttatttttatttttttatttttatttatttatttatttatttttattgatcattcttgggtgtttctcgcagagggggatttggcagggtcataggacaatagtggagggaaggtcagcagataaacaagtgaacaaagaaacaagtgaacaaaggtctctggttttcctaggcagaggaccctgcggccttctgcagtgtttgtgtccctgggtacttgagattagggagtggtgatgactcttaacgagcatgctgccttcaagcatctgtttaacaaagcacatcttgcaccgcccttaacccatttaaccctgagtggacacagcacatgtttcagagagcacaggtttgggggtaaggtcccagatcaacaggatcccaaggcagaagaatttttcttagtacagaacaaaatgaagtgtctcccatgtctacttctttccacacagacacggcaaccatccgatttctcaatcttttccccacctttcccccctttctgttccacaaaaccgccattgtcatcgtggcccgttctcaatgagctgttgggtacacctcccagacggggtggtggccaggcagaggggctcctcacttcccagtaggggaggccgggcagaggcacccctcacctcccggaaggggcggctggccgggcggggggctgaccccccaacctcccggacggggcggctggccgggcagaggggctcctcacttcccagtaggggcggctgggcagaggcgcccctcacctcccggacggggcggctggccaggcggggggctgacccccccacctccctcccggacggggcggctggccgggcggggggctgaccccccccacctccctcccggacggggcggctggccgggcggggggctgacccccccaacctccctcccggacggggcggctggctgggcagggggctgatccccccacctccctcccggacagggcggctggccgggcagaggggctcctcacttcccagtaggggcggctgggcagaggcgcccctcacctcccggacagggtggctggccaggcgggacgctgacccccccacttccctcccagacgggtcggctggcctggcaggggctgacccccacctccctcccggacggggtggctgccaggcagagacactcctcacttcccagacggggtggctgctgggcggaggggctcctcacttctcagacggggcggctgccgggtggaggggctcctcacttctcagacggggcggctgccgggcggacgggctcctcacttctcagacagggcggctgggcagagatgctcctcacctcccagacgtggtcgcggccgagcagaggcgctcctcacatcccagacggggcggcggggcaaaggcgctccccacatctcagacgatgggcggccgggcagagacgctcctcgcttcctagatgggatggcggccgggaagaggggctcctcacttcctagatgggatggcggccgggcagagacgctcctcactttccagactgggcagccaggcagaggggctcctcacatcccagacgatgggcggccaggcagagacgctcctcacttcccagacggggtggcggccgggcagaggctgcattctcggcactttgggaggccaaggcaggcggctgggaggtggaggttgtagcgagccgagatcacgccactgcactccagcctgggcaccattgagcactgagtgaaccagacaccgtctgcaatcccggcacctccggaggccgaggctggcggatcactcgtggttaggagctggagaccagcccggccaacacagcgaaaccccgtctccaccaaaaaaatacaaaaaccagtcaggcgtggcggcgtgcgcctgcaatggcaggcactcggcaggctgaggcaggagaatcaggcagggaggttgcagtgagccgagatggcagcagtacagtccagcttcggctcggcatcagagggagagggggagggggagggggagggccatatttcttaccttttattgactcataattctgttcttaaaatgaccgttactttaaaagaatgatgagaaggattccatcagtatttgtttttatattactactggtattttaatccctttgtcctactttcagatactttatcaccaaaacacaacatatatacatcactctctcatgccaaatttaaggctttgaaggagtaaaaagttactgtttaccacagggatttggaaatgaatgagtttctggtggctgctctaataaactgctacaagcttagtggttttaaataatacagatttattattttacggttctggatgtcaggagtccaaaatgagtcttaaaggactaagatcaaaatgtctacagggctggttcctgtggaagctccagggcagaatctgttgcttgtttctttcacttccagaggctgccagcattccttggcttctggctgcgtcactatgatctctgtttccatgatcacattaccttcccctctaatgtacttaaatctccttcagtttccatctttttttttagacggagtttcactcttgctgcccaggctagagtgcaatggcacgatctcagctcactgcactttctgcctcccgggttcaagtgattcttctgcctcagcctcctacatagctgggattacagacatgccccaccacccccagctaattttgtatttttagtagagagggggtttcaccatgttagtcaggctggtctcaaactcctgatctcaggtgatccacctaccttggcctcccaaagtgctgggattacaggtgtgaaccactgtgcccagcctcagttttcatcttttaaggacaattgttactacatttagggcccagcaaggtaatccagaataatctctccatcacaagatacttgatgcattactatactagtcctattaatatttacactagattagtagtttatatcagatgttatgttaaagtgttgcaaagaccactgaagaaggtgaatggggactctggtctcctacctaccactggttcttcatctagaacatctctaattgtatctgttttgtataatctttcatttgaacaaagggttctaaggttaaaaacagaagattacggctgggcgcagtggctcatgcctacagaccgaggcgggtggatcatgatgaggtcaggagttcaagaccagcctggccaacatggtgaaaccccatctctcctaaaaatacaaaaattagctgagcgtggtagcaggtgcctgtaatcccagctactcaggaggctgaggcagagaattgcttgaacccgggaggtggagattgcattgagccgagatcacgccactgcactccagcctgggtgacagagcaagactcagtctcaaaaaaaaaaaaaaggaaaaaaaaccccagaagattactataccatcatagaacgtcactcattttggatttccttgatgttttctcatgatttgatttggattatgcatttttggcaagaatatcacagaagtgacattgtcctgctctctgtatactaacagggagtatgtgatactgatacgtcttataactggtgatgttaaccttgatcacttggttaggtgatagggtagtatctgttcaatttctccagtataaagttactatttttctctttgtaattaataaatagcttatggaggtactttgcaactatgcaaatatcctgtttctcatctaactttagcctactaattttagcatccattggtagatcttgcatgcagtaattattactataatgtttacagaatgatgatttttctgtttccctcaatcattttatttgagttataatccagtactgtcataatttatttcatcgctcagatttttcaagctttaaccattgggagctccttcagcttgcattctgtctcgtttcaacatatcccattctttttttgagtacttcctttccttcttacttcacacagtgttctgggctaatcttgtattttgcctgccccagccttggaatcaaccgtttttttgtttttttttttcttgaaatggtgtttcactcttgtcgctcaggctggagtgcaatggcgcaatcttggctcaccgcaacctctgcctcccaggttcaagcgattctccagcctcagcctccggaatagctgggattacaggcatgtgccaccatgcccggctaattttgtatttttttttacagggtttctccatgttggtcaggctggtcttgaactcccgacctcaggttatctgcctgcctcagcctcccaaagtgctggaatgacaggcgtgagccactgtgcctggccaaccatttctttaagaagtcctacttcctttaattaggaaatgatacttagaaaccagtttctggggttggtcatggtggctcactcctgtaatcccagcactttgggaggctgaggtaggaggatcacttgagctcaggagttcgagaccagcctgggcaacatagtgagacctggtctctattaaataaataagtacatgaccaaataacatagcaagacctcgtctctattaaataaatacataaataaaataataaataataaaagaaaccagtatctgggtgataaatgtgcttatgttgctactggggtattatttctagaccattccagcagacagcttcaaaatacaaatatatgtatgtattgttacaccaagtttgaggagtttaaaattgtctgaaatggcttccatattccattacttgaataaatatgtaatctaaattttaaagacttccagagaagattggtaacttgcttcagaaataaatttttcttctgggatgctgtaagacagggggttgatagtaaacactttttttttgcaataatcttttatcatagattttgaaatactgaggtttctttaggcaattgataattgctaagattttaatttggatgtaaaattgtattacacattgtattcttattaagttttggagtaatacctgagagcccacataatctctctatgacctgaaattgggcatgctaaactgtcatttatggcagagaatcgagttcctggaaaattatcatcttatttggtataaaaatattaattgcatgatttttccccctaaggtggtctcatggattataaccatttggatatttggttcactaacaattttcttactggccagagttcttggtggagaagtaagtagtttattttgaaaataatcttccttatttatggtgagcttagtttttgatactgcagatatcatcattagctatacaagaaactttcttgtcccagaattgctttatgctagttcctttaagatgatcaacatattagtattgtgcttactcaataaatagtacaagaaatgaggaaaaagaaaatatcccgtcccatttatgaagtaattgcagccttttagggaagcatataatttatttattttttatttatttatttgaaatggaatcttgctttgtcatcctgctgcagtgcagtggggcaatctcggctcattgcagcctccgcctcccaggttcccgattgtcctgcctcagccttccgagtagctgggattatagatatgtgccactatgcccggctaatttttgaatttttagtagagacagggtttcaccatgttggccaggctggtcttgaactcccaacctcaagcgatctgcctgtttagcctcccaaagtgctgggattacaggagtgagctactgcgcccagacaaaatttatttatttatttattattattatttttttttgagatggagtctcgctctgtcacccaggctggagtacagtggcacaatctcggctcactgctacctccacctcctgggttcaagcgattctcctgccttagcctcccgagtagctaggattacaagcacctgccaccctgcccaactaatttttgtatttttagtagagatggagtttcaccatgttggtcaagctggtctcaaactcccgatctcaagtgatctgcctcagcctcgcaaagtgctaggattaccggtgtgaaccactgtgcccagccagaatttattcttacagaaattctcaaactttgatctcaggttgccaaagagatttgtaacaataaaccaactacattttaacataaacaatacatttaaagaaaaataaccatattttccaaaacaaaagagttagaagagtagcattattttacatttttgtaagtagctttaatatctggctgaatggaaattggattctaatacatgctttttccattcaatctgttaagatatattgttttggctaaagtatctgaagaaaataaggctttatacaggtatataattgaaaagggagagtattttaataaccttttcagatgatggtgaatattctctgatatcacaccagaactcaagggggctgggcgccgtggctcatacctgtagtcccagcactttggggggctgacgcaggaggatcacttgcgcccaggagttccaataccagcctgggcaacgtagggagaccctatctctttaaaaattatccaggcatagtggtgtgtgcctgtggtcccagctactagggactgaggcaggagacttgcctgagcctgaggggttatggctgtggtgagctgtgttcgtgccactgcactgtagcctggccgacggtgaaatcttgtcttaaataaattaaataaataaggagttttgagctgggtgtgctggcgcatgcctgtagtcccagctacttgggaggctgaggcaggaggatcacttgagcccaggagtagtttttttgttttttgttttagcctggccagtgtggtgaaaccccgtctctactaaaaatacaaaaattgctgggcgcggtagctcacgcctgtcatcccagcactttgggaggccggggcgggtggatcacctgaggttgggagtttgagaccagcctgtccaacatggagaaaccccatccctactaaaaatgcaaaattagctggatgtggtggcacatgcctgcaatcccagctactcgggaagctgaggcaggagaatctcttgaacccgggaggcggaggttgtggtgagccatgatcgcaacattgcactttagcctgggcaacaagagcgaaactccgtctcaaaaaaaagataaaaaaattagccgggcatggaggcacgcgcctgtagtcccagctactcaggaggccgaggcagaagaatctcttgaacccgggaggcggaggttgcggtgagccgagatcgcgccactgcactccagtgtgggcgacagaggaggactccgtctttaaaaaaaaaaaaaaaaaaaaagagtttcttttatcccttctattttcagtttcagaagtgaatgatattagaatatatgttcaatcgagcatcttaataaaactcttgaataaatttagagtaacatctgtgaaacctttttactctgcatatggaaatttaaaataattctaatagacacttaaagtatatttgtttatatattatttcttatgtcctagacaaaacctagtataatatttatatgaaaatatgtatcattacgtgttttggtaattcaggaatgttgatgtaggagtttaggggcctacattttaatttgaacactgacaccttactagctttgctttccggagcaaagcagtgtttctctctaagaatcgatttcttcacaatagggacaataatgcctatatttcataggattgttatttcatttactctccacagcatgtgaagccctatcacagaacttggcataaagtagtcactaaaaaatatttttctcttcagtctctcctggctaccttccctttccttctggtcggcattggtaacatctaggttctctagaccttggatttttcatctgaatgggatggttgtagtccctttaaataattctacaatttaggggaagtagtgacaaaatgtaatgtagagatatactgaaggtagtatgaaactcaagagagaggtaaatgctggaaatatagatttgggtattatcagcaaatttattttaattgaaaccatgttggttggtgagactgcccaggaacatgggagactatatgatattttgaaataatgagtataatagtttatgatttcttcttaatgctcacatttatttgaatacagcaaggaatatatggtgttcaattttgattaaaatgagtatcttgatttcaatgatatttatttgaaattttcaaaattcacaggttgcatatggccaagtccttggagttataggatattcattacttcctctcattgtaatagcccctgtacttttggtggttggatcatttgaagtggtgtctacacttataaaagtaagttaaggattatgtattacatagtttactgttttccaatgtcaaaagtatactaggcctctagctaggaatattgtgatataaaactctttatcaaacagttggtagtattttggaagtgaccttccttactgattttgccagttatatttctttcattttttttcctttttaatcaccagatattactgtttgtctgggggaaaaaacaaagagcaaatcaggtttcaggatattatagtcagatttttgttttgttttctggagtctcgatctgtcaccaaggctggagtgcctcccaggttcatgtgattctcctgcctcagccttcctagtagctgggactacatgtgtgtgccaccatgcctggctaattttttgtttttagtagagatggggtttcaccatgttggccagactggtcttgaactcctgacctcaggtgatctgcctgccttggcctcccaaagtgctgggattacaggcatgagccaccacacccggcctggtcagcatttttctttttctttctttctttttttttttttttgagacagagtcttgctctgtcgcccaggctggagtgcagtggcgtgatctcagctcactgtaacctctgcctcctgggttcaagccattcttctgcttcagcctctcatgtagctgggactacaggtgcgcaccaccacacctagctaatttttgtgtttttagtagagacagggtttcaccgtattgtccaggctggtctcgaactcctgaccttgtgatccacccgcctcagcctcccaaagtgctgggattacaagcgtgagccactgctcccggctggtcagcattttttaaatgttggatttaaaatttattttctgtatttataatatgagttcatctgacagattttgagggggatatttatttaaaattccactggacatttatttagtaactgctactcctgtttgaatagtaactttcctatcaaatatgatagatgtggttctaataaattggattttccgtagtgcagagatcaggacttctttgtgttatttatgttaaatcaacatatatacatatatttaaatatttactgataaaagtattaataaatagtagtgtaacttaaacattggaatttattaatgtcgaacaactttgggaaataaatgactgctttgacacatatatgtatattacacagtgaatataagtttgttctttatggagaacagaacttttaaagactgtgactttcagaactgctgttatgtagcttccacatgaaagtatttgtttttaagtagctgagccacttgaaattattactaatttcaatataaaagaaataatgattccttttagaatttggaaactatacgctgatactgataataagcattgggaatcgaaaatgtgtggtttttggaactaatcagttctaaattcaaaccctggttctgccacttacttgctgtctggtcttccgaggtatcttaacttttcttaccctcaatttgttcttaacaatggtaaacttaactatattttagggttcgttacaaagagtttatatataatgctgatcaggcatggtggctaccgcctataatcccagcactttgggaggctgaggcgaatggattacttgagctcaggagtttgaaatcaatcagcctgggcaacgtggcgaaactccatctctacaaaatttagccaggtgtggtggcgggtacctgtggtcccagttccttgggaggctgaggtgggaggattgcttgggcccatgaggccgtggctgtagtgagccatgattgcaccactgcactccagcctaggtgacagagtgagaccctgtctctgcctagtacagtgcttggcacagagtaggcactcaagctgttgttattacaaatattataaaataggccaggtatggtggcttactgttgtaaatcccagcagtttggcaggccgaggcaggtggatcagttgagcccagttcgagactcaaccatttctccaaaaatacaaaaattagccgggcatggtggcatgcacctgttagtcctagctactcaggaggctgagatgggaggatcgcctgagcccaagaggttgaggctgcagtgagcagtgatcgtaccattgtactccagtgtaggtgacagtgagaccttgtctcaataaaaacccaaattgtaatattttgagatcatctttgtgtttaaatacttcagagactaaagataccttgttttcctattcagtataaccctaaagcctttttttgaaattggcattattagaacttagtttaaagtcttaacgttgcagcagacatttaattattcctattccagccttagtgaacataccactcacttaccatcatttcctggtgtgtgttttttcacttgggttaagcttgtttctgagactactcccaaaatggttaaaactattgttctgtggtcatctttaatcatatagttatcttaaagttggacctaaatattctttatacaacatataaatgtattataaaatggaaaactcttttttatatcattaaaaatttagagtaaaattgtttttaaacttcagattattctttgccaaaatttttttcctgatcatttaatcttctgtgagtagtgagctatttcacgtttcttatttcagtctgagttttgttgagaaatatgatgcgaaactaatcagtaaactccagcattagagtatatagtttaagtgcagtgattttatttaacattaaatctctgtaatacttatcactctgtaagcatttataatgaaaaaaatctaatcatgaaatacaaatgcagtttgatcaaattttattttatatatttccctgtacttttgtgtatgtttgaattatttcatagggttactttttttttttttaagttcaacaaacccagtggaaagatggaccagaccaaatacatttttaataagtttgccaatatttattttttacctgtataccagtgattctcaactgaggtagattttgtcccccaggggacatttgtcaacatctggaggcatttttgaggagtgtgactagtatatagtgtgtagagagcaggaatgctgctaaccatcctacaatgcacaggatagctccccacagccaagaagtacgcagcctaaaacgtcaatattgcaaggtttagaaactctgccttgtgccaggtctgttcctattagagtttccctgaatttccttgaagtttttccttaattttatgctataaaatgtgttaggtgactacatcaataagtattgcataagtttccagtagaaataatttaaaagtatgtatgtatgtgatccaaaaactatagtatactttatttaaactcttgacaaaatgtgatctttttatctcctttttattcaaccctgtatttctgcctattcctgggaaaaaacttaataaatattaagacttaataaatattgtataaaatttttacttaatcgattttcttatttagaaggaaaaggaaaatttcctactttgcaggaattagttttctctcagtaatttggtataataatagttttttcaaaagttgcctaatcataatcaccagggaacttatttaaaatactgataactagatccttcccttagaaattatagctcaaagaaaaagaaacaataagttataatttaacagaactagagagtcccccaagtctttttaataggcaccccaagtgattcttatgattagactggtttgataagaccacatttacagaagtcaaggagtagagcaaagatggacattcttaataagtttttaacatttgtaacaagttttactatttaccaaaattggttgttgattttttaaaaatattgtaaacaccatttttactctatgatatccaaaaagttaattgacttgctaatatgctgccttttgtcttttttcctttttttaaagctgtttggtgtgttttgggctgcctacagtgctgcttcattgttagtgggtgaagaattcaagaccaaaaagcctcttctgatttatccaatctttttattatacatttattttttgtcgttatatactggtgtgtgatccaagttatacatgaatagaaaaagatggtgttaaatttgtgtgtaggctgggaattcttgctgaaggaattggagaaaacctgttgctgcaaaattttacatgttccagatggaaagggaagtctaagcgctttttaaaacaatttttttttgtatttaattaagcaattgcagttatctgggatttttgggtcagaattttaaattctgtttgattctccatattccagtgaataaaatacaaaagcattgtgtttttaagattgtgtcgatattcacctaaaaacttgtgccaaaagcacctggattggtaattatatttcacttaaagggtaaatttgacaatatcttgataatcaaaagtgcaatttttttcttcaaaatgttttctccagcatcacagatcctgcagatatatatttatatttatacatatatatttatgaaataattcttactcacaaaatatatttctgataaacattaagatattaaatctgatgcacaaactttttaatttggccattaatcttttttatttaaaaatttaaatttgtttttaaaattgtatatagtttttaaaatctcacacatgcttcgatacttccttgttaagaattcttaataactactaaaactgatttttaatagttgctgatatatatttggtttgtttgggtatacttttcaaaaccatttttgaatgtccaaacatctgatttaaagtttctgtttatctttctgaccaaaggagcaagaggtataatggatatggcattcattaaaatctttactatgtacaaaaacagtaatatttacagcatcagtaaatatttttaagtggtacttctaaatcataaaagttggggaaagagacctttaaaatcttgtggtgttgaacaatgttatatgaagtagaaaaaataaaatacttcccagttgtgtgttttgttttacagca

SEQ ID NO: 734 - DNA, 154264 bp, Homo sapiens
ttgcagggttgtatacggcaactactttattattttcaaatgcaaactctttgcatttagtttgctattttacaattttacaaactaggtataaaagaccataaataaatgacataagttatgtgtacctaaagttcatgaagggaagaaaaataccttgacaaattaaaacaaaatagaaaatctatgtctaactccagaaatcactcaaagtttggaacgtgtgaaccgaacaatgttctgttaatttcttattcagtatgaactaaattataatatgccttatacattctaatttgaaccacagtccttgcatattccaacatacttagagtgatacaaaaaataaacgcactcttcagtgtgtatcaatgcttgatgttgtttggagaatgttaaataagtgaaaatattgcttctagaactttcctttatgggtcagaatttaagtgtcttcagacaaatattgaggctatacgggtgtacggattaatacacatatccttcacagattgaatacaagaggtctcagaatgcacacaccagcagtgtagcgagcacaacctttctttaaaataagaacgtttttcaacccaccagaacatttcactcgtaagattgctaaaaaataacttggggcctgcatacacaaggtgaagctacttgatttggtgcagcggggtagtttcccactgctctagagatcggcacatgagttagcattggagctcactcggccagggcttgcccacgggctcagacccagaccctgaagttggcctcctacccttacctctggaaaagatgaactgctcagaagagtcaacctcatttctttatacatatttttcaggcatcaatgcataggcacatcccttaaaaaatatattaaggtccccaaaaaggggtgaatcaactttgtcactctggcatagaacacaatgccacacaccctgtcagaatgtaataaatatttattgatgattttctctacttattcaacaataaatggttcagaatctattttttttcctcatttttccctgatttgatgttatagcttatataaatggccacggtttctgcaaccacagcttaggataagcaaggcagccactcagattatgaaaaatggcagtaagttggctggagtttggtatacatatcatatcaatactgaatcttcacactccggagctccgattctagaaggctgatgctcttgtgagggcaacaggagttagctgcatattaattactgtagaactttccaggtaattagggaatgtgaaattgcctgaggccatttcatcccaactaccttaacctcaagagtcactggcatgtatttttctgtgatattgggagacaaagtattaatccaggacacaccatctcaaagctgacacacatatctacgttcatctccaaaagtatatgaattgcatatattcgttcgcattcaacaagtccatttatgcaggaaaacaaaggctacttgtactccatttggggttaccagacacattccatctccttctctctctccatcaaggaactgatgattcagatgagttcaatcagaaaatttgtaattttgatgatgggttgtcacctgaatggatttatattttaaattacttcaccattaaggtgaaaatgcctctgtccaaagctgtagaattcttattaaggttagtgtgacagctacaaaatacacgtgtagatacaggatgcgtgtagatacaggatgctgaacatctctgggttgtctttccaaggggatggtctccaggtccactgtatcatgtagttcttcatcttgaaactggtggaaaaccagaactctccaggtgtagcattccacaacattcatgggtagtcctaagcatgaggctacgcacatacacacacccgcacacagacaggcacgcatacagacacactcacacctatgtacacacatcaaaagagatagtcagctcatatttagtctaagaaaaaaatatatttatatcactgcaatggcacaccctgggtaaaatgttacttccgcaatgcatatcataggcagctcatggaactggctttgttttgtgtggttgcacctgacctggtgtccatagtaagacctgtagcatttggtcacttgctgccacaccaatgcagcagtgacacacaggaatgaaatatggaaatacatataaataaaaccgcaaagagtctggggcaagggctctgcagagctggtgctgcgagacagtgcattcctcagtgcaactggagaacagatgctgaatcttaagtgtttgctgtttctttcactgcgaaaggggatttgaaagtcacacatttattcttttcaggtatgggtgttgtttcatcagtgtctttgccccagaactggtgtaattgaagcagaagaaacacatttagacggaactgaggagggtgtgttctgttttcttccacgggctttgtaatcaacaggaagggctgtgaggccaagatagcagaatctactccctgtagataaaagagcaagactttagacaaaacgtcgacccatattgcgagccaactgtcaaccactattgtaagaaagaatatataggttcgtagaagttggtatccttcagtaaaagtagttcagtggtgagatcacgaattatactttccttttctgaaaaatagcaattataagagcaaaaaaaacctgtttactaacagcttaattacaactccgagataggtactattcttatctccattatatggatgaggaaattgagcataaggagactaagtaccctgcccaatgccataccctctggagtggcaaggctgggattagaccccacaaagttctaattgatatttatgctttaaccaccgtgttgaacagcctgtctatgaaatgaaaatcctgacttgtttcagttcacaatccacccatagtcaacaataatgattgaaaaatgcaaactaagggccgggcgcggtggctcacgcctgtaatcccagcgttttgggagccgaggtgggcggatcacgaggtcaggagattgagaccatcctggctaacgtggtgaaaccccgtctctactaaaaatacaaaaaattagccaggcgtggtggcgggcgcctgtagtcccggctactcgggaggctgaggcaggaggagaatggcgtgaacctgggaggcggagcttgcagtgagccgagacagcgccactgctctccagcctgggtgacagagcgagactctgtctcaaaaaaaaaagaaaagaaaaaaaagaaaaatgcaaactaagaagtgaaaaaaagtggtggtttttcttaacaagagagtaactcctgataaatagaagtatctaatctaacatggcgaaagagccatactctctacatgtaaacaggcaggagagagggaacatgggacacagggagatacttgctctatgaacgacagaggtcttctaggttcaagcctccttccacatatcaagaactaatcagccgcaggctggaattctagacatcagcctggaatcgaacaaggctggcacacagcaatggactcctcatggctcctcattgtccatatatttgtcacataatcaactcaaaccaaaggaagtaagttcccttctttcatttataacaaccaactatccagattacttattggactatgcctcccaccacggtgaccatgtttagcagctggtggcctcaagcaaagggcagtaattaagaccaaaatgcacttttatagattattttgcctattttatcaaatcacttgtctgttttgcatatgtgtacatttatcgtgtagagaataaaatttaattttttgtagtaaacgaccatatttaaaattgtagaaaacactttagtctatttaaagagagagaaatcgttttctggccaggtcttgtagctcatacctgtaattccagcactttgggagcccaaggagggaagactgcttgagcccaagagtttgagaccagcctgggcaaaagagcaagaccccatctttaaaaaaaaaaaaaaaaattagccaggcatggttgtgcacacctgtggtccctgggtcgacatgaacatgaatgttatgttgacaattacgtaaaaatgacagaaaagtcatcaaatctaccttctaactatttcctctctggaaatcggtcaaatccatcaaatgtagtttttgaaacctgaatgtgaagggatttcatcaggtgggcaggtatttatgtgaagtatgaggagaacatgaatatgatcttaaaacgctagagtgtattccacgtcctgcggacacacaaggttggtaatggtttcttttgctactagaaattcttaaaggagaaagaatggtctcataaacacgtgttgcctttcagtctgccaattccttctccacttaacatctggatatcaatagatattacataaatatatttgtaatattaagtgggcaatttggggacttggtgtgtatgcagaaatgattggacatttgaattgagatgtaagggaatgtgaagacttgtatctacttaatgccaggatacgagttgagtgaaataagccttctcctcaccattgaattcaggcaactcctttatcatgggaaatttcttaaacagagaccagacaaagcatgtggtctatgtagggtcatgagttaaggagaattcattgtgactaaataaacaaaggcttgttcctttgagtcagtcgtgatgacatcaaaatgtctttaccatccagttcttttcattgcaatagaattttacttttgtatcactgtcttccccattacaaaacaataattttataaatgtcaaggctaaataatgcatgtttatcctgccagcataacttgaaaggtctaccaccattgtataaatatgtatttacctccaaactctcataaatccatttaagtgaagaagcttcactgtgtgacccccctaccactgaacttcatttcaccccactctggcatgttgtaataaaacaattggggttacaagtgaaagacagatgaataatacttggacaatgttggaggaagaagcgtacctttcttctgtggagctcaccgtgttttacttaagaatatttcatacacacttgcaacaacaccatgcattaggaaaggtgttattattaaggtatcattatctctctaatttccaggtggaggaactgagttataaagaaaagtggagtgaatttcccagtgtcaacatttcagttggctttagaatccatagctgtccggatgccagagtctggctctgcgccctgggaaacaatgcatcattcctattgttctcacatttctcttctaaaacttcatggaggtagtggagagagttaacacttttactgttgctggatattattttaggcacttggaaagtccttttttggcctttgcatcagccttgactctaatatatgcatatgttgaaattttgaagattcagacggtgacctttgaataaaataagatttcatacttcacctctcctttgatccttccctgattacttcatttacagaaatacctgctgagcaggaacaaaacaacaccagcatagtatataatgttgttaggctatttcagaatggacatgttctctgttgaaatggtctgcttttaatatgttcagtgtttagaaaataccttgtcttaagttgtagactttaagaaaaaaaaaaaaaacttttaattattcaatgtacacaaggtaacattctgttgttagttaaaatacaatgccacctgggcgcagtgaccgacgcctgtaatcccaacactttgggaggctgaggcaggtggactgtctgagatcaagagttcgagaccagcctggtcaacatggtgaaaccccgtctccactaaaaatacaaaaattagccaggcctgggtggtgggtgcctgtaatcccagctacttgggaggctgaggcagaattgcttgagcccaggaggccaaggttgcagtgagccaagattgcaccactgcactccagcctgggcaacagagtgagactttgtctcaaatagtaataataataataataataattttttttttttaccaagcaagcaaaagaaacaaaaaagtcctacatttgtcagcttttaacgtgaatatccagaactcctagacttctgcaaaagtggtgataaaacaaaaattgttggagtagttttaaaaacaaatttcacattccttctgaacagaaaagcttttacaacttatgttgcaaaaaaggttttcactaaactgtcatgatttgacagcatcaaatttaacattccttgctctataagaaatagctttcaggatacaaccaaggggaaagaaaggtcgttaaaatcagcaactcttgtttaaaagtgataaaaatgaaataactcaaaaaaaaaaaaagaatgaaaagttaaaatgtgtccagtccaaagttatgtcctttgtttctaggaatgaacaaactcaatgctggtatataaaaatagaagcattgaaagctaataggtttatggatgagcagtgcatttttcagtagttcaactttctgatcatgagaaagccgaggcgagttccaagtctcaccactggcatcttggtgaatcctctttggccctgtttggggatggagtttcctggagcaggacagaaaatgaggctaatggaaaagtctcgccagtacttctccattgaggtaaactctccaaaggacgggacccatgacctaacaaggttagagagaaagcctcctgtgcttgctgcctggtgcccagaagataataaatatgtgtaccatgaatgaatggcaccaaaggacaggaggagcccttcgtgatggaaagcacacagccaacagccagtgagcatctaggaccatccctcagagcctgacctcatctgggtcatatgtcacttctccccggaagaatagcagggaaaccacactgtgtttggtctcctctttcgctgtcaaaaaaggactgaaatcctgaaaaacatcaacacaacctgagagacatgagagagtatttttctgttttcagtatttcgaatgagatcaagtttaaagcacaaaaggagttttcactggagaaaaaatcattcttggttgttggacttaccttgcagatctggggtcgcttctttaaaggagcgaagtgtgaacgttctctattccagattgtcacagcccactatccacaagatagttaggacaagtttgtaaagtcccaaaataagactttatatggcacagcctcaggcccaaagaaacagacctcatttgtccagttaggggttatggggcttgggttacgtatatatatattttaaatccactttccctttctttccaggccccctgtgtcataggaatccaccaggcggcttgagcactgaagaggcaacactaatgagccacgtcgctttctcctaggacttttttttcccccatggtatgaaccaagccctaaaagccacagctgagtccttaaaaaatgttcctaggcatggtcttcattccagtgaaagacagatgactgtaatttatgccacaaacaaaatacaatggttgtaattccaaatggagagagaatcagggatgtctcagaagctcagtgtctggcagcaaatacagcatcaaaactcagaggcagtgttctatttctataggtacatgtattttacagactggtgatgaacagaaaagtacttctgagaaacgatttgttccaggtctcattcaaatgaccggcagtcatttctgtaagccccacagtttcagcaatctgtgcaccaagcaacgctgcagatattgtttttttttttcatttctttaatttcagagggcgaagacgaagtaaaaaaagtgcagttcttcaattaaagtgcatggatgaggtaaactaatttcaagagttttgagtttattcagtactggctcagacgggaaccattctgccgtgcatctgctgcatttgggttcgcattgcctggacactgctcaaaatcttattctggtgcgtgatggctgtgataccaattcttgccaggtccctgtacatagggcgacaaaaaagggacagaagaagtcacagggactgacaatctcttttcttgggcttcatgcagacacacgtttgaatcagccacaattaatacagcacaacaaggcaggtgtattaaaatgtttcattaagcaatttaatgcaagaatgtagatactttatagaggctgtgtaaaattatactcaatcaaaatgagaggcattccagattttttttaaatgagtaggatgattacgcagctcaaagcaaaaaaagaaaatactattaaatctagatttaccctttcgtgttacatcgttgagtacttactcctggttcacgtgcaccacagcctctagtgtggtataaccagcagctgtgaagttatccttataccggtccattttaatggcctggagccaatcgcccactgataccacagcagagaattcaggggagcttggatccaacaaggcagtgttaggtctagaaagagaacaagaaaatataagcagaacggagctaccagtgagacaagaagactcagaaatctgattgcctcaaataggcaaggagaactgaaaagctaagggaaggttttaaatggaacaattgttgttaaatgtaactatgcaatattttgctcttaacttcacaaagctgctaaagcatgtatcaatcatcctattttttcttaattctatttcctgcgcttgttttatgtggccctctgagggcattcatgctcatagcaggtcttttaacaccctagcctggggtgaagactgggagagccctcatggccgaaacctgttcaatctttgcagaaagagtccagtctctgccagtactgaatattacagactttcgttcagcaactatggaaaccctagtgaaggatgagtaaggaaaactgcgagcttgccacctgccagactggatggaagcagagaaaacagcaagaattcaagtccagcatgcttccagcctagtctacaggcaggcttggggcattcaaacaaacttgggacagcagggagttaatcccctctttaatcaatccatgcctgaccagcacgagtgccaaggctggcagaagaacggccactttgatcactgtttggattgtggaatgtgcttctcgtattcccttgctggggttcctgaataatgatttcaacaaattcaaagcacttcttattaacttatttattagtttactcatttcttaggccaggtgttttctattaggtcactgtcacaagcaattacaggctggaattctgcctttcctaatgatattgacatataaaaaatcatttactaataaaaactattaagagaattatagttagttatcttcatcacccaattgctgaataaccatagagcaggccttcatggggttattttatactacctttacttataataacctgtagaaaaatactgctacttgttaagtcatagtttttgaacttctgtttttcctaaaactcacagaatgtgtttgatcttaacattttgacctgattttcaacgtgatactatgtttaagtacaaacatttaaatcacaattatatcattactactaaattttcaaccaaaaaactctttccttgtaaaaacaaaattaagtcgatataatgctttacttttctacatagcagaattaatccaattcgatttttaaaattttcatttttatctaaattgacttgacttgtattatttcttttttatataaatattttaacaaagatttgttttatcagtcagttttgtgtccaaataataccttgccattgtaacctgtcttttgtgtccattatttcaatataagtttgattttctaagtacaattctgtaaatgtttacagcaaaaataatcaagatataattattctttcaattttgagtcaacaacaaatgttaccacatagaattttggacatttaattgagtgtggatatatagcaataatatttgttattagacaaaagccaatagtttgcatttacttctgactttaagccaaaagcattaatgaggaagatgtaggctctgagcaccgacaaggtcaaaatgaccttacaatgaaaatatcttcactcgatgtcaattaactttaagggtggttcttaagcttgttctggaagcctctgtgctcttggtagcacaccatgatgttagcctaattttgtgctgaatcacataccatgttatactacatctcattataggtaagccataataagcttcaaagctatttaagtaccatcagcaaaaagaatttagaactgataatagtgtatctaatacctcaacttgttctgtaccttggggcaaagcagatgctatgtgatagtagtggttgaatgacttatgctaacagaagaagtaccaaacaccaaaaaactggccttgaatggaccctcagacaaaatacatgggctctggtgctgaagatctaaaaggtggaagagaagtcagctagatctggaaaggaggccttatagtcatctatttcaccctcctggagaacagaagaacaagaaatagcctcacaatagtaggagacttttaattttttttagttcacatagtgaccaagtggcagaggtgaaatgttaattcagcccttttcagtgttatttgaaaagagctggatagaccattgagcattttgtgtagtggctaatgacagggatttgaaaacctggtggagaatatagggtatctctactatctattccacagttctcttttttttcatgtaatgtgttttccttcttttctagaatctttagtccaagttttcaggagaaagatgagaggagaacaccacagggcctgcaaagactggaagggcttaaatattacgggagaaaatgtcctcctatttttaacacaggatcatgatgaaacagaagcctgtgagaagctcagacttggagatgagtgagtgtctcacctctcgcaggcctgagtcacctggtctattatgcctgtattctaaaataatttaactgataaagatggtccacaccctttcagatgagactactgatatgtaggtatcctgagtcttataccagtaaagtccattctccatgtagaaagttctcactgaacttgtaggacttatagtatctttatgttctctacagactgatatacttcttcattttgctcattccaagaaaataactacctctttcaggtggtccaatcattttggtctttaaaatccttcccaaacattcatctgcatgctttataactcaatcatttcctatcttggccctgtttcctcctactctgaaagactcagaaaagggaaaccagaagaactgaaacctaatgaatctctttcttacaattaacactttataaatcaacttaaaattgccgtgcttaaagacctgttttctaatctttatttcttactattccagtgttcctgccccatttcaaaatatagcacctactgatctgaacgtcttctaaaagtacatttcacccctcttcctaaatttcaggcctggcatcctaaaataggcacttcagttatttctttcctactattattattttttaaagttttttccttataactatttgatgcctgacaggtattagttattcaaaatgctgaatagaactacctgaaatactctactaattgagaaagaagccacccaggttgcagagagccatgaagtggcctctgatgaaaaggcaggaatttaagtgagtcaccacttgcctgcctcctctaatgtgttctttcatacatcactattaagtaagcatggctgacctggagctctccgtccctgtcctcttcaagctgttggggttgcggatgagtttgtccaacatgttgacaatctgcccaaatttaggcctgtcgctcctctccttctgccagcagtctagcatcagctggtggagcgcaatggggcagtccattggagggggtaaccgatagccttcctcaatggctttaatcacctatggaagacaacaggatggtatgttaagctgccaggcaagctgctgttcaaggttcacccttccgactggcatgtttcttgtgcatgaagctgccagcaagctggagcctgggaacagctccaactccttcacatgagccaaagctagacctgagtatcactggcaacaggagagggaagccagctgttgcactgaggtgtactctaaagggaagatgcatcaatgttctcaagtggctagagcccagtcaaatccacaatgtggtgtcagttttggtgacggccctcagagatcatgtggccctgccccctgccccctgcctccagtcccctgccccgctccattctgctattagcacacctaaacactcttcgcaaaagagactctgacttagtgccaaagacctcccttgggaagcaattaatagctgtctccaaaatggaattttctttgcctccttttaaggccctgtcctcttacatagacagccagtgtgtcaacaccagagtccaagtccagacgcccagccattttttcttttggattactctacccctagacaccaactctgaatttctttcttggtctcagttggctgtcagtcgaccctgttaaaggtgttagtaagtagattttttttaaaaaagtaaaaaacaattaaaaaaattccttcttttggggcatttacattttaaaggagaccctcgcacatctaaagaaggaagttataatggtacatgataattgtcttattggccaagaccatccagagtgcccagagtggtctccttgcctagtaagtcataaataactcattcaacagtctctttgctaattctaatttttctaatctgtcttcacaggcattaaattattttcttatagccttttctctaacatcctccccctgctttggggtataaattccaagaaaataatatggtaggacatgccaaatttatagaggagaactacttcacagttttttggctactcattacctttgtttatggatatcctctgagattctggaggtgcttttatttgtttgggagtctaaaagttttatttgctttaaatcactccatttatttttctttctatcaacatgatagctgccagagaaataagcagtggttgagccatcccaatgacttcactggactcaccctgtggtgggtctattgactgctcagaaattggccttcgaaagaaaagagtctgttgggtccagggtccatggattagtatgactgtgatctttttaataagagcaccgtttcagtttaacaaatcatcttgtgatttattaagccctctgatcctttttctcctatgtattttgccaatatcatgtatcagtatcacctacttttctttgtaaagcagacttctctatgctgtcttattgaaccttattctatttgtttctagcaattacactacgtcagtttgatcacctgggtttcttttatcttcccaggtgcatcgtgttgactctagacttgatgagaacattttgcactgaattgaggagaatgaaagcaacactgggctgatgccagcggaacataaattgttataacccctcagactgattaatgctctttcataagctccctatccactgccagcttggaagatggctcataggttagcaaagcatattttctcagtttactactaaatattttggggggcagaggattaaactaaacaaaaaacttgctaagtttgacatattttcaacagttactttcactccatttaccatatgccaaattaattctatgcatcaaagtaattccccagatacatttcctattgattcctgttctacatagaatccaacacagagacaaataatagatcaatattatttgtgagcaagaaatggcttcagatgccttttcgtggataaagccagagaactgaaagttcaaaacaacagaattctttatatatatatattgtttttttatatatatgtgtgtatatatatataaaatacatatatataaactgccaaaattacagatctgaacatatttagggtagaaaaactgacatctttagatactctgctcttacgaacatttggccatgatttcaacggaagaaaaagaaagcttaagtatcgaataattacagtaactacatttactatttgctcatttaggttttttgtctttgtccctgtgagagtctctaacctgaatccaaatgtggctacaagaagctactagaagctgtctgcacagcataatcacataaacaatagattacatgctattcccctccatagtcttcttccaacctgtaattactatcacttaggctagctgctttcttcccatctgctatgaatcttctgttataatccacagataatacagtgtgaacactaccattccccttaatctggttggtcagcatagagaattctttttgccccaccagacatggagtgcatttctctattgcaccgaacatttttttttttttttgagacagagtctcattctgtggcccaggctgaattacagtggtgtcatcttggctcactgcaacctccgcctcccaggttcaagcgattagcctacctcagcgtcccgagtagctgggactacaggcgcacaccaccacgcccagcaaatctttgtattttttttttttttttttttttttgagacggagtcttactctttcgcccaggctggagtgcagtggcgtgatctctgctcactgcaatctctgcctcttaggttctagcgattctcctgcctcagcctcctgagtagctgggattccaggcacccaccactatgcccggctaattttttgtatttttagtagagacggggtttcaccatgttgctcaggctggtctcgaactcctgaccttgtgatccacccgcctcggcctcccaaagtgctgggattacaggcgtgagccacagggcccggcctgcattgaacattctttaattgataaggcaacctgcatcccatttcttaagtgcacgtggctctaactgtcaaggctgtgcaactgcctgttgttggaggaagacaaggcagatggataggtaacattccaccacagagagaatttttgaaaagaagtttccaaaatataattataactgataaactgaataccttgcatttgtaaacactctctgataatggactaccacatacataaaaaattaggaaagttcgaaaagtataggtggccatttaattttaatatgattcccaatcttaccagaactaatgtaaacttttccagaattagctaaaacgtgttctaggaagaccccttgatcaatgctttcttttatttttttttctttctttctcactggagatgtttgtaattaaattctattactctggaatcttattagtgtcattattgaatccttttctgaaattgcagtcattgtggatactcccttacgaagtagtccagatggtacatttaaagggatgtgcataatttaccaagggtcattgagtgaagctttattttagagtcctcaaggggtgagctctaattacaacgatgccagctttaaaatattcactagttttctttcaataagcctttcatgtccgttttatcatatgtgaaatttattttttcataatctttgcattttcttaaaagtcaaagtttaattttgttttactctggttttgaaagttcaccaagtaaaaatactatcccatattttttatccatgaatctatgtgcgtatgtatctatctcccatactgtaccatgtaggccatttaattcttgtccttgaaatcaatagtcattggttgtaatgttgaactagcttgctagatatatctgtattaagaaatttgagtttaatgtatcatttcaaaccccgtgcccactccatcatacagtaatgcagaacttcctgaatctcaatgtgaaaaaatatatttcagaacatagagacttacatcttgattggacatatcccaatagggcctctccccgtacgacatcacttcccacataacgattccatagctccatacatcacttgctgatgtgaatttacgataggcaattgcttctggcgcagtccaccggataggaatcttgccaccctgtgaacatttgagccataagttattccttaagtacatcactgatgtgccattttagattctgaatgtagttcctgctagccaagcaggacaacagcattcttgagatagctctcaaaacaataagacacttgttcattttaacgcaagtcttccaggttaacacagttctcttatgttttctttactcacagggaagtgactaagtaatctaattatgtttttaaagcctacctattatctgagctctgcttaaggcaatattctagaaaaaaagaaatctcaggttttacaaaatacgtgttatctacggggtatcagtgatatgtagctgacatttgtttgattttttgttggattctctcacccaggagcacaaaggaaggcaatgcttacactgcttcaaaaatcatgaatgaaggaatttaaatatgaacatttctatccatcacacaagtctacctccccttatacagcatgagaaatatgtccaatagctaggggatgatatgataaataggcctttagagaaagccaaataataccagatactagagctattaatgactttaatggagtaagggcaggatattagttgttattaaattaaaaaaaaaagacttgtaaaatggtaaagcaagtgaatattacccaggaaaagttgcaaaacacacttttttttctgcctcaaatgtcttgtttgtttatgcttaggtataaggtattttcagtcaggttttcaatgtcctagggttccacctggggaaattaattcaagtctaattcagacccctgaggtatccccagggctatcatttaaaaggtttctttgctttcttaggtagggctacgaaacaggacaataaattgtactggaaattgctttgatacattgcagtaaactctgaaaacccagtgtattgcattcatccttgttacgcacagaaggacacttgtactgcattcccccctgcttaaatatttggctaaggttttatctatgtaaatgtatcattctagaagcctcctttaacttttctttctccaactactgggaaaaaataaaagatcttcaacattcacaaagatctattcttttctaaacgaatggacttggaattcaaaagaggacaagcataagaatcaaaactggagccaaagaaatagaatactatacccccctgcccccctccaaaaaaagctcagccaaccaaccaacaacaaaaaacccccattgcttgggattgcagatgcaaaatgaagagtgttaaaaggggaaaatggctggtaactgtcagcttcgtgttgattttaacagtgtcagtgttaatggccaataactgttttatgattctgtgtttattccattagtattttatattcagatagtcgagctaagatagcacagccattaactgtgtacttaaaactcttcactgtgtcctaatccccgcttatctaccagtggtaaaatgaaggccattagatactggaaaaccttgcatggtataaatgttttataaatcctgtatatacattctgagatttggtagccaaccaactagaaacattgctttgtctcatttagaataaggattttttttaaagaatagaaaaaaggcaaatacaaaacctaaaacaacaacaaaaaaaaaaaaaggaagaaagaggcaggaagacaggcaggcaaatacaagtgcaaaaaaataaataagtgaagctacctcctgattttctcagtaattgatcatttgttgtgtaaactgatccttaatgcttgcttctcagctcatttttatttaagacaccgtcttattgttcattagcactttcttccccctgccctcccaaaaaaaaacatagagggaaagataattcattttgcttctagtttgtggctgttaatatggtcatacatctacagtcagcttcaaaatccctcttttattggaaacatggtttaaaaatggatgcaggaatatgaggaggcttcaagggatgagaaaacttaaaaaataaaaaaattacaaagggcttcaatctcaaagtgagaagagaggaacagtttcaccagagtgaaagcccagatgtcaccgatctttcttaccctggtggtgtaagctgcttccggatcatcctcaagcactcgggacatgccaaaatcagacactttgcagaccaagttgctgttcaccaggatgttccgtgcggccagatcacgatgcacatagctcatatcagataaatacttcatcccagacccaatgccacgaagcatgcccaccagctgaatgactgtaaatctgccatcatttttctgcatagaaaaggagtgaggaacaatctcattagcattaggccaagttaattctcaccaagcatttattacttgaatctttttgggtatctgtatccggtatgcaatgaaactcaacattatttccaggcctttctgaccaaagtcgctaattcactagtagactgtaccctaggagctgggtttgcttcctgtgatagatggaaattatccaactgtaatgaatctacggctccaacagctccacattacaggaataaatcaaaaactaccctcgttgaacatggattatttaatagccttaaaaatcacatcattctccatttctcctcttctttctttgcccattaaaagaaatccacgaataccaccgaacacaacaaacacaaggactctgttaggagttttctaaataccaacattcttgggtttaatataaagtagtcacataccctgaggaatgcatccaaggagccattctccatgtactctgttatgatcattactggtttacctagagttttcagaaagaaaaacacaaacctttgatgagcgctgcacttaatgagataaaaatgggctgcgcacaattttactgccaagatacctgtcttgtgtgatctaatttaattaaaacaagccaagcttatgcctcagctgtggggagctaggaatgaaatattaaaaggacgagtaggtttaaattccatctggatagttaaacctttgggtggcttgttgacaaggtctttaactaaagtggcctctggtatccagggagcatatgaatggataattgctctctcaagcaaaaggggaaaatgataaatggggaggcctgtttcaatgcagaaataatctttaggataattaatttattttgtcctcagaagagccacttgtaagaagctaaggaggtcaataggcaataaacttctttatttagagaaatccatgtttcagggagcagtagctatgttgaatccttccttacccagacaagccttaaaaccaagcacgcaggcgggttcggtggctcatgcctgtaatctcagcactttgggaggccaagacagtcggattgcctcaggtcaggagttcgagacaagcctggccaacatggtgaaaccccgtttctactaaaaatacaaaaaaaaaaaaaaaatttgccaagcatggtggcaggcgcctgtaatcccagctactcaggaggctgaggcaggagaattgcttgaactcgggaggccaaggttgtagtgagccgagattgcgtcattacactccagcctggggggcgacgatacagagactccgtctcaaaaaacaaacaaaaaaacaagcatgcgacttctctccactgtcttgctcagctcagggcctctgtctttctcttcactttccctagctatgaataaacttgctttggtctgattccttaaactgcctacctcaaaaaacaaacaaacaaaaaccccagaacagtcacaggaaaggttcagaaaattatttcatctgagacaggaatttaaattcaatactagaacatccttatttcccccattccccctacctattttttttttctgcaaagaaataaaaatgattttaagctctgagcagaatgaggtgtaaataagattttcacaaaagtccgctttctgaggactttaggacataagaaccattctttaccttcttgatcacaggcaataggctcaaggtctgaaattccttctttctaaagggtatttattgttggcaagtggagggtgggaatcatgaggtgtttttttttgctttgttttgttttttctaagagcaggataaaacaggtccctaaaatattcctttggaagaaaataaaatgtcagtttgatataccaaaaatattcacactggcagggcacggtggctcacacctgcaattccagcactttgggaggccgaggcaggtgggtcacttgaggcaaggggtttgagaccagcctagccaacatggtgaaacctcgtgtctactaaaaatacaaaaatttgccgggtgcagtacgcacttgcagtcccagcttctcgggaggctgagacaagagaatcacttgagcccaggaggcagaggttgcagtgagccgagatcatgccactgcactgaagcctgggtgacagagtgagagtcattctaaaaaaataaaaataaaaaaaatcacactttttattgctgcattggctgattatttagacttcagtctagaaaaatgggctgaactatttcaccgctgaaaagcacccataattattctaaagaaatacattttccacccagtgattccatcagcttataatttctggcatatagggcatggggaaatttttcaccttaggggcaaaagtgttgaagagtgggtttttaattccatgaagtccaatatatcaatttgtgatatttcttgattgcttgagtttttggtgttgtgtctaagaaattactcagaggcaaacacttttgcattagaaaatggtaccatggacattttattttcaagtgaggaaagaaggctggtagaaaaagtgggaatcttggtgcagaccaaaggtgcataaaaccacttttaagtcttttctctacgctggcaggggtgtgtctgcacattctctatcaatacaaataggaaatgcttagttctcagattcatttaccctctacatatgtgaccagggttttctactcaaaaaaaaaaaaaaaaattgccggatgcagtggtgcacacctgtagtcccagctactcgggaggctgagacaggagaatcacttgagcccaggaggcggaggttacagtgagccaagatcgtgccactgcactcaagcctgggtgaatttcttttcttttcttttttttttttaagagacagggtctggctctgtggcccaagctagagtacagtgacatgatcataactcactgcagccttgaactcctgggctcaagggatcctcctgcctcagcctcttgagtagctgggattccaggcactagccaccgagcccagcttgtgaccatagtcttctgacagaacaaatgtgcctaaatgagttttaatcaacctgcctcaatcaaaagatactttgtcaactaacgagaaagggcagcctctcatggctgtgcattaacacctccttgcatttcaccagatccctctggagctgtggagacgacaggagaggatccaaaagtgagggtcatgcggagaatttatggtcctcctgccaatttaaaaagttactcaagtaactgctggtaatgaattcacacgcttccactctaccctttcaccctcacacctccctagtcggactcttggcaccatcttcacaaattttctgcattccattttctgtttattaaaagtatccatttgtcagatcctttatgagctctacaagggaaacaaagatgaatgtctccataagcaaaggggcttataaaataggcctgggctgggctcttggatagaggagtctccttccctgcagtaggcagggatgcagtggggaggaaaggggtgggggaagggaatagcttctccaatagaaattttaaatcattttaattcagtgacaactgcattatgcaaatgcatccagtcgtttataacagttacagctgtaatagctacgtgttttagaggcgcggtgggactttaatacaaagatcccctgtttcttctctcttctgcagaggtgctaggaaaatcactgtctgcgacaggaaaaacaccctaagctgaacagagcctcctttttagaaaacggacctgcaaaagtatttaaagggaatgttatcttttaattaaagtagtgaagggctctgggcggccctgaaggccacaggcaacagaaaaatatcctgtctgtaaaactaatctcaaaaagcaaatagagctattctatgctaattatagccttcaccttatgcggaaaattatatatccttctcaccaaggttcctttttttttttttttgaaagattctgaagatggggaaagatgtacctacttcttaagacataatagcaccactgaacacgtacgaggttttttctgaaaaaatttgctattgtggtaaccactctaagtattctatttcatccccaaaataaccttataaggcaaatgctctttttacctccattttacagatgagaaaactgaaagagaaagattgaacaagtagtccaaggtcacaagctttagaagcagcagaggtggtatgcggtcgtttgtccccaggccaatggttctcaaagcgtgattcccataccagcagcattggcttcacctgtggtgagctctcttgcactccaaacttacgggccgcacaccacctgctgaatcaaacctctgagcaggaggcccaagaaactgtcctaacaagctttccagaagattcttatgtttgaggacccctgaactgtatagtgtgtactttctctcccattttagtaaccacctcatttcttcttcctaaagattttgtactttgtgtcctactagccacctgccccaggcctaatgtctcattttttcttttcttttctttttttttttttttttaagtagagacaggtttctattaaaaaaatagagtccaggtgcctctgtcacctggactggggtgcagtggtactatcgtagctcactaggaatgatatggacaggcggcagggaaatactgggtagaagagggtggttccctgcaaaggccccaccttcaacactggaaaccgtgggcattaccttaggaatagtcaaactccaggggaagattatcttcctattccttcccctttccagctccccatcccgctgagagccacctccatcacccaataaaacctacacattcaccatccttcaagtccatgtgacctgattcttcctggacaccagacaggaacccaggtaccaagacgggagggtgaaaaaggctgtcaccccgactctccactgagctggttaacacttagccatccgtggatgacaactgctaaaagagcattatttgtaacatacacctggggctccagaggtcactggcaaccactcgcccaggctcctgcaggtgctaaactgtgtgctccccctcctacaagaagtttgagctcggtggccaagcaaaacaagtcacaccccattacaagtcccacgaggggtccaggaaacttacccatctcaactgcagcctcaaactcctgggctcaagtgatcctcctgcctcagcctcctaagtagctaagactacaggtatgagtgattacacccagcatcagtttttctctttaacctaccctcctccgactgctcccccacactggggtggctatattgccattactctgcacacgctgactgaagatgctttccacagacaccttgaatcaaagaagaaaagccttggctttccaggggacacagccccaggcttatgagatccttgacttgtagtaactgtagtgtgtatgagggctcttggaacacagccaccttaaacagggactgcctcagctgtgctgtctatgtggcactttataagttggtcttagccagccttacagatttactcaggatttgcttcacaaaatgcatctgttgagctgtgtcgcattttaactgaagcgtggttcataggctcagcgaatgctaatggactaaaaaaggaaagttcaaccaggtgttactgtaaataggtgctgaactgcaacagccataaatcaggcagagcagacaagcaaatcccgcaatatattcaagattcccaagcttcactctctgcatctggaaccaaagattccagcacaaggtgtggccaggttttgttgtgctttataggaaaagtacttaaattttattttgcttaccatctgcttgagcccaccctatgacaatcagtttggcctagcaaatatctgaaggatggcatggcataccacaaatctgcaatattaatttctctaaaatctcacacaagctgccttggagatagggtatccagccaaaaccaaagacccatttagagctgactacaagattaatgacttgtcctgcactgatttcctcctattagcaatcagtgggtctgcgccatctgtcatttccctggaaagaaaatgtgtgtttaatttcccagtaacttctagcttggctttgtaaagggggtgacccacgtacatttagtgaccacgccttccaagtgaatgatgttcggatggtcaaactgtcccatgatgctggcctcactcaggaagtctctcctctgtttgtctgtataaccagctttcagagtcttgatagccacacagatctctctcttgccaggcactttgagacgcccactgcatacctcaccaaattcacctttgagagagaaaaagaatctacgatggaccagaaacacattcaagatgaaagaataacagctaacattccttgagtgcttgttacacgccaggctgtttgctagtgctttgcatagattatttcacaaaatcctccatgcaaccctgaagtagatgctactattagccccattttattagagaaaactaaggcttaatgcaaaaaacctacacaaaatcttagttagtaagaaacagagtaaatcttttgaatgcaatcaatctgatttcagattgcattaagtttctctctaagaataaaatcaaaatttgtactagagttctttataacacatgatattttatactcaaaaaaggaaatttcatgtatatacacacatataatatactcacaaaagcatttatgtaatccacacacatatttaacatccaccaagaaaacagactcattagcagacggacactcagacacttaccaactcctataactttttcaatcttaatgcaggatgcgtcaatttctttggcaaactctcgcactgcttggttgggatcttcgtacgtaaaggggtccacatatgttcttacacctgagtgataaacatgataagttggctgaatacttctaaggaaccactaataaacataaatagtctgggtctaaaattaccaaacataggaaaagtcaagttagctgtacggtcttgacatatgaaaatggttaaattcttgctctggttttcattagtgggtaaacaaaatattgttagctacttaagaggctgcagctttactgacttcctggaatgtcttcacacttcaaggacaagatttttaaaacaacccatcccatggaggaaatttgaattgtgttagctaaatactattgtcccaagcagttgctcatagctcccttgcctttgcatgaagtcctacccactactttcagttatcctcccttagggaaggaaatagaagcattttaatttcaaacagctctttccacatggtgtcacattttgcccaatatctggatgaattaaatatgtgaccaacaattaacaaaattagattaaacctaagttaaagtagacaataaggttaatatcagctagttgatttgagaatacagactctgtagtggacctcacttcttttctggtttggaaagaaggtgtcataagctaagatattcaagtttgccagaaagtttcagctggagataagcattgtagcctagacatcaggaagtatgattcagccatatctcatactacccataaactaaatttagatgtgtttgccggcagcccagtgacagatatctgggccaagaggcagaagtcattgtaaaaagctttgtcctggcacttgcacctctccctcctggagctgttggggcactggggcacagagggtatgaaggacaccagttggcccagtcccttcgactttccaagcctgtaggtcttgtcctcatcccagcaccattggttaggaataagctccttaaattggcaatttcttgctacttctttttaatagatcagctttttaaaaaaacatatattccatgtaaaaatttaaaaaacatgattttaggaggaaacgaggtgaataaatggaaagttgttagacacttcatatccctcatcactttatatgctatagccaagaaaatcttcaagatgagtcttgttattcccagtccctctctttttttctatcttttttttttttttttttttttttttttctggagacagagtctggctgtgtcgctcaggctggagtacagtggtaggatcttggttcactgcaacctccgcctcctgggttcaagcaattctcgtgcctcagcctcctgagtatctgggattacaggcgtgcattatcatgcctggctaatttagttattttttgtagagacggagttttgccatgttggctaggctggtctcgaactccagatctcaagtgatctgccctccttggcctcccaaagtgctaggattacaggcataagccactgtgcccggccaatctttcttctatctttctgcactaatatgtgagtgacttgttacatgaggctatctaaatataaataagttaaatttaaaaatcactttctcagtcatattagctacatttcaagtattcaatagcttgtgtggctattggcttacattttggacagtgcagatatagaacaatgttatctcagaaagttctagtggacagctctcctggatagtcaccaaccactgtccatttaaaagtcttctactggctgggtgcggtggctcacacctgtaatcccagcgctttgggaggccgaggcgggcggatcacgaggtcaggagatggagaccatcctggctaacacggtgaaatcccatctctactaaaagtacaaaaaaattagccgggggtcgtggcgggtgcctgtaatcccagctactcaggaggctgaggtgggagaatggtgtgaaccagggaggcggagcttgcagtgagccaagatcatgccagtgcactccagcctggccgacagagcaagactccgtcagaaaaaaaaaaaaaaaaaaaagtcttctaccttgcttaagtcactctagagccacttttaatgtcttctttgacctctttggaacatcaaaattagaatccactaaaaatttattgacagtcactaattctatatcacatatagccattccctgggaagtagcaattactgttacatttcttattcttttcctcctcctcaaatttccagcttagattaaaaaaaatacccatttaattttgccacccagctacaacaatgagccagctagactgataactttcttagggtagaggataaaataagaaaaagtaaaaatctaaagaaacttctctacctcatcccacatctttaatctcaccatccaaatcacccatttcagtttgatacctaggaagtacattattgggataaggaataaatatattatattatataacattaatagccacgtaaatattatttgaacatgtttaaactagaaaacgtgtgacatgctctaaaaatagaattttttaatccaattttttgtaccttgattcaaatgtttctcttcatccgcttcttgtttggctttactgtatttactccgtctattaaaatttttttaaaaaagagaattattttcctcaaacacctaagctttaacacatgccataagacaaattctttgctactgtaagtcaggcaggtatgctatgtacatttcagagatgagaaaactgagacttacaagagatgaaatacttgtcacctgggtagtgagtcatggttttaagctcaagcagtcacagacacctctgaaccacaattttaaactgaggtgtcttacaataggttaaagcaaatattttataatataattataatttaaaatctctcagagaaaatttatcttattgaagataagtttattggctatttttccatttatataaatatacatgtgtatatatatgtacatgtgtgtatatgtatatatacattctaaattaaatttccatgagtaattctgtgtaaatcaaatggcagtaatgttcagtatgtgataggtaatagtaaatattattgctataaccagataactactaccacaaaacttcattatcatattacatgatactcttgaaacaatacttttgcggtcactggtttcagttgctgcatacaaattcccaacttattaacaaaatgtttaaaagtaagtatttgctttgtactgaattatgttccctaatttgtaaaaaaatgagcaagggtaaaaatgagctttgttttgctttgcctaattcactttcagtaaaatggtgcattgtcttaaacctggcattctgctcctacaacttttaatagcctaaatttggctttgttataaagctttgtggattagaaatcttcagtacacataaatattcaatcagaaatgtatatatctctcttatacaaactggaaaatcaactcaagccttgcaaatcaaaaatcttgaatatatatacatagtgagtcaggagaatatatatcacttaaaggaatcagaaagtcaactccgttgatatcacagctgtctaaagcttgggaagttgagaccaaattagtaaataaaatgtatacatttatgtttctgtcagaaaggtacaatttacactggaatttacattctatgttttcttagagcttcaaagacaaggtaaggcaagactcttacagaaaaagaaacacggtctgagataagtaaaaattcccgcaaagccaggtgtcttggcagtgtggtcctgtcaaaatcctataccctgaactcttaaactttgaacaggtagaaaggcagatgattacgaaaaagagagaataacagagaacctaaaggagccaggcagtgcaaccagagaggcagcggatcccggtcacatgctccaaccttccctcccacattcctctcctaattgtcagcagcgcaagaaccagctcagcaatcagaccctcagagcctacagatgtttctccgtggggataattccctggcaaataataaaaccttgcacttttacactgcatttaacttttcaaagtgctctcatctcatatattatctccttccctaactgtttgcaaagcaggaaccaacttagcaaaacagagaccccaatgactacagctaactgtgaagtacagtatttcagtcccaaatcataagcttgcattttcctttgcatttaacttttcaaagggtctatttttatttatttatttatttatttaatttattattttttgagacagagtgtcactctgttgctcaggccggagtgcagtgctatgatctcagctcactgcaacctccacctctagggctcaagcgatcctcctgcctcagcctcctgagtagctgggattataggcacccgccacccatgctcggctaattttgtatttttagtagagccagggtttcaccatgttggccaagctggtctcaaactcttgacctcaagtaatccgcccacataggcctcccaaagtgctgggattataggcatgaaccaccgcacccagccagaatctattatttaattgcatcttcatgacaaccctttgaaagcaaccaggcagacacacatgctcagattccctgtagatgaggacatggagctggggtggggtggggggtggggagcaagaggatcaccacgtgctctcctagcaagtacaggactttgtgaaagccctgatccagcccacgacttcatagagcctctcttactggagattagttacataaggatacctggtgagagttaattataagtagtattacgttttatatcagtacattcacttaaagtgaattcaattgctcttaaaatccattgcttcattgaagtaactaaacaggtttaaataccctgaagccaaacaactttctataaaagatgaagtctcctccaatcttcttcctctccctccacccccgtcctttcccttcttttaaaggaatataagagtgttaggtcagggactactaaaataacattttatgtcaggaaaatgccatcgattggtcccaagggagtgatagggtcctgccagcctgaaacattgtgtcttatcagagctcctaaaagcattatctaaaattacaagtatctcttttaaaccacttaagatctcgaacactgatttgaatttctttcctttgaagaaggaaaaacaaatgcatagagtgagaaagctttggtaccaacttaaaattgtcaatgaaacaaaaacctggaatataccatagaaacccatggcctgaagctgcccgggaaagcgtttatctgttttacatcaagcacattcattaaatatgtgcaaagccagaggaaatacaaaatgacaggggtcattaattataaggttgacacgcccatcccttcctcagacttctaaacatagaaggaggaattaaattagtggtgaaggtgtgtttttaaatgagatttttttacgtggagtgttatttggaggagaggacccttaagactgcaggaaatggctgaaaaaaaaccacaaggattactgttgaaaggctaatagtagtctgtttgctttttagaaatacctggaaaacaaaaatgcctgtgtcctgttctacctttaacacctgatggcccttttgccttggctcagtgtaggacagtgtggcccattatcatcccaggaaagaaagcccattgaagttcaccactggggcagccagcctgcaggaagccacactgcctgaagaagtcctaactcaaaactgacatctcaggctgatcacttgaatgacagaaggaaaactttgttgaaggttttctaattacagagatgtggacaagctgattaaaactgggaaggagtggagtgttttgttagtgaatgctccagaaggaaacatggaccctttcagccgcaggagttggagaaaagagcccacattgcaggtgaaactttgaaagagtgtgaactaagccctcctgcagtccaagggacatggtaataagggtattagcagacattgttgcagaacagcgtgagccctctcaaccaacgtgctgttcctggcaccttgactattcaatataacaaacaaaatagagacggggagcaaggcaggggcccagcataaaccatgcttttactaaattactaacttttctggtcaagtggacagatttgattgatgtggttcactgttccaaaactaattagtaaaaggtaagtaatttattcagctaaagtgcatattaaaaataaagcaacgtaactagcatggctccaggaggtccctttccagcactgaacggcatcacccatgaagattcacagcagccattctttttctccttctttaagctgtcattattcttgcaccgaatgatgtctaaatggtgttcatgagtagcatgttgaaatggttgcacgcaagttgtttagaaatgttcccgaggtatcatctgcccccacttgtgtgaatttacatgacttcatcagagctgaattaggctaacatttaagtgttttcattttcacatgattgtaatattccagggaaggaaattagggcccaggcggaccacctgaggtcaggggttcgcgaccagcctggccaacatggtgaaaccccatctctattaaaaatacaaaaattaaccaggtgtggtagcacaggctgaaccataactgtttcagcattgtgtgaactcttagctccaaagtggaatatcttaaccttcaataggaggagaaaattaacttgcaaactctgactttatattgtgcaacagatttgcatattaattcacagattacaaatcttaccaacatcactagcagagtcttgaagctttggttccatagaactgccaatgtcagcttttttatgtaggtcaactttgtcagttaagaagatattaaaataatatatctatcccagtattggaagtcaggagagctgaattcctgtcctgatcagcaactaactcaccatgtgaccttcgtttatttgtttaatctctttaggcctccagtacctaatatatatatataaattttgccataaccacttcatttttttcttaaaatcaattcacttctttttccttatccaggtaaaaggggtactttataaccctaacataaatggaaacccactgtcactagcaatcattagaaggttcgtataaaaacagcatgtgcctggttatcagtaatactttccctcactaccaagttatcctttaagaaataggggctattcttgtattctagacttttcttaaaattgtttttcacatttgaataataaaatactgttttggggccgggtgtggtagctcacgcctgtaatcccagcactctgggaggccgaggtgggcagttcacttgaggtcaggggtttgagaccagcctggccaacatggtgaaaccctgtctctactacacatacaaaaattagctgggtgtggtagtacatgcctgtaatcccagctacttgtgaggctgaggcatgagaatcacttgaacccatgaggcggaggtctcagtgagctgagactgagttattgcatgccagcctgggcaacagagtgagactctgtctcaatcaatcaatcaatacggtaatactgttttggaaaaaacactgccctaaaataatctgaattaatactagtttgtgatgcttttggagataacctgatgaaatcattactataaaagggaagagggtgtcagagaaaattagcatagattcagtcattagtcttggaggttatgaccttataattgtattttaggatgtcactgtgaacagtccttttaaagatcattttaaaaaaacaatatagaaaagtggttatgttgtggagatcacaaatatataaatatatacatgtggaaatgttgatttgctggagagaatgtacaaatagagatttgtttgtggtttgaaataaaatttatagggacagcatcatataggtacaagaagtgttctgccttaaactaacctagataacaagtacaattatgtgctctggaaagctgaaagaattctgaaattatatcttgagtgatgagaaagacacagatcaaagatgcctacagaaaatataaaattaagttgcttaacataaatgtgggtggtaaaaatatacaatatagctaaatcaatgtgcctagtataacatctcattttaggtattttataaatttagtagtttgattctttcaccgcgatccctaaatgcttacatgttccatttggccaaaagaaaaaagtagatctcgctgaaaaaagtgtagattattctggcttgccttaggctcaggcttctccctataagctgcatgtgtacaatgaaataaatgaaacaattgctataaaaaaaatctagcaagataccaactgtgagcctgaggctgcttcctctttcttaaatgacaaattagcaccaagacaattttctctctgaggtcatcagaaggactgaaactttctcactacgtgagtttctgtccattgacttccttaggaatcttgcatgccatcagcagagtgggagtcagttcaaggggacccccataagggatctatctgtagcatccattccagcataaacatttagtgattctaagaagcacaaagcagccccatcgtcaaaggacatgactcagatttcataggctagggtgtttaatctgttgctttctcatactactggctgaagtctggcaagattatttcgccagtaccatgtaccacctttcatttgtcctctcacgaaaagcctgggccagccaggctttcatccccactacctgtctcctctctgttcacctgttcttgtcccatttaaacatttatagtccaagataacagagcagacaacctgcgtgaggagaagaattggctgagtgtgcatgagccgctgcaagcctgtcagctacctggctccgggcggcctttcccatgacagctttacggccgacactaaagaagaatcaatatgagggcaaggggttgacatttcattttctaaaaagtgatccattgaggaccaatcaccaagcactgtttatcagccttgggaagtgacattttttttttaatgggggagaagggacaggaatcatcgctaggtaactcgacaggctcaattctctaaggtggggactcataattggaaatccgatgcatcctgctatcaatcctgccttatataataaagtgatcaataaaagcagagaggaaattaagtcatcaagcttaaggatgctattttccgtagtcacggcttttaataaacttgtctccccgcattacattttcatgtgtttttcctttcttttcatcaaagccaatgttttaagcagaacatccaaaggaaacttacaatgaggtaacttatttctcattactccagtttgactgctgtatttagggccacttataccaaaaaacaaaaaagcaaagtaaatctaaagcaaagctggactacaactagagaatgtttccagtcaagtcaaagagatggtcaagacacaaggcaaggcctactttctgcagagaagtgctctgagcatcctagggtgctgaatttttatcaaatatttttagaggtggaggtatttcatgaattgtatctgtttttaaacctttaaacatctttattttctaacaaccaagattatttctgtatactgtgaacatttcagacatagaaatatgtaattataaaatcaaaaaagcacatataattcctatacactcccccacatgctccttgcttcccaccatcagatggatattacagttcccggtggttatatgcacagcatgcgtacatatacaaaactaaatggcaatgtacaagaaagagggccatcttgattggctttcaaaatcaaataccagggaaggaaagaacagtgggaattcaaaatctatgcaggtcaaccttaagtttccaaaggttgagatattctgctgtttagaatatagagggcatgccaatgtctatatgtttttgtatgtgtgtgtattaaagaaacagaaatgagaatttattgtggatttaacatctcaagatttgactcatcactctaatcaaacatacctattcatagattgtgcatgaaaagcaatgaacacggtgtaaaacagatgcctgtacagaacgtgtttttctatactgtgttatgttagagtgaacataattggtccctgtataccaggacactttagagagtgaggatgggagcatgatattaagaaatacatggccggacatggtggctcatgcctgtaatcccagcactttgggaggccgaggcaggcggatcacttgaggtcaggagtttgagaccagcctggccaacatggtgaaaccgtgtctctactaaaaatacaaaaattagctgccaggtgtggtggcgtgtgcctgtaatcccagctactcaggagggtgagacaggagaattgcttgaacccaggaggcagacgttgtagtgacccgagatcatgccactgtacttccagcctgggcgacagagcaagactccgtctcagaaaaaaattaataaattaaataaatacatgtaccaactgggaccatccaggcaaactagattatatggtcaccactctaattataatgtatatcagaggaaagtaaaagcatagtggcttgcccaggccagtggaaatagccaaaggcattgctatgacattggtgagatcatcagtaggcagagagggacaatgcaacagacactggcctgagggccaagcacagctactggtggggccagaagcagctcagcctaccactatggcaatgcgacaaacttgggcaagaattacttctttcctaggactacttccctcttctagagaatgaaaagctttacatttaagaggatccttttgacatccccaggcttagccctttttttcaccaacagccccatcttgtgaaacagttgatggtatatggggatgccgatcagggaagaggcagattcttacacatcaaagacaaagaaggcccagatgtggggcacatatcaatgactactcctctggagcctctgggcagacgatgggagtgagtaaatggagacaaaaacagtaagaaaaactggttcaaaagaagatgctgccaatctgttgttatttctctctcctttttaggttattttttaagtatcaagtcagattgtaagtacttagaggataagggctcagatgtttcaggttcatttccaagacaatgccatgcccgagatttgctcaagggataatctctagaaatcccttgattgtctggaaatgctgatggcttttcctgggggaagactgagtgtgaagtacccatttctttgctttagtgaccattactgttaaccaaaatcatgctgaagcacctcctgtgtgctgtattatctattttgtgtatcaaaattctcctgtcaataaccctttgaggcagataataattatctctattttacagaatagaaataaagactcaaaaaggtttatgtagtagtagctggcaaatggcagagctcaaaattggggcccaagttttatagggctttttcttgcctttggcagtgagtccaggcttaagagagggataaacgtaacacctggcagcttaaagcatctagaaatctcccactggcttgctcttcagctttgtttcctacaattagctgggtccttccggacctctcagcctgccaccagggtacagctagcagctttggtaggggtgtgggaagatcaaagcaacaaggaggaaacttgggatgcagatgccaagtttatgacgcaatcaaaagccttagctttgtgtggaagagaaaaaaaccatcataaacactgggaaggtcgggggctgcacagtgagtggcttcagtgcttacctccggctgatgacaaaagctgcaatgagaattaccaccagcaccacactgcccgagacagagaccagaaggactgtggagttagccccatctccaatgatccgggaaggcactgggaatgacaattgcataagggtcacctttgggaaagtcttaggaggtagaacttctgaatgggtcacagttttcagtgttctgaagccacttggagagagaaagacacttgaacatttcagaaagggcagcagttttgaatgtacctccttccccgagagctatcaaaaacctgcctatttttgcctagttcaaaagccacttcctccttgtacccttgctggataatttcaaaggatgtcaatccccttcagattcaactctactttctcttctgcttttccttttattcttatttaataatttgtgaacaaaatttctttcttgaagtcaaaaatctatcatctttttatcaaacatgcccaatttgggttcattgattaccgggatggaggtatctgacactaatgcttgttcatgggtagacccctcttaagcactttaaatttagtcaaccagtcaatccaactcgcaatgcttaaagatttgatatgtttgtccaaagggtctttaaaaaaaaaaaaaagcttatgtaacttgatttaaatgattcttaaaaataagtaggtaaaaaatatttttggcgccttctttaatcttctcagggagaaaattccctatattaatgtagggtagctatgtaaccctcaatttgtcagtttagtaatcccatttttcatgctttctagaaggctcaaaacaagagaaaaataggcaacatttttcattcataggaaaagacaaatcagtatttcgaaaatgcttttctctaaatcacatgaagttttctaagttacagacattggctaacttatttcaagacatattcattgcagcaaaatgtctgctgaaccaaaaattacagacaactccttagatttcactgtaatgggattcagctgtattataaaaatagcctcagaagtgactgagtctgggtggtccttgttacctgtgttggttgtaacctccaagggctcactgaagtctccatagccagctgctgtcctggctcgcacgtggaaaacataggaagtgagagggttcaggcctttgatatctgtgttcctggcagctgtccgaactatacgatagcttcgctcattctgatcctacatcatggcaagataaaattggggaaggtggcaaaataaatctcctgcttacttactaggtgcaatattaaaggagtcaagccagtcaactcagaaactgaaagtaaatggagatgaataaactctctggagcctgtattctcttggatgttataagtactattgttacttcttacttgttgaaagaaatgcaaattcaggtatgattgttattgacgctgaccatatccagatctttcctcctactctttttttttgaaaggaacattaaatgatggttggtggcttttctagttccacacccagcaatttaaaagaaataactgtgagaaggtcccttatctttttctattttctgtctagaaaatgtaaaatgtgttgtaacatggtttcaatgggaaaatcctgtcccttttctacttttaataaggaagccaataagtgattatctttaaaaagaaaaagaagacaactgttcattttctagacaaccttgaatgcaaatagctctcttcaaaattctgtcctgtaagagagacaagttatttgtaaaaataatgcctttctataactttaagaggctgaagaatgtgattttccttccctgactttctattaaaagtcatcaaaacccacatctttattctgaatagcagtgatctacttaaacagatcattatttcaactgttatgagtcactctccctgatagaaggttcatagattagaacttcttagctatcttgatttccattactagaaagtaaagatatagttatattacaatacaatgtattatcattattgttattttctacttttcaggataactaagtaaatgataaatttcataatcatacttaattgggaagcaaaatgcatttgatttgaggattcactggtattccatgacttacaactggctaacccttaaacagaagggagggagcaaaggaggatgggaaggagtcgaggaaagaaggaagaaaagaagagagggagggagggagggaaggagaaaggaaagaagaaaacaaagaaggaaggaaggaaggaagaaaggaaaggagtgttgttcactcaagtaataccttctcataatacttgacttcatattccaggattaccccattgggccgatctggttccagccaagccagtgccacactgtatcttgtgacttctttagcctggaccaaagcaatggatgatggtgctgttagaaaaaaacaaaagacaaaagatattttctttaggaaaataaatggttttggtggtagccagaaataatttcatcttatttaagaaaagtgtgaaagattgtcttgtctcccccttgaccattttactcttcagtatagaagcatatcattttcatccttctctccagtatatttttgcatgtgtttgtcttaaaaagagaatctctgaagtaaaagcctagtgggctcacaggcctgtagtaccatttccacagcacgtagagacatttctcataaaaggctgtaggtacagagaaggctgtctggtttttaaccttttgtaagccataacagcctttggaagacctcattttaagctcagtaaagctacatctaatcctacctcccagtattatgagtgccatcttactggactttaatttcatgcaagcaagagaatgtacaagtcttcaataagtactgtagggaatgccaaaagggaaacaatttacatactttccaatataaataaaagtactgcttaatcacagtaagagttcagtctgaacacaaccatgtaaatagtgaatacaaatcaagcagtgctggtctctctgaacatgcgtggcattttgcagctattttacaagagctgacatgttgcctttgcctgctctttccactgcgaaggacacaaaggcagccctctagtgggtgtgttatgggggtggaaggagggcacactttagatttatacacccaggctgcccgatgctcacttctccgctgcagtggtcgcatctccagccagctgttatcaggctctgctgacactgacaatggctggtacccatgcacaatctccagggagaagagaaagcattcatgaaatccttaatcttatctaacaaagctgccctggagaaccagagattagggagcttcctaactccaatgtatatattcttttattcccaaactggggaaacaaatgtcaaaaactggccactgaggaaggataaattagtgctgggtcatcctcctgcccttttgcaatacatgcgtatgaatgccaacccctaactccaaggaacaaagataaaaagtgaaatacattgtcactgaaaatggtatgggaaaagcttcaaacctgcttgaccatgtctgacgagtatactgatggcagggaagccaagcagacacaccatagtcacacaagggagtcttccagctaaatccagtacggtagagactgtctcctggagggggttatttgacagcccagcatctctgttagggatggtaacaggcgcacacacacacacacacacacccctctatttttttttcctctctctcagtcccaaagctattccagattggatctcaggcaaaaacacaagggaaagatacagtagatacacatgtcctccatcaaaggcaatcccaaggttagtaataccaaccccagtgaacaaagctgcatgcggcagacatatggaagccactgaacatctgaggaaaatgaaaaacggaaatgtgctcattacattcattaaggcccccttctcccaacacacacacaggcacacacacacatacacacacactcacatttactctttctttcctggttgacacaaagccattgtccaacaaaatgcaaaaagtgactttgtaaaatatagaggtagcaaggaggctaagaaaactgcctggctgtggaaagtcatttcactccaggtaataaatatattgcctaacagaccacttagcatacactccataaaaaggagctctttaaattctgatgttcaggattgagaaatgaaacagaaaagtgaggtcattagaaagaaagcaggagggagaaaaatcataaaattataaaatgaactttctctcggaaatggtcttggtcagatcctgataatcgacagattccttgagaaagaattgcctgcctgcccttggagtgcactgatgaactaagacagcttctctctggttgggttatcattaaactgctgcatatgggaaatgagcttgatttctattttagaagtttgagtagctgtgttcctgtgaccatttaaagggaatatgaactcaactaaggtgctcaaaaaatctcaagcagggagttagcaatataatcacgttaactcatagagtatttctaatgcagccctacttgggaagctgatatgcataaatgtgaaaataaaccaacagagtgtaccttgacacagctgtcataaaaatggagaataaggagagactgaaagagaaatgcaagcaagaacgaaggattaaatgaaaatagaatgctaggctgaggacagtcagaaaactgctgagttgacatttgtctttcatacctactggagagatcaattcaaccaaggaaaagtagaatacatagatctaattcacaaaaagtattgtgttgtatggctgcaaagtctaaattctttattgatcagatgttcttcagaagagcatgttatcagggcacaatgacacaagcaatccatgaccaagtgaggttgggaaatgtacctaaaacatacaactgcattgtatgtggagagcttaccttctctagtaagaaggagtttgagaaaatctgggctttgccatactgccactttggaaaggaggcaacctggatgttctccacatcataagccacatatgggcttttccctcaccctttctaccccatttccaaaacagccttcaactttacatctagaaggcatcaccctactgtgtgtgcctgcctatgggtcatttccctagatgaggcatttgccaatgacattttgcaattttccccctaccgcagtgtttcccaagcatcagacttccatgccacacatttgctgccacatccctctgcagcttgtaagatgatttaagtaatattttctttaataaatgcagtatctttaacttcaacagttgtatttgaaagaaatttcccatttactggtatcaatgaaaccctataattacttgaaattaaatgaacattgcatgtaaataaaacaatgttatcaatgtttgctggacactcttacttctccaaggattgttaaaaatggagattagccagtgctagagaaacaaaggatatatgggcacccgcttgagattctgaccttggagtactcagaattactgagaaagaattgaaaatgaactatactgtacacagggcaattcaatattacataatatctcatcggtgtgttccctaaaatcatctctgatgccaccattggtatgtttccacactttggtaaacaatgcctaacccaaatgtcttgaatcctgatttgcaatattccagggctctgccttttgcttacagaattagaagaggagataatagaatttttttaaaaagattgtacatcccacccttaaatatatggttcaataagagctctgaccaatcaatgcctaagttcaaaagagagtttctaatcatagtagaaaatttggtcagcataaaaagaccaagtggaaaaaaagattctcagtggctgctcagttctttgatttacattctgaaatctcatagagacaaggttcttcctcaacatcaactcggccactagacacatacttaatgagcacctatggaacaaggccgagagggggaatgggtaagcatggccagatagaaaataattgttggtatcagactaagtaccaccaaatactttagcctcttcttaactaaaagaactattgggaaatttttatagtagtcttaaagaaaaaacactttctaatgtcaagtcagagggcccatttttctagaatttaagaggagacgattcctactgcccctcttctaattcaagttctctcatgggtgatggggaggagtaagtagagggcactttctcacacattctatctgtagacactcaatacacctgctgagtgtcagaagcaaagccaggaagaagctggggggctgatgaacacattcttttttttttttttttacattcttactacaagaaagagatgcatcatagattgaaaagcattcctatctacccacggacttctttcatagaggagatacttgttttaaggacagttttgtgcctccagacaaatgcaggcattctttaatggctagaattcagacatgacacatagcaatgagagctggtcatgctagttgacagtagcatggttaaagaaagatgactatgtaaaaatcataaggcaagcactcctaaagggtagctctttaaaaaagatgtgtgatttaattcaatggagtccttaattttcaaacctttacagcaaaatctccaatgactcatagatgtcaattttcctggtctaaggtgcctatccccgagaccatcattttttattacccctaaggagatttcagcagtttttaacccaaaacttgtctctcatttcttcttctttttaacctacaaatcatggtgacacatgcattcagtggtgctcaataattatgtcaaatgaataaaagtttttacatattaaaatttatctaaaaaatctttactgtagatatcaaacattttctaaacataaagtaccagaagtaagccatccttaaaacaactttccatctgcacctgtttcaaaggaccttttgtggggttggttttactatttaggttaactgagatattgacaattggggtgaagcaaatgacaactctaattataaatggagtctctgtttctaaggtctgtgtgatgcttctgaacatttttcaaacacaggctgtaaaatgtcattcaaatgtaagttaacattaaaactaggcatcactgcacctgttacagacagcattttgagcttctgctctttaggctgatgaaggtgttgacaatttgctctgcatttctcctctgtatctgtagggcatatgcaaatagttctcctgacttcttaactgccaaggtggagtgatggtgagactcccaagtcataatgataaatccagaaaggatcctaagcctccaaagatggactagggcaaagccagtcactgccagcagaagccattagttactacatatgcaacagccaccaatggacataaacttgaaacatgggggtaatagggtggagagccctttgcagtcatagtgtgggcgagcagcattattaggaacagactctgtttttccacataccaaatggacacaagtgaaattgtagcaaaataccatttttaaaaaacgatgaagcaaaaaccaaaagaggaggaaaggaaaaaattcaccaaagctttccagttgaatgatctgagctttccaatagaggtccaagataaatttcactcccaaagaatgttgtattcccagttctacaaatccctgagaaactgagaatgctttcgaaatagaatccccatttgctatgtacctgtggttacatttggtttgagagcagaccacaatgcactgagaaggtacatgtgggttttctctctgtgtgtgtttttgataaacagaaacagcacagattagggggctctatcatgactctctaacagtggtgcatttcacaaggagaaattacaggagatgctttgatgtcaaacagaggtggctccctttaagaaaatggtaaatttaactttctttggttcaaagctcagcagttctccttgctccccactgacgtgaatgctgcaattttcttttattcacttcctcaatgacttgccattaaacacctacaagtcattttactgcagcagtttggtccttgtgacacccaaatgggatggagaagagaagaggagatacggagaaaagaaagagaggaaagcttcacatggttcctgagctagaaaattgttttcttgagtccagtatcacaagcagtgaattaaaaacagtttggggggaactttggaggaaaaagaaaacagctgaagtaggctgactgcatttcattactggttcaaattagagggtggaggaggtgagctaggaaataaacagatgcaatgaaaggtctccagcctgtgggcaaggaggagtgaaaacagccctttatgaaagtcaagacacctgaagccatggatgtcagtggtacacaatggccagtgtttgcaggagagatggcttcttaaccacagcagggttacctttcccctccccaggatctggatttaaacagatgatatttactcaaggggtctttcattgatagaaaaatataaacccaccatttatacatatctctgcttaatgcaaatagcatatttaaatttaattacttggagcttaaggtggtttttgttcccatttctttctcaattcaataccccagctctgatttgcttcttatcaaaggtttgtgcattttaaaatgctgtcaagcatcagaattaaatgcttcagagcactaatgatatccttgtgattaagggtttcgcgtctctgagatgctaagagctctggtgctaatattaattgttttcttctacattccagatggagagaaggattcctcctctcaagctaggcaatacctatggcatcaaacatcacttagcaatatttatacgtcctttttcttactatcatcattacagtattttatagtacaagagtttataaagtgctttcacatacacatgattttgtttgcggtacattcgaccagccaggtcaactcctctgccatcttttaggtaaaatcattaaaatccccaaccaccctcgctggactcatcatcaaagtaaaaagtcagctccacccccaacagcttttagttgctacatcatgcatccacacaagcacagtttctcatagtcaaaaagtgaaactttttaaaacaaaccggcaaaaggtacagaaaaacaacttgattattctgaaattgacattgatttttctccttatttgacacaaaaacatagaaccaaattctcagccaaaatcttcagaagactgtgaattaaatgaagttcatttatatttagatatgtaagtattcatatttattaagcttaaatttagaatgtatgagagatgcattttttttttccataaagtgatttccaaggtcagaccagagtctattttaaacacatactataaaataaagcagtgcacagccacattatccttcagcaatatttactgaaggatacaattgactcatgctgccaatgattttaagagtctgattttggaacactataaatacttgaactaaatgattccagagtaagactttgcaaagtctgtgatttggtttttacttttggtttaatagaagacgaaaattttataagccttttttatttcccagatagatgggagggcacgtcattttctttatgccagagagatgggcaacggattattttcaacaaatcctttacagagagctattggttaaattttaaatgatagaatgtgatgctattcttagccttcacgttaattgtttgcatagggaagttgaaggtgttgggttggcctctttggctaaggcatccaaaactgtgagatcccttcccttctagatagagctgcccagccaaagactaccttcctagattcctttgtatctacggtagttcatgtgactgagttttgggtaatggaatgtgggttgaagtgatttcccctcttctagatctggcccataaatagctccctgtgactctccattttcttgaacccacaagccagagggaggttaatgacccaggcccatcttggaagccccacacccaacaacccccatcaccaccaactggatgcgatttcagcaagaaaataaatttctattgcaataacccattgaactggcatttggggttaaaacaggtactcattcaagtgaagtggagccttctggcaaaaaagaggtatttgcatatcacaactaactcagataaactgtagaagtactgtggcccacagaagattggtctgtggttttgcagcttcctgaaaggcctttgggttccctcccggaaactccagctggtcatgcacgatgagcagatatccacccatttgtgagaaactggaatgcgctgccctgaggtcagcaaagccagtgacagaggccgcgtggcttcccacggacaaaatcacggccacaatcacggccactagtcttctaacagtgaatgaaatcggcagaatcgcaaaacactgagccaaaagattcagctgatcttatgctaatgctaaatgggaaaacacattggggttctcaaaatggtttggttgagttttctttgtagaaaagagttaatttagttttcactgaattattaactgcttaagcagatgaaaactgaggccctgtgaattgccacaaaacaaagaatggggaaaggagcaaatcagatgccagtaaactcctgggcaaggcacttgcacatacacgcacacctgacatcatttcatccctataactctctgaagtagttataatgatcacccttacatttcagacttggaaactcaggtacaaagaaattaaataatttgaccaaagccataaaatgagatttaaaactcaagtccacctggctcaaaagtatgtgatcctccctctatgccacatgtctgtaacaacatacacacgaaactagcatttattgagtaattatgatgtgctgagcattgttctaaatctcttgcaggacttaattcatgtaaacctcacaaaaactctatgagacaggtactattattatcctcatttttatagatcaagaagataaggtacagagagtttgaataacttgctccaagttatagcttatatgtggtcataattcaaaaatctggtcctagagccctcattctcaaccactgatctacagaaagcggctgatctctgcccctcctttccatggtaagaaataggagacttgaaggtttaagtgactgttttcccacagcagtagcggcagcagcaacaacgtaaatctttctaaagtctgctctgttaggtacaggggtatctgtgtacattgtcggctgtcagaaacccaggggtaagttcgatatgatccctgctcacagacaaaccttaaaacttttggtgcagaatgaactcacatttgaactaatctaaagagctaagacaagaataaaacaaaacaaattcaattaccaaataaaataattagtctttggaattagagaaggggtaaggatacaagacaagcctctggaagactggcaatgttctattgttctgttccttggcctgggtgacggtcacataggtgtttactttgctataattcaatgactatacattcgaatcttgcccacttttccatacgtgtatatttcacaataaaaaggttataaaacaaacacaaatgttaggagtattaaaaaggaagtatcatacttattactagaaagatccaaacacaatatttagtatacctcctgggttaagccctaaagatgtcatgaaagatgtaaggttttgcaaattagagcttttgcaactttttaatcattatactgaaacatacagcaatccttactctttgtagtaaataaaatgcattactttaatgtctgttttacaagttagctagtatcttgaattagcattattacaggtacagtcataggatcggttataaaattataagtgggtaacagctcaactggaaaccaaggcccatgtccaccagaattagcagggaactaacctcaggggcacccaagtgtctttgctgcagttcaagtgtgtcctgtgtttcgtctgggagctgcttgttttactttctacttgcttactaagaaatttgttggcaggttctgacaaggatagctcaacacttgccaacagaaacatggcaggattcaatgtgtgtgtttcctgttataagtaagaatgccagtttgaggcaaacaggaaaacaagtctttccactggaaggcagtttagaagaatttgcctgagcaagatgattgttttaaggtaagaaaatggggtgaaactagcaacaacaacaaaaaataaatatacatttttttctctgaatgcttctagtgagatgaatcttctcactgggcctaaaagtagtgttgacagttatctagtgtttccactcttagttgaaattattttatgtgtaacttggttagacaggatggtgaaccttcaccaaatgggggtctccatgacctacaatgccctccaatcacttcctagggaagatcagaggaaaaaaaaaaggccccccaaaattattttttaaacaaataaccaacaaaaaaaatgctctccaaaattaatttggaatatggagaacaatgtaaggaaaaggttcatttttactgagcagaatacagaaaagagaaaggaaaggattagctgctatgcatcaaggcttctattccttttgctgttaactccaccagggagcttcaagcattccaaatctggaaaataaaaagctaagcttgtaggcttcaggttctctttgttactcagacagctgctaatcgtcctgctgtgttaggaacccatgagacaatgctgtaacatttagctttctgacgtccaaagcatctagatcagtccccaattaaacaggtattaatcacaaagactctaaaagccagggtgatagatgcacccagtaaatctttgctgttgcctttacttttcacactcagatttctacatttacaggcagaaatacttaaaagcctgctccagaaacttgaccaatcaaaagccttgttcattactttatatcagatgcttgatgatttcctacctctgaaaagcctttcagaaagaggtaagacattgatcattccgctaaaagagcctgtctgcttcaataaatagatccactatggttgttgtcatcttgactttttaagtgtgataactaattcagaagtgttgtggctttgccacttgctatagggaaatccaaatcatctgtgaagttaaagaaaaagtcagtggatgaacccagaaaacatcaatgggcaaaacattaatatactagtaatactaacgatctcttccaacaggggccaaatcatcttcaggtcatgaacctgattagagtgaatgaatgaagtgaggtatattaatccagataatagaaaagagtatgtgttggatgaatccttctgaattccatgttttgaaatttatgttgataaaaggtactcagtgttacattttcatcaatttccatttcacaagggcatgaagatagccttatttaactctgtcaaagagtatcatttacagcttttgttataaacaagtgactaggtaatcaacctccaaacacacaaacaaatgaaaagtaataattttcatagccaatatctaatcactataatacacaatgaagagaaaagcaccaacacgagaggctcatatgacctcagaggaaaccaacattagctattctgagttattagaaatccttttaaattagatttctattttttatttctcaaactaacagaacccatgagacaagtacaatatttgcaaggtgccagctcaaggggctgaattccttggctttcaatggagcctgaatatattataaattactccgtcttcatcactatctcagtgatggtccactgtcttccaagttgaaagagttgggagtcaataaacgtcacttatgatatgagcacctgtcgactaagacctggactgagaccaattccattaacatagtcattctacggctgccaaatggccgggccttggaccacttatgatatagtccccattcaaggaggtgacctaaagacagaaaggtccagaatcccattagtcatcttccaagccatccaattctccatcagatatactgttggaatgggatacctagttttttaatcgtcatttaaaaagatcacgtgagctgctccaaaacatgtcatggtgaccataaattgaagatagatgctctttagcattgttaccagccactgtcctttagatctatgaaattattttttagcaacttctatttctttctcttgttgcacttaaaacacacaggcagaacagaggaaaaaatgacacatattgacaaagtataaattatagcatgaaatcataggctaccaatgattcctgacaaggccagagagtcagaggaaacatggtggtaaaaattcagttgtaaatcaatgtgttctgtgctatttggaatttttccaagtccaagtgttgcttggcttaaagcacaatgtctaaggactgagaagtgatgatcacggacagtataaactagaatgttacaaataggggagagagacagagagagaaagggcgggggggagagagagagagagagagagaaacaggaagaaggccattggggtgaagttctgagactcctcatgtttcttattgccagtttggttctactggatggaagtctagggaagttccaaacacaggggatcaaaatattctgaggacaatattcatgacccatagaatgctgagaaggtgggttttagtatcactttagggaacctctgcttttccctaaagtatcactttagggaacctctgcttttccctaaagtatcactttagggaacctgcttttccctaaagtatcactttagggaaccttttttataaagaagaaatctttcctgccctgtttcttgcttgctatgtagacaagtgtaaggaagcacctggtgagtggaaagaagtgggatagagacctttgggttaaattacagtcagaacattttgagaatgcatcttacacaaatggtcaccacatgctacgctctctgaaaatgtggccatgcaattatgttcttgcagacctcatatttgaaaatctgtctttttgacaattttctcaaaagctatggtacaggttaggaacaggataatcatttaggagaagaggttttaagcttggaaatctgtaaccctagaattgtatttttattttattttttatttttagagtatcagctagaaactaagttctatgtgctagatagtttaaatttctataggcattataagaatggggcagaaacaactgagctattaaattttaaaatgttattaaggtcagtagatatcttcaactggatctgtgtttgagaattgagaattgagatgacttttgtagtcataagaaataataaagaatgtattacgaaagctattactgttttaggacttgttttttgtttttgtttttatttttttaaaaaaaggaagaaagaaagaaaaccagggggttcacagcatgtcacaggggcctctctcatgaactcaatttgctgaagtgtgaaattcagcataactggctccacccaaagaagtcagtatttagtccattcctaaatactggaggagtttattagaattgcatcttacctagaaatagttccacagcatgatatctaagaaagacactggaggaaagctcctgcacactatggaggaagttattggaagttaatggaaattatttttgtgttttctgaaataggtagaggaaaaagaagtggagggaaagagaaaatgctaccctccaacaaacacgtacagttaaggtgaatccttgaagagtttacagtgagatagaaagggctctcattgatatttctccccaaacaatacatctttacataatataagggtttcttaaatatattaccagccccttggagccgcacctgaattagttgactgttctgtattggagtgtacaatgaaggctgtaaacacagtgtatgcttcttaaattttctgtccactgttcatggctacaaaaggatactttcagagggggtaaggctctgctagttgttctccttgcttctaatataaaacaaaacaataagaacctttatcacaaaccttaataataaccctactcctactgtaaatggagagaaatgagatgatgttagctccaaggatttccaagtctcctaagaagtttcctaaaaccacaccctcctgggaaccctataggattgggattagattcattgggtttcaacatgagcctcatcaataattttcagataaaataaaagtctttggttatcttatttctttatctttagataaaaagaagtctttaattacacttgagagtatagagaacacttgatcaagctttctgctggttacatattaaaaatccctggcttgtttatatgtgtggtcctagctttgaaaaagaaacatgaacgaaactgtgctcctatttaacttcaggtttatgctcaaaatacgcacttattttacaaaaaaaaaaaaaaaaaaattagggttgattcaagaggcagatttccagcttgcagtatgttatctagaaaaacacaaattctccagggagccgttgtaagctacccccttttcagtgtttgtgctaatggatggatcttacccaagcttggaacacactgtgagtctattggtggcaggtcactatttagcacccactgagaagttgaagctacatatttaagtcttgtttgtatgcacatgtcacagacaaaaggttcctagacaagaatttttaaaaaacttatctgtcccacagcctttattaaaaggatttttttgaaagtgataaacaaactgcctgaaaaaattgtgtactggaagatatgaatcaaaaagggatggaccatagttctttatcttttctccccttgcccctcccaagagtaacagcaagaatagaatagtaatagaaaaaatatttcgtgtctctataattttacacataaagtattttagatagatttcagggagtggtccctgtactttttcataacaaaacaaaacccaaaagatggtcagaggagaaccacagtacagttcgtttagatcaggcctaccaatttgtcagaatagagaaagaagaaatggaatctaagagtgatttcttcaactctgtgtctatataggcggacattttgatgaccattcagccagattcccacagtgctctgggtgccagccctcacctatggaaccaatcattagtgacatttcccaatgaggaagccaaggggttcactaggcaagcgaccacactgactggcaccatctctcgtttttatcattgccgtttcaggggagcctggggaacctctttcatttctaattttggcagaagcaaagaatgagaaagcatgagtacaggttgtgggggtggcgggtggaaaggtggacaccagaagaaggttcattaaataagagagatatttttaatactgacagatagaccaaaggtttgcttatcttgacagattaacatgtaaaccctaaaaaacatcctcaccagtctttacctgaagaaaatatacaggataccctcttattgtatacccacatcacaaaaatgccacagggatgttgagactcagaagaattctctatgtatttgagtgacatggacaggcatttcaattagtccctgtagatttaagatctcttaatgcaagataagtcctgtgcatggcttttgggttttcaaggtgtttaaaggaaaaaaaaaaaaaaaaaaaaaactatttaaagacatcagcagggggttaatggaagctttgataaagtttctctggatcttttcattgatgttcaattgcagactggtttctggagacccatctggctcctctggggagacagtaattaattgagccagttggagtgacaactagataatttagaagcccattggaaacccttgctagccctgccctgcccatttctcatctcagccaggcacttattttttaaatctcttgatggcttctccagagggtgtaaaagttggtggttagtgttcgatggaacaagcacaacactgagagatgagaaacaaaccagaattaggctgtcaagtgattactggtgaatgaatttctcttcttacaaatgaacatgcatatatctttctgtaggagcaaaaggaaaggactcaggaaaaatagtgttctcagtcctgggtgtataaataaagacttcattttcttagagtggaatattcacatcttttttaaaaaaatgcaatctaacttttgcttatatgcaataattaccactacgttctatagacatactatttgtctgtgctattcagtcaaccttgaaaagttggataatttagtaggctcttttggcaggcttttatttttttttctcctcaccaggacttgtggcacccaccccgaatacaaattcacagacactggtgccacacacaagaggctgcgccattgtatatctgctggtttattttatttttaattacgatcataattagtgagtatgcttattaattatagtggtagcaacagtattctggaaatgaaattcttctcagtataaggttagaatcaagagactgtttcttaaaaaaaaaaaaaaaagtaccgcatgttgtttttaaatgtgcatttcataggccttatgaagtaaaccaggatcccatggctagaccagagctattaatgagaaaaccacagcctggctcctctgaagctcattgtgtgcttgcttgggcctataattaccaggcacagaaaggactctccaaccagctaccgattccctactaacaactgaggatgcgcaaacaacgtttcagcaaaatctctcagtggaattgctttgttgtctgtttgaaggattttaaaatgaatctctagaaggagttcttcattttctcgatttcactagtaccatcatttgtttttcctttaaatttcttaggggtaaggaaaaataacacgatttactggagatcaaaggcaagcatgacatcatctcggagagaagataaggcacaggagcagagcatagaattattattattttgagatcgagtctcactctgtcatccaggctagaatgcagtggcaagatcttggctcactgcagcctccacctcctgggttcaagcaattctcgtgtgcctcagtctcctgagtagctgggattacaggcgtgcaccacaacacccgtctaattttggtatttttagtagagatgggtttttgccatgttgggtaggctggtcttgaactcttgggctcaagtgatccactcgccctagcctcccaaagtactgggattacaggcgtgagccgctgcaccaggctaacatagaattatttaaaaagaaaattgctgtcagcaactataggacctaggcaatagtgtgaagaatgcatactttaaagagaaccagaatatcagtgaagcatgtctcacataatccatttaaatctgagtgccaatgggaaaaaatttgtggttcaagaaagcaaagttatgactgaaatcctaattattttagttaattttttttctgagtcaaaacctttacaaaataaggtgtcttgaagattgtttcaaatgtgagatttacctaaatgttacccatcacatcctttgccaaaacaatattccacaaatgataccagtatttcaatagcttctcaaccttgttcttactggtctcctttcttgatttagtactccagagcagatcagcaaacattttgtgtcagcagtgagatagtgcccatgttcgctttgccggacatttgccctctgttgcagctactcaactatgccattgtcacgtgaaaacactcttacacaatatataaacacatgagtgggaatttgttccagtaaaactttatttatgaatgccaatacttgaattttatataatttccaaatgtcacaaaatattattctgttttttattatgttgaacccattagaaatataaaagccaatattcgtgggttgtcccaatctggaggattcgatttggcccttgggccatagcttgctgacccctgctttagggcactaaaggaagcaaacatttgtgtcttaaaaatatcatcatttggccaggtgaggtggctcacacctgtaatcccagaactttgggaggctgaagcagatggatgcacttgaggccaggtatttgagaccagcctgggcaacatggaaaaccccatctctactaaaaaatagaaaacttagctggatgtggtggcgcccgcctgtaatcccagctactcaggaagctgaggcatgagaatcgctggaacctgggaggcagtggttgcatgaaccgagatcacatcatctcatttaggtttagtattccaaaacaattctcagaatcagcaggaatgtgctttctgcttgtccctttgatctcagaccacaactcaggtccactccagaggtgcccctcatacctaactgtgggccagaaccactcactgtcacaacctgtctttcaacaccttcatttcaggccaaactggacttcccaacatctcatctttctcccttgtcctttctgtttttagggatgattatgcaatagtcttgttgtctgacaattgcatttatctcaacatagtcagaggcagatttttatttaccgaagctaaagaagtttgtatggaccctttctgaagctctgttactagtctgacatttgtaattttgtagggttttatgttttcacccttaatcacacaatagttgtttaagctttaaactccacaaagtctggctctgccatgcctacagcatattacctaaattgattgctgtaagattttcccctttctcccaccattttcttgaagctttcctcttactatctagaagacaggtagcaattatacccagtggggatgagaattcccactgttctccattatcccactcaaataacataatatgtctaattaaaagatggcagagagagaaagaatgggaacttaccagttgaataataaaagacagtgtgcctcttacacttagttatttcttttctttattcattattttggttttattaaatttatcattacttgacaaagagagttaactgatttgattttactgtaaataaatgttaatcaacaaacagatggaactgtacaatgactacatgtggcacagtggcattataatgaggtgtaatgccactttattttattattattattattattattattattttgcagttaatgcttaattgtccaaccctagagaacaaggtcagcctaacaagcagcgcccgttcatctgatggcaaaacagctacaacaggattcatgaggggccttgaaaggccctttacaactgcctgttctctgagaacagtaacgggagcatcatgctttcagcatggggcaatggagccagagaaatgtggaatcttccctatgtgttcagccacaggccagctcaagcaaaggccacatggctatggaaccctgaaatggtgggcactgctatgaagtctgttcttaaaaactattgctagaacagagtttttcagccttagccctatggacattttggaccagaaaattcttcattgcggaggattggggatgctgtgttgtgaattataagatgtttatcagcctgcctggcttctacccactagatgcaactgcaccaaaaattgcctctaaacattgcccattaggggtaggagcagaaatcacccccaatttagaacaactgttcactatcttactgttttccccccgcaacgtaaatcccttggcaaggcaaggaattagagagaaggagggcaggcagaattcaggtgataattctgctgaagcatttggagaatgttttcccactcttagaattgcattgagagaccatttctaaacatgttagaagaataagccttacttcttcaggttcatagcccacagctcagggttacatacttagaatcatagaattttgaaacggaaaagatcttagagattagctggtttaaataattacgtaatgcatcaaatattttaactcctccaaactaagcatgctacagatgtttgtttgtcactaggacaccatagctgtgctagagagagatgaccagatctttccattatgaagtatctagaatagcatcacatgcaaagtaaaaataaaaaatggacaacaccggccctgggtgcaatttggggtgaggagggaacaccattcatgggggttgggaccataatgatttaaaacgccagaatatggtccagcctcacagctagaaaaccaagcaaaggcgatgggagatgaacggcaaaaaaccgttcagagatattaagctactgctggctgccatcacagcctttttaacaaaaaaaaaatattcacaggtctgttgcttggccagaaaaccttgtttcatttatacagtatttctccctcctagtgacacatcctgtattcatttgcctgagatggtccacttaagtgaaagtaaaccaaaggaaagccatccagaaaacaaatcacccagcagtttgcttatccatttttcataaacatcaggactacctgcttctaaacaaaagacaaaacagtcgctacaggatgaaagatgaaggaaactggaatctcattttcctccttttggcctgtaatgtagaaaagtaactattgggggagctccaagagcttcctcttctccaattttactgggtacgacttcagctggaaaagtaacacccccacccttactcttttcccacctcttcccttcattgtttctggcatgggggtgaggctgggagtgactcatctcattagagaatttgggaaaagtactctgtcctcagctccacccactctcagacctgtctatctgcctatctgcctatctgcctacctgtctgcctgcacagagtgtccttccaacaaccttagcagggcaggcggagaggctgcaggtagccagctgggctgcaagtgtcactgaagcaagcccttttggccacagatataaagctcacatccttccatcagcttatcagcaaaaagctgacagacattcagatttcctttgtcttctgtgtcaactggttttcaacccagaaggggagcaaaagggtgtttattaaccccctaagaccccaggagtaagatttgggttaggattgtttaaataaccttgtgagaacacaggcccattcacaccacattctacaattaaatgatcaaagcccagttcaatctccatgtccatgcccagatactcacataatctggtctcataaatggggagaatgccaagctgaatacatgaatgccattcattatctcctaattttaaaggaaagcaactttctactttcaggagtaggattctccctgctttttagtactggctctgacattagcatgggtgagtcacctcaccttcatggagctgctcctcaactcttaaagtctcaaaggtggtgaacataggacccaagaattctagcaggttttgcgtgattgatttgatttatcatttctaacatattactgatgagagaaagaaccctgtgaaaacagagcaaagatggagaaccactaacttttgtagcctccaggtgctaaatgctaacgttcattaattctatgtattccttatagagtgagacaccattgcctatagtggtcctcaaggaatttaatttaatgaaatgataggagcaattgcaattagaacataattgtgtgtatgtaaatatgcttaggggagcttcgatagagtttacggttgctacattcacccgaattttggcctacattattaatttgcactactatgaagaaagggtttgttaatcaaagataaactatcctgatgacttgaattagagaacttcaaattatgataggataatgaagcagtgctctgcacatatacaattctctactaagtgaaagctttctggctggccacataggaggtctccttattgaaagatttatttttaattttgaacagcttcccagcattacccttcatgaaaattaaaataaggagctggaattttgtcctgttcagcaaacctccttggcaggactacatgccatggcaaagaaaaccttattgtgtcagagtaattctctgtctgcttttctcctaaatctagaagaattatacctacatttaaaataaaacttcatcccaccccaccccaccccacccccggaaatgtttttgcattttcttcttttggaggattttagtgtgtcttctttgtgctctctggaccttttgccccagtaggtgttgacataacttcttggctcaaatccctacgtgtacagggggtcatagaagtctcccccaaaatctgtgggagccaagcctgtcctcagcgcatctcccacaggcttttctctgccaaggagaatgacttcaccttttacagatgaggctccaaaagtccatccctacttataattcggttaagaaaatgatgtagtgcttgcgaatgaatagccaaaaaggtagaagggggctgcatgtaagaatactgattggatcatcaaccagattctccagatggtgcagaaatcgttctgcattgcatcagctcctaattcagagagaccagcagcaccgatgcgtgttcccaggatctgtatgtaatatttccattgcattcttccaaaagagaactaataaactgttggcaatcacagagtactcatgtttctatcaaaaactcctaaatcatactagtctttgtagaaaaataaaactaatgactgcgaacagtgttcacaacctaaaaattcagaattaaaagacaaaggcctagctggatgacccgttcacattagatattttaaaagactgttcacatttgcagagctgaagatacattccggtaagacttgccattctagcccctgctcaaaaccttccccaagtcttaactttttatttattccaaagagttcagggcaaaatggaaaaataatggctttggattgggacactggaatagttttcacttataggatcaattagtacagatattttactaaactattgagtgcacttactgaaacattcatttaaaagaaaagtgcagttagaggcgataggattgttggcaatttataatccttttctggctatgttttctatcccaagagcctcacaaagaataagccactctaactctgtttcccttctcctctctaactctccagaaataaaaaagccggcaatgtaaaactcctggaggggtggtaactttttcagggaaggagtacagatgagtaagtcagaagcgaaagcctagaaacctagattttcaaaatatttgatattcaagatttcatgacagttctgcgattaactcagtagaaacacttcatgaacaggaaatgttttctagtcatctgtattagcagaaagtgatgtaggaattggaggagactggccgccccaccctccgccccaccctcccagcccccacgtcaatcaagaaatcaactataaaagtagctgcaatcacgcctgtaatcccagccctttgggaggccaaggtgggcggatcacgaggtcaggagttcgagaccagcctggtcaatatggtgaaaccccatttctactaaaaatacaaataaaaattagccaggtatggtggcacccgcctgtagtcccagctactcgggaggctgaggcagaagaattggttgaactccagagatggaggttgcagtgagccgagatcacgccactgcattccagcttgggcgacagagtgaaactctgtctcaaaaagaaaaaaagaaaaaagtagctgcaaaactattaagtgtcttaaagtaaacttcgttaactatagacacaaagatgtacatggaggttctagtataggtccacctagatcatttataatattttacattaaagcataagatcaaaactattgctgctaatgcttttgttagaaaatataacaaataccaaaagagcactctgcattggtaaaaatcaattttataattgtacataatctataagtgctctgatgtccagccatggacatcataattcaaatgactgagatgaatcccatccagcatggagtgactcagctcactgcaacctctgactgctgggctcaagcaatcctcccacctgagcctcctgagtagctgggactacaggtttgtaccaccatgcctagctaatttttgtattttttttgtagagatggggtgtcatcgtgttgcccagtctggtcttgatcaaactctcaggctcaagtgatccacctgccctggcctcccaaagtgctgggattacacgtgtaagccaccgtgcccagcccctaagtatcttttacattataacgcagctcccaggcttgattgattctatttcaattatagcaatttattataattcattattttaagccttttctctgtatacattcagatcatacaataaagtagattcaattcctacctgcttggttggtggtcacagtgacagaaactgattggtctgggttagggttatatttggacactccattcacagcccagatttcaaaggtgtaattggtatgagctaggaggtcagtgatggagactttggtggtcttcaagccattctgctgtggggtgtagtggaccccacttccacagggtcggcacttgctggggtcaccagctccacatttcttgcataccacattataggaaatgtcctggcggccacctgtattctgagggctactccattccaagttcacagatgtctcgttgacatttgaaatcaagttcaggggagcagatggtggacctggagaaagaaaaccacatcatcacaccaagaaccgaaatacccttttggaatctctcagagtttgtattattttctgcagctctccaaagcaaggcaaacccacttggcaaagaaagcaaaaagcaaatcaagccagcataaaagatcttttaaaagaacaatataatagaaggctgttacgtgagtgtcattctctttcccacgcaaacaaacaaggcatcggttgtcactttgagatgtgaagcaactctccagcaaatgggctccaagcccaggctttccctatgaagtggcagaaaaatatcataatttatctgttccatcttatcatctaaaaaaatgaaagtgattctagttcccagggccgttgtgagactctgataaattaatagttatataccacttctgaaggtaaattataattcctaagtacagcatgtcatcaatagcaaataaaattaacagaactgtagaaatgtgcctctgcagttcaacatggcagcggagggttaagctgtttatgggtaattagtacgaactggtttaacgcggttgcagagatgttgaagatacagctgtggcgagatggcaggggttttgttcaaggctcccagacccctcctcctgccctttaactcgtgcattcccagcaacatcaaagagtttctgaaatatgggtgatggcagtggttgttatgaaacagaacaactgattaccgacaacatactggttggttaaaaaataatattaataataaaaaataagactatagatcatgatgaaactcttgtttcttgatgtagatttgtgtgtgtgtgtgtgtgtgtgtgtgtgtgtgtgtgatggagtctcgctctgtcacccaggctggagtgcagtggtgtgatctcagctcactgcaactttcacctcccaggttcaagcgattatcatgcctcagcctcccaagtagctgaaaatacaggtgtgtgccaccacacctgctatctttggcggagtttggccatgttggccaggccagtcttgaactcctgatttcaagtgatcggcctaccttggcctcccaaagtgctgggattacaggtgtgagccaccatgcccggccatgattggtcttaatagggcaaaaaaattgtgacacaaactgctttcaagtggaagaatcaggctgggagaagggagagggaattttcttggtctgaaccagttccaaaggcttaaaaggtagctgccacactcaaacgagacatagctactcagtttgacagttggaaagctatttctttcccatttcagtcttccaagagatgagcaaaatgagttttaagaaaaatttgaggtttctagatcactgttatctatactacttctaatgtaattgagatggctactttgcaggaaattagtacaagtttctcaggaaaagaaagttaacaggaggcttgcatgaacttggatgagctttacctagtctaccacaatgaaacatactgttcaaaatggctgtcgagatagaattggaagaggtaacctataaataagaaatcatattcaatatttattacatagcttgcagtgattaatggccaattattttttagtggtaacatttaataagggtaattcactctccttttctctttatcccacttattgaagactttattttaacaaggtaagcaggacttcccaaactcccctcaggactaattaccaacaacctctttaagcattaagatcagctccccatcctgtgaaacttagaaaaatgcaaacctttaaaacatttcacaaaagtattgtaaaatttgtattaaagggaagattacttcacataagtcctcagagagaaaatacaaatttctttcttgtttagatttcaaaactgcatttacagtttttagcatggtaactggaatataatgacaaatgaatgctttttgaataaatgaagtacataaaatcaccgactctaagagctacataggatgttaaaatcatttggacaaatacccttattttaaagacgaggaagctgagatctggaaagtaaatctaataatactgaaagttcatgcaatctaattagtgacagaatttgactgaaatccaaaagtactatctgccatttggagttatttttattccaccatgtgttcctcactaaaggtataatgataacaaaaggaaaaatttcagccagtttgagaaggcaaacatggaggtggcagtgagctatcttcagccctgttttaattctgtaatgcttgccaccatagtgaaatccattactagtctgcagctgaagctgaccagggcttggtttatcaaatgggtcagtcattggttcttcttttgctgtgacttccagggttaaataagagtgactctgaaatccattaacctccttgccaaggttcctggtccactttcacatgggaaaatgtgacacaatgaatcaagcaccacagaagcaaaaagtcagtaattagtatgtaggacggggcacggcagtgtctaaacagagaagaaatggagcagaaaactaaatggtttcaggactcagagatatagcacttccacgtggaaaaaaaaatgacaaagatgctgcaggatttcaaaatggagggctggcacgaaaacacgtgctaagctagggcagccttcttcctgtgggcagcgattctgaaggaaggctctgggttggatgctcaagactgagaattaggcaaattcaagttcagtgctggtaaatcgtactgcgtatgttttatgctttgctatcatagagagtgacagctttgtggggacactgtcgctgcctcgaaattggagtataacgaagtcatatgatagaggggaaaacaaagtatagaaaatccatccaatatgactatgatgttggtctggaaaaaaacctgggagaggacacacgctttacaaattaaaatcataatgtggtatgctgtgcttgtgggattgtggtttctttttttttgtttccctgccaattaaaagattacaaatatataagtgtgtttctcatttaaagggagggcccatctcctctttaggaggaggagaataaaagtattctattctcaagacattgagaaacaaatatgggcttgaatatagccaaaagccaatctgggcctgtagttaataccgaactgcagcatcttggtaaacaattacctacagagatggctaaaaagaagagaaaactggtattctgagtaatctgagctctcttttaataaatacaaggcatccagaagtaaaaaacctaactccgattattttctctttcatttatgtaagtattgtgtctggctatttagaagcaattaaatttctgacagagtgattgcctttgtcatcagaaatatgtccacctgcgagtaagtctccaattacaaatatgaggtttataacaaaaaagggctaactgttgtacttgttctaattttctagtctccacatctgaatcgacctactgagtacatacacccatcgggtagcttgagggtcattgtgaatggcaagattttgttttcaaaactacccactactagcctcaatacaggactggcataacaccagtccttatgcttatgtcattgtttgacatttcagttccttatttcctttcctgctttgtttgtaacatataatggtgtcttgctacttagacaccattccatgtctgtttctatcaccagtatatgtgctcctcaagaattgatgtcttggccgggcacagtggctcacgcctataatcccagcactttgggaggccaaagtggatcacctgaggtcaggagtttaagaccagcctggccaatatggtgaaacccccgtctctactaaaaatacataaaaaaaaattagccaggtgtgctggcacacgtctgtagtcccagctacttgggaggctgaggcaggagaatctcttgaacctgggaggcggaggttgcagtgagctgagatcgcgccattgcactccagcctgggtaacagagtgagactctgtctcaaaataataataataataataataataataataataataataattgatgtctttatcacttcctgttttctaccatggttcctcgttcagaaatttcaaaaaatgtttgataagtcaatgaatgaatgaattaaaaactaatgaagtcctttaatgcatcttatacccagtgttatgaagtgtgtgaactatgcagccttctccgagccaaagctgtactagtcaacttttcacatacagattcattagctttatacctgtgaagtagtaactcagtgtaactagtttgtttcaattgcctctttttttcatggtttagaattactttggaaaaagtagaaagggctatatataaaatattagtggttacttctgctgggagagattgtgaatcattcatttattcaaaaaacatttatggtgtatctagtgtttatcacctgctttagaggagagaggaaaaatattcttattcattttgataacttcctgatagttgcctagatagttgcaggaatggatagggaacctagggaaaaaggcagagactcaaggaaactaaatagggattatatgtgcagtggatgtcagagcaagcacctgccttgtcctgtttttacagctgtgtaaccagcgacggctgggaatttgaaatgtgggttctatcaaataaggttttatcaaattgggattggttattacacttttcttcctccaccttgatttcaggaggtgatttactcagacatgaaagctttatctctggggaaaactttatctctgaagaagcttaattttaacatttctaaaggtagacaggtattttccatattagtctttatggaacaacagcttttgcctttaattttaattttttcacccaaatcaagacattctaaaatattagattggtacaaaagtaatggtggtttttgtcattacttttaatggcaactacttttgtaccaacctcatataaattaatcaaatgctgaggtgtatttaagggaacataaacacccttccttcacgtttttggttgtatttgtaaatttcccatgaaattcacatataagcccaggattctctctgtgcctgcacccaaaaatgaaaatagcatgttcaactattttaaagttttcatatttagtatgccctttacatttgtaatataacttagtggcccagatattaatggtaatcccagaaatagaagtcaaatgcaataatctttagtttataaatcttttgcacaggggccggcataatttctctgtaaagaaattttatgatctggccagaaaataaatattttaggctttatgggccatctgctccctgcagcaactactcaactctgtaattctatctccaaagaagccatagacaataccttaacaaatgatcatggctgtgctccaagaaaacttatttgcaaaaataggtggccgttaaaattgaccttcagaccatttcgtgctattgaaaatatgatgaaagcaaggcatcttctttttaggaagatgctctctggcaccctcagaattctgcatgtaattccaggaactaaaaagcctatctaaaaagctcagtccaggaacccctgattaacctatgtatatagcccaggtgacaactctggctgctaaagtccaagttagacctacctttattgactaaggagggaataaaatgagacatatggcttatttcttgagtttctcattgctctgaaagaaacgggcactgaatttcttgccattatagatacatttaatgaacatccattcacttcactggtgtgaaatactttctgcatcacacagcaagtaccagagaaaggtgctacaatgggtaattattattttctagtgggatgtcacctcacattcagttgacaggagtttgacagcattaagccccaaagaaactatagccacatgatagtagatacaaagggctatcatatcatattataaaatatcacatcatatcatgttgtattataaaaggaatcttgatcttcctttaccaaccatgtgctcttctctggggaaaaaaacaagcttctggaaatgaaccacatactgtcaatgtgacatttaagaacggcaatattccaagcataaaagaaaattccagtaattccacatatcttaattctttcctcccatggattagactaaaatttaattcttgagtagtttagagaacacagttgctggcttatgtcaagatttaaagtagcccctttaggacaagccagtatttacatatccacatgaaatctgtgtgagccttaataatgtcatttaaaagccgtcagccaacactaaacctaaagtcagaaatgtctccagtgtgtctataagtttggtataaaccattccatggaaagtccaggtaccctatgtactctacctcacacccaaagtcagagaaaatgcatttctttattcttacaggaagcaactgaaacttcagtaaaagatgaaaacctgctatgataattgcgttttgaaatgggtttggcagaaatgggttctgccaaagggcttaaatatatgtggatatacggtgtaacgtgccatataaacctaaaagttctatttctcgtaacgactggaattaaagtgccaacagaatgcaaaactgtggaaaaaagtaagtcaactttaaaactcacattgttagcaaaattttgcacatgcaactcaaaataccttggagctggtagttctgcttggaattctcactcccggccctttgactgactgacttcttatccctggaatagttctcattcctgactactccatacaaactgaaatcctccctttccctgtcccaatgcacccaattgcatcacatttttaaaaatttccttcttaggagaaccttcaattatcttattcatttgtttgtttatattcccattagaacataagctccaggagaaaaggaatcttctctttttcaggtttatgagaatatctacagccttcagagtaatgcctgacatctggtagaaactcaataaatatctgctaaatgaacaaatgaatgaatgatgatgctttagcccagtccagctcactaatcagaagcatcactaccatagcactatggctgagcacagtggctcatgactgtaatcccagaactttgggaggccatggtaggtggaaggcttgacaagcctaagagttcaagatcagcctgggaaacatggtgaaaccctgtccctgcaaaaattataaaaattagccaggtgtagtggcatgttcctgtagtcccagctacttgggaagctgaggtgggaggattgcttgaacctggcaggtggaggttgcaataagctgggatcatgccactgtactctagcctgagtgatgaattgagaccctgtctcaaaaaaaaaaaaaaaaacccactgccatagcacttttgtatgtcacaaaagctaagcaaaataataataataataataaagagagaaaaaatggcaatcacatgctaaaatgtaaaaaaaaaaaaagaaaagaaagaaagaaaatcaagtctgcaaccaaggcaagaagacagttgatagaaaaaccaaagtctctggtctcatgtgatagagtagtttccagagctatcacagacatctaatacttaactgatttttaatcgccattttaaaattcaatgcctgggctatgaaattcattctggatgggaaatggagcatcccccaagagcatgggcagaaaggtaactctcccatgatcgatgtatttaagcactgctgtcacctcactaaaatgctaaggcaaccagtccaacacatatcttggaggaagcagcaccttgggtctgtagttccatttcctaaggcttcattaatcatgtacaacttttggactgtcaatagcacttcagcgtcttagctgtaaaacccttcaacccttcagataagcctttgttgttaatctctctccagctgaaagacaggttataaggaagagtcaacagttgggatgcattacgttttgactctgaaataaagcccatgcttcccctgacatttgtatatgttgccaccactaattgctttctcccagtcctatctgctgtgggttagtttacataaagatggctgttttaaagacatccctcctgacatatatgaacagtgcataacctcttatcatggtggtttatgtgtttttacaacaaagacagccaagcagggctgtccatgattaaaccagaaccttttggatgcatcaatcacttgctgctgtcatgaaaaattcttggcttcctatagaggttcatttcttgttgtgagactttcccataacctatttttctggttctatctcctttcccattctcctctccagtgatctttgtcttttttttactgggttaattaggggtttggtttctttttattaggatgacttgtttatggctgaagtgccttataaattctcagttatacacaagaaagctaccacgccaaagaccaagaaaagtagaattgagtatttcatttttaaaattatctagcctgtgcattaatttactttccttgcaaagcacttttttgtatcttatttaacagctgcaatcaaatctgacagaaaagtatttattgttcacaacaatctgatcgccaaaaactaagataagttaagcaaattgccaaaattaagacagccaacatgcgcaaagctgtgatcagaaaccctgactccaaggctaaacaaccctgcttccctttcatagagatacaaataatataaagaaaataataacccataattacaaattctttttgagaattggatagaaagtttccaactttctcagttcaccccagagttcaatttcacctcacttccctgcccttcatgatgatgatggctagctagtactacttcccagatgatcctcttttatcattttcatggggattatcttttctgccttgttcctaccttctgtgcaagagagtggctaggagtttctattaaaggttctttttctaggtggaagatcataggaatagggcgaggggcaattatatctctatagcagaatctctcataaatctaaatgttgatagcaaagaagataccctgggctgagtgtggtggctcgtttctgtaatcctagcaccctgggaggctgaggtgggagaactgcttgagctgggaggtggaagttgcagtgagctgagattgcaccactgggagacagagtgagactctgtcttaaaaaaagaaaaaaagaagataccccgttctcaccccaggggatctcagaaaaatgtgtaattaaccttgtttcatagaagcatgctgtgaataaccactgtatgacttccatgcatagtgtcaaaaatggcatccagaaatgacaggactcggtcaatgacaagccactcttaattattcagggtggtagaaaaattgtaataacctggctaaatggcattggcagattattcaagccttccacttgggcatatattagtgtccctcgaatctttgcattttccagtggaatccataatgggctgtttatgactataaaatggggagtatgtggggaaaaaaaagaggaagctaaaacagcatttttttaaaaagaattcagtgagatgatacctgatctttatgaaatatcatgaggctcttaaaattttgcaaacaaccaaatggcaaatgatcagtctggggtctatctagtgccttcgttgaagctcacctggtgatctttctccctttatctttaattttcttcaaacaaaaaccatccacttggttgtctagaggtactttttccttttagtagctaaaatgctgaaaggcaatccgaaaggaagaaacaaaaatgtggtatactcactagctaacatcagatgttgaactactaagctctaactgaagcagcagcatacgttgacggctgcatctgaatcgtccaaatgtctttggttgctttgatcagtttgtacagtccatgggacagacacattagctggcttaccaactaacaggcagcaggaccatatgttctgaactaaaaaccaactatgtaatctggcagtggaggagttggtgtctcaatctgagtttttgtcctatgacaaatggaatgcagtatgaaactatactattacattgcaaatttgataaatgacatggaatgagaaattcccctggaaaacttggatttgagatttttcataaaaatatgttcacgaaaatgattgattgcatgaatgataaaatggctagagatcaaccaatgaatcttctgaaacactttcatttacgacactttgggaatctttggcctttgttctcacttttctaactagtctttcactagagctaactgcaccctcactgacctatttcacagaatgtatgcctcccccatcattatatgattagttacttgcagctctaaagcaaaaagaaatatgctttcgggtagataaaaaaatatatagtttacttgaaactgaaggctgcattttatcctatggtttatacatcaaagcctcgctctagacatccctccccaaatcccttagccagactgctaagcatgtaaatctttggggtagagaattgaacagaataacaggggcaccttcaagagcttgtttgaaaatggatgtgagattcccaaaattaaagcccttaaaaaaataaaaaataaaaaaataaaaaaggaaaagagtccctcccttctcctgaccttggaaacaagtaaggacgatgttattttaatttgcattcaaattttcacaacacagtcacacagcaccggtcgaatcgacattgggtttccaccgaagattgctcatcatttcattatggctcattatgttgataactgtcagaaagcattagcagcgagggctttgagtaatagaactgaaatggtaattttaaaacaatacactttctgggaggaaatacagcagcgcactaaattcaattagaaaaggcaaatgtagagacaaagtaagtgatgtttgttgtttggaacttggctgtttcaatttcttgataacgtaaacctggagaaagttttttcaaatcaggacctctggtcatagatcttaggaaatctgccctcattagctctgagctctcctagtataaaatgtcttgaaagctgcaattttggaatattttcggccacgtctaagtatcaatcaatcactctttgtttgtttggcacattcgaggctgtttacttggagacagattcgtaaaggcccttcaagttggcaatctaaaataataatctctcatttacagagtgttcccaatcaccaggctctaagaagtttcatcaaacaagttaaataaagagcacccaaaagcacagggacagatttccaattgaaaaatacgaaaaactactctggtaacagtgctcagaagtcaaggtggcaaaatgacagatgagctacatttttctagatatgcaaagccaatttactacctttacaaggtacttttctagcacattttgaaatacaataaggggttggaaaagaaagttaccttaatgccgggtgcagtgactcacgcctgtaatcccagcactctgggaggcctaggcgggcggatcgcttgaggtcaggagttcgagaccagcctggtcaacatagcgaaacccaggctctactaaaaatacaaaaatattagctgggcatggtggtgcatgtctgtaaatcccagctacttgggaggctgaggcaggagaattgttttaactcgggaggtggcagttacagtgagctgagatagcgccactgtactccagcctgggcaacacagtgagactctatctcaaaaaagggaaaacaaaaaaagaaagttactttaaatataacattgatttagcttcccagtgggggaaaagaagatcttgctcactacaatcattgaacaagcaagtacatgactaagaccatcagaagtcttcctgcaggggtgtgaggttgaccacgcccagtcctgctgataaccagactgcattccagaaggggcagggaaacaaggagaaacagatctggagaagggaaagagctagtcattcgtagagttaaaggactttaatttcattaataaaaatcacatcaaaatccctgttaagaaaagattcataaaatcaaaatcctgacatcagctttaatggcagccctgaatgtgcagaaataatggtgcttgtcctggcaatgttgccaaaaaaaaaaaaaaaaaaaaaaacttcttgcctctcttgactgatacaggtgtctaaggtgaacatttacatttctactctctggcaataacttggtgaggattctggaagaaacaaacaaacaacagcaaaattaaaaagaaaaataattccacagtgagtgcatttggttgtatgattctacccaggctggattttcttcatacaggagacagatgaagtattccatttccatgaagggagaatgatcagaatccatgaaatacctttctagagtcaccactgagctgaagaacaggtctgaaagttacaggcatcaaaacagaatctcctgtctcctgacagccgtggggctgggaatctaaatccttgctgcctaaagacggttttacagatcagtagcttcagcctcacctgggaacttgtcagaaacagactctcaggcctaacctcgctcctcctaatccgcaggtgatttccatgtgatttttgtgcatgtggatgtttaaaaagctctgttctaaactccctgttctaaatagttatgggctattttccagaaaatgttccgatggtgcttccatagaaacatctcagcacatctcacaggcagccatttatgttaacctaaccagaggctccagcaaaagtattcccaaaggtaaagtttgtttacgattaaattctcttaagctctccagcagcgtcaatggtgcaaacttcctaggcagtttccttctaaattagccaatgctacttttattcacctggtctaattgttctccaagtgaacaaaaacctgattttacaagccagtggagcacagtctctctttggctagaagaatgaggctcagatagtgtgttttatttcttcattagtgtgccgtcacagtgagcgatcactaaatgcgaggctgcataagaatgctggggttaaagacagcataatgaacaaagaaggtgcctgattatcatggctgtcagcacaagggaattgggtttgtcacctggcttaaccaactgggaagaactgattagaggctggaatcagtttgaaaggacccctgatgtttatgctgcttcccatccccacatcttgtcaagagaatccgataaagctgggggcagcgtgcgagtggggagagttactctgtggatcatctgaacaagaggttctttgagaaactcctactgtcttctctgttggaacgtctactacagtattgtccaatagaactttctgtggtgatagaaacgttctctgggtctgccgtccggtatagtctccactagccatatatggctattgagcactcaaaatgtgccaagtttaaataagaacctaaatttcaatttaatgactttaaggttaaatagccacgtgtcaagtgtctacagtactagacaatacaggtccattatattcactaggaagggagatgtcgaaaggaagagccataggctaagaattagaatccagttctgctgcctgacttacgactatatctattatcagcaaagtatagtcacttccctgattatccctatctcagaggaagtcttcagaggcttatgcagttaatgtttaagtttaaaaaaatacttacaagtttagttctgttggccgggtgtggtggctcatgcctgtaatcccagcactttgggaggccgaggtgggtggatcacctgaggtccggaattcaagaccagcctggccaacatggtgaaaccctatctctactaaaaatacaaaaaattagctagatgtggtggcgtgtgcctgtaatcccagctacttgggaggctgaggcaggagaatcacttgaacccaggaggcagaggttgcagtgagccaagattgtgtcattgcactccggccagggtgacaagagcaaaactcggtctcaaaaaaaaaaaatttagttccattggaggggtctgaaccttaactgtacaataaattaacagactgatttttgaaaatactgatgcctgagtcctacccccccaccagaaatcctggggtacagggcagccatcaagtaatttaattatgcacgcaagggtaaaaaatcactgatagagaggcagtgagatagctgtcaacctgctgtggaggcagtttggggaaggaagtgaccagctggaaataaaagaggaagagaacaaacattgattagatccctaccaggtgccagaactttgcaaattttttttatttcattcttaaaacagccccagaggtagatggtgagaattccaacttacagatgaggaaattggggcctggtgagggtaaactctctctgaatatcacagtgttggtcagtggttacagccaaggcgatccgatcagcaagttgatggcgtcgccatcagcactttgtttcctcttaactgaagtgctgcatataaagtaagtgggatgtgataaccattaaagtaatgcacaaggctgagtgcaatggctcacgcctgtaatcccagcactttgagaagctgaggtccatggatcacatgaggtgacgagttcaagaccagtctggccgatagggtgaaactctgtctctactaaaaacaaaaacaaaaacaggtgtggtggtgggcgcctgtagtcccagctactcgggaggctgaggcaggagaatcacaaacccgggaggtggaggttgcagtgagccgagatcacaccactgcactccagcctgggtgacagagtgagactccatctcaaaaaaaaaatgaaaaaataagtaagtaaagtaatgcacaagaccttgaagtagtaaagtgtaggagaaggagttccaagagcaggtattttcatggaccttttaacaatgacacaaaaagccaccagccttccttcccttcaccttgtggaaaatgacttctgaaacatgcaaatgttactttaatttttagactttttggtccatccatatgctaaaatcaaattttctcttcttcccctttgcatccttaagataaagctaacagttaaaaatacaattccaagggctcaactaccacagccttattacacatacatcaaatgttccagcaacacagacatatggccatctttggaggtttcctaaactcccaagtagcaagacttggtaataaagtgatgggcacatggtccccttaaatgctaaacaggtcagcatcatgagactgaaaaatacctgggagaaagagccaggacctcctgccatcagagatacatttcatgacactcataatacaatcaaatctcaacctagagaaggctttatctgcatggaaagtaagtgggggagtacatgatgcaaattgagggccatcctcaaaatgtcagcctcaaacacttccccttgagtttactattgtgccccagattcctacaagaaaattgttggtagcaggtgtggataaagatggggagtttattattaaactaatcacacaaatggaacatagcatgaaaatatttacattggaaaagaaaaaggttgggactgaagagttcaaacaaaagtggccacgcagagaaagttcttagtctatggaggaacaggaaagaaagaaagcaaaaacaatccttgcctatttacagtttttctgttttcgtttttttttttctaagacagggtctttttttgtcacccaggctggagtgcagtgatgtgaatgcagctcactgcagccttgacctcccaggctcaagtgatcctcctgcctcagcctcccaagtagctgggaccacaggtgaaaggcaccagtcctggctattttttttttctttttttttttttttttgagacgacagagtttcctctgtcatctagggtggagtccagtggtgcaatctcggctcactgcaacctctgccttccggttcaagcaattctcttgcttcagcctcctgagcagctgggattacaggctcacaccaccacgcctgtctaatttttgtatttttagtggagacggagttttgctatgttgcccaggctggtcttgaactcctgacctcaataatccgcctgcctcggcctcccaaagtgctgggattataggcctgagctactgcatctaacctttttaacagttacatctgagactgaccctaggattctccctaactctgaatgtttatgcttgacttgggagagccagcaagagaatctcccagattctctataatagaataatataaaatagaaataatataaaatataaatataataatataaatataataataatataaaatagaaactaggtgagtcttcaggttgtacaactctgtccaaggtagggtgtgatcttgagcatgttccttaacatctctgagcttgcagttaccttttctataaaataaagattatacctacctaacagatttcttataaaccacgtattaagatttttttcaagtacctaatacattacctgggcataattataaaattgtcatcatcatcattattatctctcattatgaaagaaactctggaggttacagcaatttgaatataaagtcagagagacctggagactcactccactcattttaaagacaggacttgattgcccagtggcccaaagtgctcaaatacccaaaaaccttttatttgcagggttgttagctccagattggccaaaataccatttatagtagttaggaaacaaaataataatagtcataatgataactaaaactaatatatatatatatatatatatatatatatatatatatatattttttttttttttttttgagacagagttttgctattgtcacccaggctggaatgtaatggtgcgatctcgcctctctgcaacctctgcctcctgggttcaagtgattctccagcctcagcctcccaagcagctgggattataggcaccacccaccatgccagctaatttttgtatttttagtagagacggggtttcaccatgttgaccaggctagtctcgaactcctgacctcaggtgatccgtccacctcagcctcccaaagtgctgggattacaggcgtgagccaccgctcccggccaaagctaaaatatatgaaatggcatcatcctatgcgatgtacatagcacataaacaacatgaggctgtttaataccaacaaccattaggaggcactgttattaactccattctccaggtgaggaaacagactgaagagactcaacagccacccagctacacaacaggctgggaaacaaactcaaaatctgtggaaggtgtctgacctgagccatgaggctagccctccaagcacagattcacctaatggaaattcatgggcccagtgctccccattccgatcaaggtcacagccattgtagggtctgtgaaggcccaagtgtacatgaaaggaatggtaacacctaggaacactgtccatataaagtgtgagaaaatatttcttcactcctgctcttcataccaagcttcccagcctcatccattcattaacccagcatttattaaatgcaatcattaaacaagcatttattaggattggggcctaagtcttatgaacacaaaactatgagtagagaaggaagaggtgtaatgacaacctaagcaatgatctcagtgcacactgagctgtcctttacagactgaaaccacattcccaaaccctgccgtctacctgtttctcctgccagttgtcaagcttccctgagtcctcagtgcaatggcaaagccactaataaattccaatctcagctctaattacactgtcagacaacctctgaacactcaatctcttctccaccaagtagtctgtaggcagctgtgcacactgaaggcaaccagaagcagtgggaaagaccctttctttttacaagcatttcccctgctatgattgagaaaggatgaatgtttgatctcaagtgccccctgaatgattatcccaggagaagacctggcagtgccttgctaggtggtaatgaaagctgttggcatcacaggaatgagagacaagcatacaacttacgggtgcagggcatagaggcagcatcgttgtcagctctgaaaaagcctcggtcacaggtgcacgaggtggctccttcccagacagagtagctgtggggtgggcacttggcacaggtggcatccgtggagagagccttgtaatatccaattttgcaagctgcagggaagaagaaaaaaacaaacaaatagaaaccactgcaaatagaccaaagcaaaaatgcaaagccacctccttgtttcagaagaagggagacgttcttgctaatcattagcgatcatgtggcttgaaatgcaggtcatgcaaccaaaagcattcattgagtatagtcgctctttaagggccattaacattcctggtcaggtgtcaagaagtccaaaggaagaaattttcttaaacctggcagaatcaaggaaaagcacagcaaagtttaccgaacgcctttctatgtgccagataccctttatacacattatgctgcttaattcttacagcaccccttttcgacaggcattatctctaccttagaagtgaggaatttcagctttgagcagttaattgagggcacaagaccatacatctgctaagtgtcagcacccagctttgaccccaagtgttctgccctcaaagcctgtatgcttagtcacatgctatggaatttcagagtgtagcctttagccaaccagtgggaagtgtatccaagtgctgacaaaaaaaccgggtggtgattatttcccaattacaactacagaaagaaccaaatcgaaagatcaacaaaggcaagcaagtaaaaaagacgagcttgtaaggcacgggtcacagtttcagggtgaaataacaaaaactatcaactggagattttggaatatagtatgctaagatttgttttttgatcagcgaatattttgtgtctattttcaagttcataaaaccctcctgtttttccctctttccatttttccagcacccttcccctgcaatgcacacacctcccgagagcctggtgtagagaacacgggccatatagttttttatacacctgacatcctttccatgacttcatcttcataaacatcacactgacactgtcatcatactgacactaaggaccacttttagtagtgtggaaaaactcactaattctgggaaaactcataataaaaaataatgactacttgctccccactctttttccttcccccatggcctttcatgatcgcctctcaaatctgtctcaaccccagataaaaattgaccaacaccatcagcattaaacccacagagacaaggccattaagagtaaagttatttcataacaccagaggttcaaagaaaatgtgccagtaacccacaatctttccagcatgattcactctcgtttcttttcattcatcatgtccttaggacttgtctatactatcagaaacagcagtggggagaaggacctatcagccattttccatcagcctggcagccaaaacggaacaaccatgcagcaacgcagcagatcttactgaaatgagtactagaaagagatccatgaaactgcttgattctctctggagatagggccatcatctcactgtcactactcatccatcaagcatctgtatggcttccagctgaagtctgttccacccactcgcatatcctgttggcattttcttaatcatactcttgtaatggcaagcggaaagggaatttagcaggggctcaggaaggcacacagttacttcactcttactaactgaagttgtttatggaatttcctttaacaagccaaaactttatgacgtgtggagcactgacaataaaagtgctgggagatcaatctctcccttatttgctttcgtctttcactggaccggagcatcttagaaaaacaagttgctccaatgactgagatttatgtgtctcaagtttatacacattgcataattagataaggttcaacttgcaaggtgcttttttggtcatgcttaagatggccctagggttttgattaaaatcagaaaccctgactttagcaggaagaaggactgggggtcaagcccagctttctcacatcaaacacaatgagcctctgaacaggaacacaaacccactgggtcccgcctgtcactcagtcagtcgcagtcgacaaaagcaacttgtggcaactcaggactgcaaagaaggcacaaaatgctttcatttttttcacatctgaatgtttgcagaaaactgcatattactgactgattctcatgcacccctcaatttcaacaagcatcaaaaacgaaaaactcacagtgggagtggaagatcgacaaggacaagaaactgtccagtgactgatcatcacaaagtccaaatggcatatttgaaaagctattctgataagactacttccagctaaaaaattaaactcatcttttgcaaaaatcaaaatggaaaatgttgccttcaatttcattaaatttcttacagtgcaaaaacctgttttatatattatgtgaatttaagaaaaaagtgcatttgcaagtttacattttttcctatttttcctcgaagctggtattaatatgtcaccaggaataaatatatgtgaattcatttgggaaataccaattttataccagtttggaaaattgaaggctgctgttctttaaacagacactcttttccttttgcttttataaaacacaggcagaaaatacaaaattgtcattgtgctattctcggcagccttgctacccttaacaccttcttttgtctccaactacattaagaccatgttattaatatttcaggattcttagaaaggctctctcaaaatatagtagtggcttttcacgcacatagccattttgctgcctacatttaaaatgacctagtaaattgatggtttagtacatttctttgctctatgtggtgcacagccttccagcatttggtacataaatgtgtaagtacattctgcatttattcactacttactagcatctgaaaactttcactatctcttttattctaaacaaaacccctgtgaaagatgtacttggcataacaagcattgactgttagtattttttatccttctattttaggtgagaactgctatgctgtatttttgaatactaatgactttgtgagcaagaaactacttcctcctgccctatttccaccgaagtttcactagttaatgaaccatctgaatgggtgtcttacttgatcttctagatatgccatggagaaaagattagttcacacgtatgatgcaaactttgcattcaattcctttagctttgctttaattatctctttctgctggctttgaataaaaaaagatggaggaggagaaggaggaggaggaaaaagaagaaccaactcttctttcattggctcacccactaccataacaaagtcgaattttaagatagtcttggtaacgtagtatcttctggatttttgatgcattgatgtgtgtacgtgacagtataatgcccaatttaatgagctgattacacctactatttgaaaattttatatatatatatatatatatatatggctatgtcatttttctgctttttaagaaatgtagaataattgatagtatctgattgtctttatagttcattttaaaactaaattagtgcctaagagtagctaataatagcaattgtgaaaataaatatcaagtattcattgagtattcattgtttatatgctcattgatcatttaattgtcacaataattctgtgagcttgaggcattatcactgttcccactttgcagatgaagaaacagggttttcagtaacttgtccagggtcatacagttaagtggtaaggccaagcatttaactccagtgcttatgtttttctaaaagtttttagtgaaaaaggttaagttacctagagttaggtctgaccttcagcaaaaatatgacttgggtataatggaggggtaaggatctgggctggtcccaacttctatttgttcccccagcccatcctcttgctgcctttatcagccacaaaggcagccacactttgctctctgtgacccactttccagttcaaggtccctcagagctacactgtccattaaaataactgctcaccccatgtggttactgagcacttgagatatggccggtcaatgaatactggctgtgagtataaaatatacaccagataccaaacacttagtatcccaaaagtaaaacatcactaataatttgtatatggattacatgttgaaagcaataatgttttgaatgtatacttaaattattaaatttaatttcacctttaaaatttatttatttatttatttttttgagacaagagttttgctcttgttgctcaggttggagtgcaatggtgtggcctcagctcactgcaacctccgccttctgggttcaagcgattcccctgcctcaacctcctgagtagctgggattacaggcgcctgccactacgcccggctaatttttatatttttagtagagatggagtttcaccatgttagtcaggctggttttgaactcctgacctcgtgatccgcccgcctcggcctcccaaagtgccaggattacaggaatgagccatcacacctgggctaaaatttatttttcaatgtggctactgaaacacttaaaattatctatgtggcttgcattatatctctatcagacaatgctgctctagaagctagagtattaagtattgcgtgtgtgctgccgtgtgcacacacatgctactcttgcaaacgcagggtgctgaaagtgaaggaggatgtatcacaatcccccaaggacctgttttcaaaacttaccctgaacctacttagaagaatctgatacacttcctgaagaactgctctcaaccagctaggtaattttaaaaacctaatttgggctaaagtactaacaaatggacattaatggggggttaaaaattaccttcccaggtaacaaatttgcaccttaatatagagtcgcttgagggtctagaaattccaacactgattctaaggagaatctgaaccctttatgcacgctggtctccatacaatatttggcaaagagaggcttataggtctctccaaccctatcttgtgggcatgatactaggcacacatgaccaaaaagtttccatgggaactctgccttttgtgcactggatacataatatatccagtatgcttaggcatctatgttagaaatatcaaagtctcttaatggccattattaaattagttcttcaataaatttttcatttgttaaactatttcttatgttaataatataagaaaaaatgatgggaaagaaaaaatatctgtcaaaaagcattacagcttttgaagtttttgtgaatatgtgcaagccccagccatctttggggaaggtgtgaacattaaccaattaattccccacagtacagatggaatattaaggcacaaaggttaagggtttgcccaaggcagggtggattttctaacacagacaatatggcttaaactaatacgctatagatctctgctttctcttttcaaacatgcagggtgaagatggacaattggaactgttattggacccatctgactctcttccattcatgaacagccaaacgctggcaaatccatattgtccaaatcacctgcattctacaagtggtttgactgctatctgttgagcatagttaaaaattagattgttgaagggaccttcaaaatcatctcatccaggaatgggcaaacatttctgtaaagagccagaggccaagaggaagaccaaggatatgatgaaggtatttatgtaataagatagaaaacaaatttttacaattatttttttagtgatagaattcaaaatataatagtaaatcattaagtacttttttgcaatatagagttattagtgaggggaatggaattctttgttggagagagaacatttcacttaatttggtttcaaggaaaatgttcattattaccaattcaattccaaatgtcatctattaaaaaacattcttagctgtcagatcatataaaaactggtggcaggccagattttgcccatgggtcatactttgccaaccagtgatcttgtaggacatgttcatttttgagatgaataacttgtccacgggtcctttctggagcatactaggattgagcctctactccatggttcgtctgttactctgcagtgcctccccaagttttgaatgacaaagcataataaagtgcatgttcttgtcatcgctgcaaatgagtaaacttttcatcaactgtcttactggaaaagctgattttactcagtatcattataagtaaaaccacttttcaattgattttctttttttgattaaatggtatggcctgatttggaagctattcctataccattgtggggacaatttctttgaatcagttcaaatttctgcaattatatattatgattaattttacatttacattgttttagggtttttcttccctgaggatcctgggcttaaactgtttttgtctatgaaatgaaagaatgatactgatttttttttttaatttctgagccactaagttcatgaaacaactacaatagcaattgaaatgctttgtgttgatgactgatgtagagaaataatgccttaatcttttgcctgtgaaaagggtttactctcaatcccaagactgagataaagacagagacaacagaaagtgttcaagagctttgaaagatgtaacaggtctctcaggtgcggcctaagctctagtctggacattagctaactaaaaaaaagtttttaaactggagattacctgaatccaaattcagcaagaataccaaacttctcatctcagaagcttctaatcttggaagatcagtagtttctaatctttcttctcagagtctagcatgtatcagaatgaccttaacaaaggacttgttaaaagaccaattgctggtcctcactcctagtttatgatggtctggtgagtcctgagaatttgcatttcttatatactcccaggcaaaatgtgtccctggacccgatgacaacattgctggtccagggacatgttttgagaaccactgcttaactgtaaatagacccgtgtctaagtaaactcttaacaatgcagttcatcttaaataggttcaaaccacctcatcctttctctaatacccggatgctaaagggacaaatcattatcaggagaagaataattggttttggaattcattttggagtggggagagggcatgccagaaatctgacatgtttgaggccgggcgtggtggctcacgcctgtaatcccagcactttgggaggtcaaggcagactgatcacctgaggtcagaagcttgagaccagcctctccaacatggtgaaccctgtctctgctgaaaaatacaaaaattagccaggaggcattgtgcatgcctgtagttccagctattctggaggctgaggcaggagaatcacttgaacccgggagactgaggttgcagggagccaagatcatgccactgcactccagcctgggcaacagagtgagactctgtctcaaaacaggaaaaaaaaaaaaaaagagtaagaaagaaaagaaatctgacatgtttgaaatataaaatttaaattatttctcaaaccagtatgaatgtgccctgtattgccccccaaattatgggacagagcctggagtgaaatatccttatagaaatgggtagctgccaaagagaaaggaaaagagatgaagctctcacacagaactctgttatgctaaaaattacaccatgaaattcaaaggaaacttaccaaactaatactgtctcaagtaagtagttatcctctcacatcaatattgtgaactgatcattgttgttttttgatactgtttcacaagtattaaataacacagttaattcttacttattttatttcaagtatttgtttatttgatactcttctgttttctggatagtaaaatcagaatagtacaacctgattgttgttaaaaattactaaagaattaaggctgggcccagtggctcacacctgtaatcccaccactttgggaggcctaggtggactgattaccttaggtcaggagtttgagaccagcctgaccaacatggagaaaacctgtctttactaaaaatacaaaattagccaggcgtggtggcccctgcctgtaatcccagctattcaggaggctgaggtaggagaatcacttgaacccgggaggcggaggttgcagtgagccgagatcgtgccattgcactccagcctgggcaacaagagcaaaactctgcctcaaaaaaccacaacaacaacaattactaaaaacttaaacttagttatttcgagatttttttgtgcactctgaggagactaaactccaaaacatgattgcatcaccagaaattcaagtttatttcattcatacaaagttctactttctctagtaaacctctgagaattcagaaaagatgtactgagttgcttggctctgacctaatcctggtctttggttgctttagaatattattttaaaatggctgtaggggagatagtagatatgtaaatgttgaaataaaattgaaatatttaattttggttaccttaatcaagtgtataaaggaatataccagacatccatttagaaaggttaaaatatttaggacagagatgtttcacagacaacaacagcaagaatgtaagtaaagaatgacaaaagcaaaaaataaactacaaacaaatcaaaggtgattttctgtctgacattcatattcactgtctggtggtctctttttgccctgcagaataattgatagcaagggcagtgggagacataacgggaaaggcctgaacttggtttttagctctgccccttattagatgtgtgaacttgaacaaactatgtaactactctgaacttcaattttttcatctgtagggctgaaatgatgatgaaatgagataatacacaggaggataaaagacagtgtgttctgtgtataagctactcactaagagtaactcattattcctatagcacagtgcatggctgcaagaggggaagatggaaatgaccaatggattttcataaaacttcaagttttttgttttgttttaaaataagattggatataatttctaaaacactatgggataacttcttcattattgtttttatttcttctgttattaacatggggtagaaaacccaagattgaagtctaactcatagcatctgcagtttagtaactatagacaagattggaagtatgtaaaaatttatttttatttagacaatttaaacaccattcctaaagttaaataaattattgtattggctttggaggtttcttccttcaaccaatagtttctaattcagatcatctcctctggcaagacacagttctatcctattttctacgttccatctcctcccatttttcccctcttaccttggaggtagttttcagaaaaacagacaacgaaaaaaagtgacagaaaaaaactatgctgaaaatggatttgctctttcaagaacagaatgcagtataatcccataaataggtgagtaattctaaaatgtcagatgaagatggttttcacaaaagattcactaaatcttccagaagaaactttacataaagcctgctaaatctaaattaactctataaaaaatattaaacacaaacaaaaagaatgcagtgggggagatgacttattattttcccttcttgcctttagaacagatcatctgattatttgaggagctatttctctttggtgagtttggaaggagtaagcttaaacagtaaaagttccaaagtaagtaaactaaacacattcaactaaactctctaatttacttctctgaagagtaacttccactgtcataaactctacttaaaaacagctctgcttcatatatgtataaagggaatgggaataaagattgctagctccaatctctagttgataatcctggggttctctctcatcagggctccatacaaaagcaatgaggccaccaaatttccatggaagtaactggtaagacaagtgataggcttctgtatttttggaaaaaaacataatgcattctgttttaaagtgtagatgttgctgccaggtttgataaaaatactcttagaaacttttacttagtttgatcattgcagttttccctgttaaagtgaactaaaaacggcctcagaacgactctgtacttctatatttgagtccttgtgggagaactgtaacctaacttagtaggtagacaaaattgacaatctaatttaggagtatgcacctataacaatggctgagtcttggccaatcccggcagccatgcttcaacctctcatacactgctaactgttcaaactgtgttcaaataaggcaaacaccaacctgtaaccaatccagctgtttctgtacctcacttccgatttctgtacctcacttccgatttctgtacctcacttccgatttctgtatgtcacttcccttttttgtctataaatcttcttccaccacatgtctgcgggagtctgtctgaatctgctgtgattctgggggctgccaattcacatatcattcattgctcaattaagctcctttaaatttaatttggctgaagttgctaataggaatttttgattaatcacaatagagcattgttagaaacaaacaaatatgttatttcaatttgataagagatgacaatttaaaaatagaaggcagtacagcaacctataatcacaataattccttttttaaaaaacatgttatttccttaaagatcccttattcttattctaacctttgttctaattcttccattagagcactgaaaatttgctatctgaaaaacaaaatatggttttcaatattgccttataaaacagctgaaggaaacaaactaatacctagggctctacaaatttttagggtattttcctttttttcccctcatgcctgaaataaaaatgattatgactttagtaaattttgagattaaagaaatattaatttgattttcaataaattaattctattggagatataaattcaagtagattaagcagaacttaattgaatgactctataataatatttttaagtcacaaaagccaagtaaacttgtttgcctaatatgctgaagtttatattaggaatagaaacaaatggatgctaaaaattaaaatgaccaccatgtaagaaaaaatcaagaaaagcgtatattttagatgaactaaatgtagaaagtaagtaatcatattttgtaagaaaacccctgccattaatttgaattaaaattactgaaaatatctgaaaatacttttgaaagatttaaataagtgctgccatataaactatcaatcctcaccaccgctagcacatcgcagccatgaaatgcaaatcaggagacactaacacctaacttgattgcccaggacatttcacagaggatcaagctttttgatgagttgctattgttttcttcaccctttgatatttggggtacataaagatgagtggctcattatacatcccctgattacagataacaggtcagggcactgaataaaggaagcagctgttcttttcttcttcctctcctcacactagcccgtctgaatttaatacacgggtctatgcagattagcgtcattatgtagaaatttcatcccttattaggtatgtgcatttattcattcattgggccatttatgttttagcaaacatttattaagcctttacataataacagtaatggcaataatgagagcaactatttattgagcacatactaagagctaaaaggctgggaatatgaggctgttcccttcaggaaggaagcagaccactgcttcctctcacattttaaggagtgatctctggcagaggtgctttgagactttcctggggacctcacccatgcacctaacccaggctgtctgcttgcagaggtaatggaatagaaaaaccacccgaaagaaaaggtgccccctgagtatcacctggagaaaaagagtttaaccaggaagctggcttcacccagaagaagctaaaataatagtgactgctagcctggaacaaaacactgaggtgggtactgtgggtatcacccaaactaatttagacaagaatcctcttttgagggagagcacagtccaataggagacataagtgattctgtcattaactttatgcatatcttacacttgctcagctcctccatttatttaaaagtaaaggcactacagaggcctgggaacgaatgaaatatgttctgaagccagggccagaccaagagaaacacatgttaaataattatttgattaactccggcagcagcattgctagtcattgtcatccaaacgactttacagcctgagttgtcaggaatcatgatttatgcagctgaaatgactgcagtaataagtgctcagtgcacctcttcttttttgttatgttgatggggcctgagaatcacacacacaagaagcagaacctttaaaagactgaattccccaatgctacagttattagcaacgtattacgattctctgctgaggtttttaatcctggctcctctgatgggtcacctttaaaaaaaatgagtgtatatattaaaaattttctgaaagtttttgagcacacaagatttttaaaaagtgttttatatttaacagatacgatcaggttaaacatctatttttggtattgcatgtagtggactaatgattttacacaactttctgccagcatttaatatcatatgtgtttgactctttcaacattgcttatgtctgaggagcacaaaataaaaattctcaaggagctccctgaagagacctagtctagactaagtgaaatttatggagaatttgcactgtctgtttttggtacagtacagagaagtcccagggatggtagcaaagatgagagccccaaaagcttgggataacagacgatgatcttcctcttaaaagtacaaaagggtgctggcaacaacccaccctttcccacggactcagttatactcctgtaagccggggggagggggtttgaaaatctacttaatgcattttgaactcttcagcttgatgggtcattgtcccaagaaatcggtttgaatcggcagccgaaatacacagtgtgacagtggaaggtcctctgcacccagtttgacaaggacgacttggcagtttgtccagccttacaggtgagcctttcataggaccacatccacaaaagggaacagaggagagcagcacatccccagacctgaatcccaaaggaagtggaccattttcttgctttcgtgtgatgcactcttgtagggcacaaaaggttagtgtttagtccttctcacagcatggcaagtggagctggtcccaacctcggggattttgggaggttctgtgggaagtgttttggcagcctgagcattctctgtcaacagttcaaattcatgggaaaaggcatgaagccaaaagtgcttgcaggtgaattatttgtccctttcaagtgcatcttacttaccctgatgacgtgtaagtgtgtttatctttgttgggagggactatcaggtaggtcagtaaatccttccatgtataaattataaatcacaaatggcatgcaggagaaataccaagtcagaatctgctcatttgtttgtccgtttctcatcccaaatattaaacacaaacgatgggtgaaaaattgatattaatcataataaaaacaagaccatgatgttgacatgctcccaaagtgtttggtcatgagagaagaaaaagtggaacaactgttctttgtaaaacatggatgagctggaagccagaactgacccatttaaagaaagcaagagaaacagatcaggcttattatcaaatacaaaagaacagcatgtcactaacaacctaaatttatctcagatgtacaaaaaaatcttactcatcccaagcagatctctagaccaacattcaaaaatgactataaaaggcatgggaagttgaaaaccttttctaggattctatttacaagatgctacctcaatttttgtttgtttgtttgagacgaagttttgctcttgttggccaggctggagtacaatggcacgatcttggctcactgcaacctctgcctcctgggttcaagcgattctcctccctcagcctcccaagtagctgggactacaggcatgcgccaccatgcatggctaattttgtatttttagtagagacggggtttctccatgttggtcaggctggtctcgaactcccaacctcaggtgatcttcccacctcgacctcccaaagagctggaattacaggcatgagccaccacggccagccaagctacctcaatttaagaaacattatttgatatctcattattaattagtcttctttttcatatatcacaaaacagttgaaaattacttaaaaagtactcttaatcaacaatcaaaattagatcctggccacatcacacacggtgggtggcttaccatgcctgtaatcccagcactttgggaggctaagacaggaacactgcttacatccagcagtttgagaccagcctgggcaacatagtgagactctgtctctacgagaagtttttaaaaattagctgggcatagtggcatgcacctgtagtcccagctactggggaggctgaggtgggaggatcctttgagcccaggaggtcaaggcctcagtgagccgtgattgtgccactgcactcagcctgggcaacggagcaagaccctgtctcaaaaataataataataaaagacatagatctcttttgtgtctggaaagcagaccataagaagatctacattttattttttaaaataggattttttccccctagccttgaggcaggatcatttctaaagaggctcagatttgaagggaaaaaaaaaaaaaaagatgaagtcataaatccttcccccaggaaaagaaagaaaaacaaaacatagcattaaaaattttggcagatggatgatcaccttcatgttttcctcaaggctgtgttaaggttacatttctcctgtcaaaaacacaaccaggaatccgttccctgctatgtagaagtggaggaagtgaatggctgaaatacaatgactgagaagaggccaggctctgtgaaaaggggacctggattccattcctaacatttaacaatttaaggtttctaggggtcagtttcctctaagagtaccagactaaataatttaaaatatctctttttaatcctcaaaaattccaagtctatacggttcccatgatctgatagattcaatgattttttttttttttttttttgagacgcagtcttgctctgtcctgtaggctggagtgcagaggcacgatctcggctcactgcaacctccgcctctcaggttcaagtgattctcttgcctctgcctcccaagtagctgggattagaggcgtccgccgcgacccctggttaatatttgtatttttagtagaaatggggttttaccatgttggtcaggctggtcttgaactcctgacctcaggtgatcggcccgcctcggcccaaagtgctgggatcacaggggtgagccaccatgcccgacctagattcagtgattctcaaataacctaggatgctctgataaaccccaaagtcacttacaattcagttcaaatgccattgagcacattagtccagcacgtttatctttccttccaggactggtgcagactcatttatggagctcaggaactgagctccaacactttctcagccctaggactgtgagcaaggtccttttttttccccaaataaatccacccctccaaactgtttattgaaatttctcttacctgtcttagcagagattcccaagcactcctgtgctctttttgtcacttattaaaaatcagatcagaaaaaagagggaaacaaatgtctttgctctatggtgtgaaggttcattcatccacatgtattgctgagcgctcctacgtgtgcctgacatagggaagggatgactggcacggcctgtgtttccacagagcacatattctactggcagggatagaactgtacaggagaataaacctggtaatatgagagactgaggatggggctgggaaggtggttcataggggatctcaattaataaagggccagcaattgtgaacattacatgggaaagcatgccaggaagaagagaaagttgcagaaggcctacagtaggcatgtattagacagacagaagattactgatgctaggaaatgttgcaagaggcatgccaagattgagatcagagtggtcatcctgagcccacaggcccttaactcagtgaggagtttagtttttattctcagtctggcaatatgatttgatacaaattgtcaaaagattcatttggctgctggtagaacgtggatgacaggaagtatgattagaagcaggggacctgtaaggaggcccttgagatccagcagagagggcatggccacctggaccagggtggaggagggcgagccgggagtcgagagttccaagtaagtgacataaaggactaactctgctcttcctcacagttgcagggcattttttttttttaagtggacttaagattccaaacaagtgacatacaaagcaaattttgattttccccttggctgtatccttccaaatgagtcatgtctgcatctacttaagcagactgggacaccacttcccagctcaagaatgccacccgcatgtgctatcacaacagctttgatgaggcttggccaccaggccctgggtcctgaccacttgcaagtgggccacaccttgatagcagctgcatgacagcacccactaacttgaggaagccagccgaggggccagcttcctgagcgtgattcaaaccggaactaagggtgcagctgacaagagtttgtcaacagccattgaagtaagtgagttatgaggtttcaggttgacattaggtagctgctggtgtgggcagcgcagtgttgttttacaactgaggtctttactttcctgtttcctcccagaacagaatttcatctaattgggaggcagaaaataggtagctggttttcaggaaaactgagaaattgagtggatttattcagatctgaaactgttcatgcttccccctccccactccatggcttctgtggttaagagctcagtccttatcctccaatgcaaaatggtcctcacctccagcttgtaagaaacaagaatcctctcctgatgcctgtagtctaggttaggaaatctctcttccctagaccccgctctttacccgctcctgctgcacaactgtaatccagtcatgaactgtgtgttttgaggtttcatgtctatcaccctttgcagaacacactctcagatccatagcagctgcaaatacgcccatcctgtttactattacatctctaacatttggtaacctgtaacctgtaacgatggctactcaccacaaatatgtagactaagtatacgaatgaatgaatgaatgatgacacagttgcctttagcatctaaatgtctagacacagaaagcaactcagaccactccttgctgtgaaccaagctgtacgaagatcatttcagatttacttttctttttctgttcctatgttttctgtttctatgtttcttgccattgtgacttacatttcccttcaaacagccttgcaacattatgggcttggctgaagcttgccaaaaaggaaacagcacaatcctaacacgggtaagcaagcaggtctgctgataatacttaaaaggtgggaggagcaggggaggcagaattgtaatgctctcttgcttgggagcacttgtctcccagaggaagggttagatcactcaacaaaatatgaaaccagagagcagagtagttttgaaaagttaaaatatttagatatgaataattttcagaggaaagatagcagtaaaggttggaggggtggggctggtgcaagaagaaataaatcttatcaaaggcagccttgggagctcaggcagataggataagagataagtccctttgcagagttagtcacaccctcccacatacaattcacttggcaaaggttcctttactaacaaagcaggtgcatgttttaaccaaaaaacagtgcagtgcaacagctagggtggctataaatgtagttttaaacactttttttttaaagcaggatataacaaaacatcgtctataggaaatctgaaaatatagggtcttatggccacaaagcaagtccaagttttctcgtcgaactttaaatgatggacagtttctgaaaaggggcatttggaccttaagtcggagacaacagagctgacattcctcccaaagctctgtggagtggaaaacagatggtgattccaaagcaagaatctgaggaaaggagccaggttgagatgagaaaggggcaattaacagtgagaaaacccagttcctttccttcagctcttcagacgaatccaacagaacttcttttcctctgctccagttattaggttggtacaaaagtcattgcgatctttgccattactttcaatggcaaaaaccgcaattacctttgcaacaaccaacctaatgtaaggacatgctacctgggagactctgctcatggatgatattaatgtttctgcctctgccactcaaagtcagccctacaagttactatcccctagcaagggagctactcagggtttagaaacaaagaacattaaaaaggcctgtacatagtggtagaataaccaaatcagcctttcaaatgcaaggcaaagaagcattctatactcacagcccaaataaacaaaagcagtttacctccaatgcaacctagagtcctagcctcgccctttctctccctctggactgagacctctttatttcctctgtagtttctcggtgtctcttcttttctcttttgcttcctctcccatttcgtttactgaccattatcaaaatttaaaattaacttttaaacacccattttgtgtaatttttaaaaagtatgatgttcatgctgatcatgtcattcctgtattgaaaatctctcaatgatccccactgtatataccacaggattcaaccagaagaacagagaagctcaaagcctctcatagccagccccaatttgtccctcaaacatcctgcacttcaatcaaaccagacagagtaccagttgttctcacttggattgttctttaaacacttcccatcacctacaaataatgaaattttatcttctcttcacagcctaaaatcagccagtaccttttctatcaagcattgctacactggggaatcagaattcaaatgttttctgtatacacagcacttctgtatacaaacacatatatgtgtctttgaacatatatttatttactttattatccagtaggcaactggtagacccagagtgtaagacttatttcctctaaccacacacacacacacacacacacacacacacacacacagagagagagagagagagcaagaggggggagagagagagagagagaaacacagacagtgcctattatcttatcttaaatataatagatgtatctttaggaagcagaagttttaaactgagtagccaagtgtttagagactttcaattttactttctcttcccccacatcctatttttgaaaattcatgtaatctctgattttgttttctatgagctggtgacgctgaacaaatgaaaatcatcaatcattcttgaaattcatatttcataaggtaacatcgtaagagtttcatgaaactcctctgccagttgcacttttagcatgaatttttagaaaaagtatagaatgacaaaaggctactacacattcaataagtctttaaaatatatttgcattttgttaaccatggtaggatctgcatgcatttgaaattggctataacttatgttttgttatattgcgccccctttgacgctttttagaaaacaacatttaaaactactttttgaagaaacagaaattatgaaattctgattatttcatacacaacaaggcttggaccatatagtgttaacccaaggataattcttgtaagaattcttccctattctcaaccctcggactctattacctactgttgtgaatgtcaatgaactaattattgcttggcctaacttctagaatccaacttcattccaaacctgcccttgagtaaggaaaggaagaaagctctatctaagaccagtgcaacgggaggatctcatttccatttagatgttacaggatattttaaaaagtagaattgaaactggacttaagtttcccagaccaaatgccagagacagtagagatgctatagccaaaatagggaagacaggaagacatgtcagtttcaaaaggaagggcatgaggtcagctagtgggtcatgatatgtttgagttgagatgttcaggaagcaattggagagacaggtctggaggtcagcactactagaggcagagatttggaaaatatctgccaaaagcgtaagtgtcacaggagttcatgaactgtagattcagaaaaagtttaaggaagaaccttgtaaataccatatgtcagaggtaattggagaatatggaattaaaaaaacaaaacaaacaaacaaagccaggagcaatgactcacacctataatctcagcgttttgggaggctgaggcaggcagatcacctaagatcaagagtttgagaccagcctggccaacatggcaaagcccagtctctaccaaaaatagaaaaaaattaggtgggcatgatggcacacgcctgtagtcccagctactcgggaggctgaggcatgagaatcgcttgaacccaggtggcagacgttgcagtgagccaagattgtgccactgcattccagcctgggtgacagagcaagactccatctcaataaattaaaaacaaacaaacaaaaaaacaaataaacaaaaaacccaaaataggccggaaatacagagcaaaagggaactagcatttactgagcactgcctgggactaggccaggcacttcaaatatgcattctcatttaattctcaccattttcccttgatatagacattgccagttatgcccatacatgtgaggcaccagataaatttgaggcccagtgttacagataatgctacattcatcgttgaagaacggggaaggtgcatgaagaaacccaagagaaagcagaatttccagccatcagatagggtatcaaggaaaatgaggcttggaaaaagagtcttggattgtcaatatcacacgtttgaattctttgagaactgcacagggaagtgacaaagacgaagttaagctgtaggattggtccagtgcataaaggcacaattaatcaaaacttagctaaaaacacctgttcaatgaccaacctataaatgatatacggtaacagattcttgacacgacaccactcattattacagggatttgaacactaagtgaaactggtgtctctgaaaccgaactggcttacctaataaattcccactctcaccccaaaatgtgtttcaaacaaggtttcccacacttcatttacttatgcttcatttttatgagttttaccttctgagagttcaattatgttcttgatatgtcaaaagcaacttgccataaatcaaaggcaacaataaaaataaaatcctattattattattattattattattattattattattatttttttgagacggagtctccctcagttgcccaggctggagtgcagtggtgcaatctcggctcactgcaacccaacctctgcctcccaggttcaagtgattcttttgcctcagcctcatgagtagctgggattacaggtgcgtgccaccatccacctaatttttgacggggtttcaccatgttcgccaggctggtctcgaattggtctcgaattcctgacctcaggtgatccgcctgcgtcggcctcccaaagtgctgggattacaggtgtgagccaccacgcccagccaaaagatttttttaaactgtctgtccttatgcagcatttgaaaaccccagtacttccaatataccttcctcacttacaaaagagaacactggcgatcagttgggtaataagaatagcaagtagttactggggctctctatgtgcactttcattaattcctttgatacccccaacaacgctaagaagtaggggctatttttaattggctaactaatatatttagtcaataattttttttttttgagacgcagtttccctcttgttgcccaggctggagtgcaatggcacgatctcggctcaccacaacctccgcctcccaagttcaagcaattctcctgcctcagcctcccgagtagctgggattacaagcatgtgccaccacgcccagctaattttgtatttttagtagagatggggtttctccatgttggtcaggctggtcttgaactcccaacctcaggtgatctgcccatgtcggcctcccaaattgttgagattacaagcatgagccaccgtgcctggccagaatattttttagtaactttttttgagacagagcctccctctgtcacccaggctggagtgcagtggtgtgatcccggctcactgcaacctccatctctgaggttccagaaattctcctgcttcagccttctgggtagctgagattacagacgtgtgccaccatgcctggctaatattttttgcatttttaagagagacaaggtttcatcatgttggtcaggctggtctcaaactcctgaactcaaatgacagcctcccaaagtgctgggattacaggcatgagccaccgtgcccggccctcagtagaatattttttgagcacctggtatgtcctaggtgctgggataaattcaaaccccttttgttaaattgatggaaaaagaggggagtggaaagaaacaaacaaagcaaaacaaatatatatataaaatgccttgtggtgagaaacgttctgaaggagaggaaaaaaatgacatatattccaatggagaaaactgaggcacccaaatcatgctggacttgcagagggcaatgcaaagttcatgaagtagcggagcagaagtcagatgccaagagaaaactccagagcaaagatgtccagccacgtccgtgtgctgcctcctctcctgccggatgctaactccacttcttagcaccagtatccaacccatcaggtactgcctgagcaccctttaatgctaggcttcggggtaaaagaaagaacaagtgaaacttgagaaagcataatcacctatatacagtcaagagggaaagtggtaaatgacacgtctctatggttcctccagtgtttgcctatcttttcaggactttttgctgaaatgagaatgagaatgaggatgtaggcagtggttggtccatgttacatcttagtagaagtcattagaacccacctagttagacttacaatcagtgttacatggggatgaatgtcacctgggaaaagcggctgtaatttcctaacaaagcctatgtcaaatgaaaaggcaaattggggaagacaaggaagtacattgtacttagtgacctttcagaatttaccaaatgcttaatcatctacataaggtgcaaatatgctttaacggcttgacttaacctgggaagatacaacatataaaaacatctcacgtctccatttacattactaaacaccagctggattagttgccacacaattgatgcttattagcacccaaaagcttgatgtgatggctacggcacggctactgctcatgaattaaaatggacatgctcatacttaaggtatgtgtttcccaattcagagatttaaaatgaagttttccaagtaacaattatatttttataactcctaagttctcaaaagtatcctattgtcttatttacctggaaggagtgctggagagagaaaaaaagaggcaatttttataaatctataaatatgtaattttatagccttttgaaagagtttactatttgcaatgctcaccaaattacatgcccatgatagaaatttctatttcataaaagaatgtgataaaaattgacgatgcagactagaccaacctgtcagggacctcagtgttcacaatggcctcaggacagagcagctgcaaatcatctgtccccggcaatgtgagcacagagaggacacccatcacgctgcgtggaactccccatttaggcagatgaaaacaggcgtgagactcaatgcacaacatgtagattaagttaaaaggttaattttctgactcgtggtctggatagtagagctgtggaggaaaacgagttaccatatgctccgtaaatttcctttcggttaaaaaagatgagggaaagagagagagatatgtccttgattccgtgccattagttccggcagtgaggatgctcactgtcacgcctttcccaggtttgatctgatggaggacgaacgactcagtggttagacacaggctcgacagtcagacaaacacattgaatgatgttgctgccacttgagagagcaggcgagatgtggctcttaactctcagctgtggcttcctcagcaaaatggggttgatattaagtgaggaataataataagaaactgcccacaaagtacttggcaccagcactcaatacaccactacctgagtcctctccaggaaacaaagttggagcctatatcccttacagggaagaactgagattctctgaaaaaaaataaaacgttgccaagaaaagaagctgggaggataggaaagggtctaccaagtacttttagggactgtgtctccagagtgatagaaataatgtataattcttttataactctctattagatactgtgtttcccattttattttctagataaaaaaaattgaggtttagcaaaggtccaactggttacatagccaaagcaggagtccaattgaggtttatcacatttcaaaaataattataactaatatttattgaagaattatggctcagcactttatatacataatcatactaaatatataagacactcttatgaataaggaaacacattattcccattttaagctaaggaaactggggcatatacagttaagcagttgcttgagtaaatatggctaataagtgacagtgtcaggatttgaagcaaggcagtgtaattccggcactttatatacataatcatactaaatatataagacacttatgaataaggaaacacattatccccattttaagctacggaaactggggcatatacagttaagcagttgcttgagtaaatttggctaataagtgacagtgtcaggatttgaagtaaggcagtgtaattccaggtcacagccacaatacacgtgtgcctcgaaggttgcaggcaggatacatgtgtccctcgaaggtcatgagcctgatatacacgtctcaaaggtctccacctttctcctgtgtgctcaggaaacaacacaatctagtgtaaaaaaaaaaaaaaaaattcatggctgggtgcagcggttcacgcctgtaatcccagcactttgggaggccgaggtgggcgggtctcttgaggtcaggagttccagaccagcctagccaacttggtgaaacccgctctctactagaaatacaaaaattagccaggcgcagtggcgagggcctataatcccagctactcgggaggctgaggcaggagaattgctcgaacccgggaggcagaggttgcagtgggccgagatcgagatcgcgccattgcattccagcctgggcaatatagccagactcggcctcaaaaaaaaaaaaaaaaaaaaaaaaaaaaaaaaaaaaaaaaaaaattgacacacaaacacgtttaaaatgagcagtattaaaatctgaatctacccccgtctctactaaaaatacaaaaaaaaaattaagccgggcgtggtggtaggcacctgtagtcccagctactcaggaggctaaggcaggagaatggcgtgaacccgggcggagcttgcagtgagccgagatcgcgccactgcactccatcctgggcaacagagtgagactctgtctaaaggaaaaaaaagaatctgaatctactactttgtccttacaacaacataggaataaactagaacgttgtggaaattggataaattcaacatgctccatgttctcttggtttagaggattcttattaataaccctgttcggctcttgaggcctcttcagaatgacaagtgcctctgattaatgtccacgtgcacatattcacctgccgagtctctcatcagaaaatattaagaagaaggggagagaaaaagagaaatagaaaactaaagaggtagctgaaatagatacagttcctcaaaagatgccctggacagaccttcacaatctccagatacaggacaatgattcagccccatatgacagaggctcctgtggtgaggcccactgagagtccactctcattgtcacctggtcatttacagctgagtatggaggccccagccccagcaaccggggaggtccaccggggtctgcccgacactgggcagttacagacaatggggcaagagcgtgtgtctgtgcttcctcagggccaccttctcaaatccttcttaaggattcaacataacattggcctggatcagttctgaagatatcagcggtttatatttatctcacaatagcccgatgaggttcattgtattattattaccattttacagaagaggaaattgaggaacaaagagatgagggaacttatctgtcacatggctaaggaactgtcggagcagggtggagtccaaggcaatctgactccagagctcacaagctgccctgcaaacccctccttttaatatttcgccaatttctgaggctcatgagcagagacaaagacattctttcacaagttaaaagtgtttatacatctttcccaggccccacccctacctaaccacccccaaccccgccgtttcccctccccttccttctctgtgcacacagcagacaaaccttatctgttgtttaaaacatagagttatgcctgtctcattctctcttgtgtaaatgcagcaagattcctgatacaaaggcctgtaatccatagtaaaagtctgataagcgtctcttaggtgaaagagcaaacatattagcattgtgggagaatgtactcattgagtaaaaaatacacagactcaagaagacagggtgaccagcataaaatagcaaatactagccttgctacgctgcctccctagtaataatccaggctcggtaaccatttaaacaggaagtgtatattaaccattagatgcatcagcaacagcaataacaacaaaattcgagcagccaattcaacgttttctctgctcatggacataagactataaatcccagccaccaactgctcaccttaatcttattccctttgaatcaccacagccaagtctgaacaactttttcattataatattattatctgagtcttgcagtgcttgtttagaaagcattttcctaaacagtacctcatttaattaactgaatcatcaatacaactggtaaggtaggagttctcctttttcccagattaggaaactgagtttcagggagattacccagccagcaggagcagaaactggcttttctgattctaggtcctgtgctgcttccctgacaccatttccccatcctctgatgccacttctatacattttttagccttggcttctgggttccatgccctcctgtgccatcaccaaataggctacattccagatttcaaataaataaatggcccacacaactaaaggcatgctcttatcctctgtccgacatactctctaacacaaccagataaagatcaaagtggcatttacaggtctcaaatacatcaaatgcatggatcattaaaacaaaacaaaacaacaacaacaacaacaaaaaactacgtatatgccaaaaaaagttttaaagaaaaattttaaaaaccactccaagagtacatacaatatagtaatagatgttttccatgagtaagaggattgtgcatggtttcctttactgcaatagtctattctttctaaattttctataatttacatacatgacactgttgcttgacatcagaaaaaaaaagatttcagaaatgttcagtagtgaaagcactgaaaaattccaggtctccacaggaaggaaggaaagggactttgctgcagggggctgattttgccccaccttgaggaaggctggagaggctgggagaaggggcggtcaccattcacaaagcacaggagggaaactgagtagacagcttcctctctccaccaggaattgtgacttctgggaaacagccacccctccctgcaggctgccaactctctccacacctaaacacgctgacttgtaccaatggaaacgcctagcttttaaaacaaggttacaaatctgttgcatccaggcagagagggagttgattattctacagacagagctaattattttgacctaatgctttgagatcctccagtatcaaatctgtgactccaaataaatggagaggtcattatcacatgttatctttacgcctggacttaaaaacaaaatttgagacaacgctgaagggcataagcttgctcactgtagtagctttagtacaacactttctgcaaagttgctgacaatggagtatgaagcaccagtctccaacaccgagggtttctaggtgtgacaccatggaacttttagacacaaagcaaacaacttttgtttttcccctacatttgaggaaacccacgagtctattttcctggacatgaagacagaacactgataacagaaaaagggctctcttgtgagttattttcatctgaggatgtccgacctaccacaaaaccacccaagaaaaagagagaagagcagattcagaaagcgaaattatttcaagtgttatgttaaccgaatatccaaataataaacacccaacgcaaacagtccagtaggggcaggtaataaatcataatacttgtggggatcagatctcattagatttgaaaaaaggaacattgttgcacaaactggttattagaacaaggttctctctccctgcttttttttttttctcttaaaaaaaaaattgggacaaagcccaaatcttttacgatgtaatttctttccttattgtacatgtctcagcaagtcgccatcagctgttatttgttattaaggatctgtataaacattaaggcaaagagactgactcatgccacagaacaggaagagaaaggatgtgatcacactgttactttcatctgcagtcatgttcggcattaaccattatagagatggcagttaccattctctaacatgaaacatttgcgcgcagtaggaagcaaattctagaatggagcaaaccagcaacgggctggaggacttaaggatgggtgaatccctgcagcaggcatgaaggtagaggtggctctgccacagggcagcaccctgcaagaagtagggggactgggggcccatggacctcctggacatccttcttgggagcagagaaaccacccgaaaaagctactaggctaggaattcttaaatctgagggctgagggctttgggtatatgatttgggtttgggggacacatggaattctgttctctggctccatggggtgtatctgtagccctgcctcaaacaagggaagaatcacagcaggacatcgtggtctgcagggggtcagtgctttttcagtccaaaaatcagcacctcctacacagcccagatcgtactcctccactgtgctgtgggcaaatgggattcttgaagcaccaccacctccccctccaagtaccctggaggtccttcaaatattagctctaagtggctgaggacagagttgacacctcaaaggcttgggaattaacttataacagctaatttagagagtcacatgatcagccaagtgtacccagttacaatcaagttaagaaaataatcagactacggctgctttaattgcagcaaacaaatacgctctaagactactcaagaaagcaaggacaagtgagatctacaatgaaaaaaatctaacccatgattagtattgaaactgcagaattaggttaaactttctctctaaggtaaggtgagagctccaaattctagttagcagatgtttatactggtaggtttattaccctagtatagattaatagattaaccacctcaatgcctctgaaatactgattatattttacattcttcaaagcattaggacttgcttctgcttgcaaaagccacgcgtactttttgagcttaaaaagtcagcatgcctgggactcaaaatcctctttcaaagaattttgtattgtttaatttttacaaaattcctggcagcccttaggcagaaatttcatagtaatcacaaatggaagtagaaaaataaaagacagtttaattcaagattgaacaataacagaaaggaaaagtatgcaaagctacttcctatataaataagcacacttctttttcatctcagggctgattctagatgatacctttttcttcattggtgtagtatctaaaaagctttttttttctttgaagaacaaagccaatataaataggatgaaaacagttatactcatctatctgtctcacacatacattcggcctaatttctatgtatctagatatagataaaatatgtaaatgtctattttatttttattgtttacattagttattcaaatctaaatagaatcttcttgtttttgtgcgaaggccatgatttttttctcagagaacgtgagagtctttaaagacaaatatttgctgagcaaagggatgactgaatgagagacgaaataccttgtactgaatttcccaaggaaaacgtgtcaggaacaaggacctgcagccccatcactgacccctttcttttaccaagggagtagccagtgctctttcaaaggagagctcactgagacaaaccaaatatgctgggatgtttgaaaaggggaatttcaaacaccaggcaattgtcacacagatatttcaatttattcttttttttttttttgagacagggtctcactctgtcgcccaggctggagtgcagtggcatgatcttggctcactgcaagctctgcctccagggttcaagcaattctcctgcctcagcctccagagtagctgggattataggcacgtgctgccatgcgtggctaatttttgtatttttagtagagacggggtttcaccataatggccagactggtctaaaactcctgaactcaggtaatctgactgccttagcctcccaaactgctgggatgacaggtgtgagccactgtgcccagccagatagttcaatttattctatcaaaagatgagaaaaactcagatcagttgagatttaacattctagttctgattactggccattttaatttgctaagcaggcacatgaattaaccaaattcctagtcatcacaagggcagatattaacttttagttcctacttaaggaaccaacattttagaacccagaagaccagagtgaaagtcaatgcagtcatgccaaaattgtctgttatagatccacacagccttggccgggccaggggctgcattctgccacctgggcaccttgtctgtagctggtgccttaggcttggcctcctaaggggtgcacaccactcagttcctggatgcctactggaaggagctgtttgacacggccaacacccaccacttctcacatagcctagcccttctgagggggctccattgcagaagccctctgggccaggtgactgtttgcctctgaaaccaccttattctcagcagttttactaccaggctctgagtgaagactgcaattggcagacttggccttctgtagggggagtcggccactcttgggcagacttgccttggctctttgaactcacttgtgtttaatcactggcttttgggggtgatttgtttagttggaacagggagatgattaaaagagaaaggtaaataaagaacaacaacaatgaaaaattgccagttacatttcatctgagccatacatatggccttggcataaaaatgatgggaaagttacattgaacaatgtacatgcattataataaacccagtatgtatcctaccatcaggcagccccatagctccaaaaacttttttgttgttgttgatcaaaatgtgttacagcctaccataaatacaatctgtcctctttaatctggtttctctatttctgtttgtggacctttgctaatatttgaatgagaaaacagaggcagaggcagtaactgccctcacccctgcccccgtatgtatcaataaaggatgcagatgcgctattcactgagatggctgatgactcggagggaggaggaagctgatatgttccaagcagaatttcaaaggtgtgtccctgaaagaaaaatgttgaaacatgggtctacacccatctgtgtgactcctaaagtcaatacagcttctaaacacacagattacagcacgctgaacgagttccagtctatggagtttcaaaacatatataataatgatggtaccgggggctgtgcctcctccagggaaattgttctgatttcaaaagcatcctgactgttaattttgtgactagtgtcaaaaaaaaaaaaaaaaaaaaaaaaaaagcctgtgagggtaggattcagattataaagatcagagagagaatctctcccttatgaaaatccaaacaaccttctccagggctatccccactgtcacttctggataccattgacaggcagactctttgccaccttgggtgcatactggaagagccagcagcgccctaccagaagagttctgggcaaaagatccttgtgagttaccttttcccacatctgcgtgacactccatgtgcttcacacttaaggaaataaaatatacatataagaacagccctaggtaattatccactgataattcatatttaatctgttgaatctaggtaggcagggactcaatttcaaaaatcatgccaactacttctcttgaaggataacagatgagatttttaactgatgtctttataaggattcccaaaagaatgatttaagaatggcctgcaagtagcataaagcatatcttgtttactaaaaaatgaatttgtgcaaaaacatgcctgtaattagtaaatcattggtgttccacttacccataagtggctctgggaaatttctctgctctgtttctgccctggattctattttgatctgtggatcttcttggctaatccatatccagtactgccctaaataggtttttcttgtattggaatgcgttctcattacctgcaagtgctccaagttctaacacaggcacctagaaaaggtctcaccccctcagatgaaaaactgcatcttgcacatgctggtaaatgcctaaattggccttcttccctggcctggctacagtggctgtggttgtgtgaacttccctaccttttagaagaaagagaataagcaacttccaggctgtgactatccctggaacccatggtcaatttgttagctctgtctaaaagtctcaatagtcaataactttttgattggttcttctttgttctactagggctgtcacatttagctgaaaatttaattttatgcccataatcaaactcaatagcctttcagttctgtgtagttgtacttccagttgcttttccacctcaagaaacagtttctgggggaaaaaaggtaaataactcaactctttccagtcgacagaggtgctcttcacttgagcatctacatgatttaacttttttgttgaccagaaagcatatattcacagcatccaatctaagcatatgtgctatactggctaatttctagctgtctgggattaacttcatcggcaattcggggtgcagcttctgcacgttctccatcgctattggatccacagaccttttcaatcttatccagttaaaaagaaataagcagcactattctctctcttggatcttttacttagcaagggaacctggaaatcactttcaactgggtgtcatccagagtcagccttagtggtgtgggcaatacacaagtttacctgtggcttccaaaatgctgttcctcaacctaaattaatcagaaccacctaggagcttgtgaaaaattcagatcacagactccaaactctaaagtcttgaggattgatgttaaaagtgtacatttgtaatcagtacctcaaatgattctaaggtataaactcatttttgcaaccactagggttcatcatcagacagaaaagctcagaaagcacttaccttccactaagttatcttatgccattcttacagctactaaaagtaacaaccatatattgactttctagaacagtcccaaatcccaaatctaaataaacattatcgtcttttgtccaatgccctaaaccacctatctacaaagcaataaagcatcaattatgccaaatcaaaggcacttctttttttctgttttttttcctcttcaaacaacggatttgttattttctccttttgttcaaataaagacaatcatcctttaaatataacctgcaagtcaactttactgtgaggcttttcttatcttcttcttctatgcctaaagtggtagaacaaagattttttggtaaacattacaaatcttcatatcaagggcacattccctttggttggatgaaatatctttcccaactccagtagggaaagaatcttacatgatcaatggctctcaatggctggaagatagatggcaatcaagaaatatctgatgaacgagccaggggtagagaccaaactcttcctctgctcttcaaaaatctttcaaaactcagctccacctacctacccagtctcttcaaccccagggtgtggcagctaactcctgttcttggctcaagggatattcattcctcttttaccagctttatttaactacagtttaccaagttcctattcttggaagcctttctagataactgtcaacaaagatagtccttcttatctttggcaaaagagcactttatcttatcactcattttgacacttaagagctaccgggcaccctgtggatgaccttgtccagttagctattttctagatgaggaaactaatgtggcagcctaaggaacttgtccatgatcagatcagataattattcagaataaaaattagaaacagtctcccaccctcttgtattgtattcctctaaagattataagccttttggaaatgtgggctttaaatgagaaatggtttttaatccctgtactagaatgcgaacctgctcactgaaggctgccctccagattaccggccttacgatgctctgcactagaccctggcattcttgaaagatgtttccccaaatcctcattaattcccaataattaagccctaacccccaatgtgattacatttggagacagaggccataaggaggtaataataagtccatgcttcatccatgaagtcattcttcagaaaatccctctaaacaatgtactttggtcaattcccttgtctctcaaagggggttattatatacccagtttagaatgattgaaacataatgtgagaatatgaccaaatcaggacaacaaagatgtgctgaaaagcagcccagatttgtagttaagggtgaaggcttggtcagtggccagactttgcaggttgaatccagactcctcacctattagctgtgtgactttgggcaagctgcttagcttctctgggctttagtttcctcatctatgaaaagaggataatgacagtcactatttcaccaagtcatggtgacacaatgaaatactgaaaataaagtgcttagcacaaagccaagttctcatcaggtaaatacatagcgaccttaacataaattattttaaattaatgccataaaggctaaaacaaagagagagagagaaatctctatgccgtgggactttgaatgcatttgtgaactgttgcatttaatccattcattcattcctttcaataacaactgtgtgtcaggctcagttttaggctctgagagtcctgcaaaaaacaagcaaggcccaaaaaacaaagccttctctcatggaagtagcattgtaattgacagctaaatccaaggatgctggagatcttccacattcttcttccacttatgttctcagtgctccaaatacttctcttgaaagtacactcaaagcaatttaaaagtcactcctaaaaatagtctgttactttgcaatcactcattgttcttgagtaaaacccaatattacccagtatggctgatctcatttatcaatagcctggtcagtgaattatttgatttccaaaaattaaatccaccttaagggacaaaattgttcagaactaagcacatttaaaaagaaggccccaggcctggcacagtggctcacatctgtaatgcaagtactttgggaggccaaggaggtgaacagtgcttgaagccaggagtttaggactagccagggccacaaaataagaccactcatctctacaaaaaattaaaaatttagcaaggtgcagtggtgcacacctgtagccctagctactcaggaggctgaggccggaggatcatttgaacctaagagttggaggctgcaatgagctatgatggtgccattgcactctagcctaggcaatagagtgagattccatcgaaaagaagaagaagaaagaaggaagaagaaagacaaagatgacgatgacgaagaaggaggaggaggagattatcaataaaaagaaggtcccagacattttgaagaagacagttccaaaacatttccacaaaagttgtggcagccttacagttatccagactatctttttcaaggattcatttgcatgaaagtctctgtatttgtttgctaaaaaaaaagggggggttatactttagaattatacagactcttttgtgtaagtatactgcccagcaaaactgacagagtgctgagtgtgtggcaaaatgagtaatttattgaattgaacgaagagtctaaaacgtagtgggatgaaacagatgtatgagtagggttataagtcttctgttataggacacaaatgaaaatctccttagggatactgctctacctgtaatttatttctacattattcttgtgtgtaatattatttttggcatgttaatgtattgtcaatgaattccaatctggtgacatgacaaaagttgtatttcattttggagtgtaaaaaatgtgaaaatcaattgaattatatatcaatgacatgcaatgagagtaactagtatattctgtgtaatgtcacttttctggaatgactagcagcctagagctattagattaattgctagagttttattcttactattatagtcagttggatttgctgaagtgagataaaaactcaaagctctctctttttttctcccccaaaagaaagagaatttgccagaatctgcataatttagattattaacttattttcttggcatttgactgaacctgtaagtttatgctggcaaataaaataagcactgaaagttgaagtcactctttgatctagtaaataaacctgcagaaaattcagactcaattactctttaaatttatgacatttctagtattgtgacaaatactgctttctcactgaaaatacatgatgtattcggtgagtatgcttcaaaaatcaatgggctgcttacaaataaaaccatattgacatttttacattttcctttttacatttgtttcttcgttcatttcaatgatcacacgtggcgtgcaatgactgaataggactctatgtactgtattgttttaggtgctatagtgaatgcaaagataaatacagacttagcctgggaagtgcatagattctggtacagaactgccatatatagttgtacaggttgttcactgaaaaagagtatccaactgaaggggaaagtggggtctagagcccagcctacactccttttaccaagttcaaggtcctgacacagggccatgacaatccaggagtagtagcagcagtagcaggagtaggagtaagcgctaatattgattgcaggatttctgcgtcccagccacggttcatgtgtgtttcacgtatttacttatgacgacaagctgatgttgtaggaactattactacttgcattttatatatgagaaaaccaagtacagagaaaaattattaatttgcctgaagtcaaatagctaataaatggcagaacaattactcactgagtaatactgtactctgtgccctaacaagtccgataagatggcattacacagcataagtgacatgaaggaacgcaatcaaaatgctggtgggagttaggagagagaagaaaaaaatgatgcttctgtagaaccttgtggaatgtgcaaaattgtgaccagcaggagggcctttggggcagggtaaattgtgtagaaaaaggcacagcagctagattcttagaatagtgaaggagctttgaagaaagagcttggagacctatcctaaaatacagcgtaaactcctctcaccgacgttagagctttgacacagggccccagtaacgcggagtagtcacgggagtagtagtggtagaaataagagctaatatttaaaagccaatggtggtttcagagtaggagtgatcacaggatcaacactcagatttaggaagacttgtaatcccccaatacaatgaaggctggaagggtgtggaggaggggagcagatagaagaagaaagatgtgttggtacactcatttattggcacttggcacttgtgcatctttacaagccagttttcttttttctttttgttttttctgagatggagtctcactctgttgcccaggctggagtgcaatataccacgatctccactcactgcaacctttgcctcctgggttcaagcaatcctctcaccacagactcctgagtagctggaattacaggtgtgtgccaccatgcccagctattttttgtatttttactagagatggaatttcaccatgttggccaggctggtctcgaaatcctgacctcaagtgatctgcccgcctcgtcctcccaaaatgctgagattacaggcaggagccaccgcgcccagcccagttttcttatttaattcaatgaattctctctattcaaagaacaatatccagttgctgctgttgtggttacttaaatttccacgtgcaaaacaaaacaaatgaacacccaactagtctgcactgcagccagtgaatcaaagcatgtcctcagttgtcataacatctcacagaaggaaacaggattactatgtaacaaataatttggccaatacaacttaaatgatcaaatacgccagttttgatcaactcattttttcccctctttctgtactgatacaacctttttcaagagatgaatacaccacaaaacctgtaccaagtcatgctctgcacgggactgggaacatagtaagaaacttttcattgcctgtgaagtaggaaaggcaatcactgttgaattgcaataacctcagaattataagggaccaggagttattccagtccctgcaactggataaccagccaggggtaacagctgaagcttcttttattaaggattccctctactaaggactcccttttattaaggactcatctttccatgacatagaccttactgtttatctttgacgggagagctgtacaggcttgtcgaaacctcactgacataggcaacagagggagatgggaagaagctggaattcgggggattacattaaaagaaactgatgtagggccaattcagtgtccaaaatgttgtggaaaactgtcttttttttttttttttttttgagggtatggcggggagagagtcttactctgtcttccaggctggagtgcagtgacacaatcatagctcactgccacctcaaactcctgggttcaggtgagcctcccgcctcagcctcctgagtagctgggaccacaggtatgcactaccacgcatcactaattacttttttatttgctgtagagacaaagtcttgctatgttgcttagggtggccttgaactcctggatttaagcaatcatcacatctcagcctctcaaagtgctgggattacaggcatatgccactttgcctggactgagaactaagtcttgctgtgggatgacatcaagctctcaggacatctaggcagagggcagagaaccgaagcagcgaggggatcccctaagaaggtaccatattagagtcagatcagtaagccaaattcaagctcctggtgattcagaacaagattctgtgggattgagaaacagggtgcagcaccctaagggaagggaatggcaagagctcattcatagaggatttcagagttacagccgaaggtgccagtcctaatggggaactggaatgttgagccggggaggcggacagaagtagctgtagtttgtgggccaataaagtgtgtgggaagctgtaactccacaggcatacagatgacagtactcaacccaagcaaaacagaaatgcaatctaaaacagcaaatgaatgctttacccagcaaggtaggtgattctgacgttaccaacaaaccactttccttggtctggaccagcagtagagaggaaaaggggagcaccaccacccaaacagagtaatactctttatattttgtacattgcatttatactttgtacattacaagtacagcaatgagacaggggataggcacccagacgttaccaaatgtgatttcaggtttactttgcatgcagcagcatttctttctctgcattttccaaatgttctacaataaacagtatttgtttcataaataaaataaatagaaaaaaatcaaaaaaatatgattttatactcttattgctgaagagaagagttacagaaagcagaatgaatgctttagtttcaagaaaatacatccctggtttcactgaccttggaaagtctactctgtttctaaatgacaatgtcttccagaccagaggccagggtaggcaggagagaagggagaggcaaaaggactaggaaaaggtgagaaagaaagagtgaagcattgttcaacaatctgtgcaaacaattggaaaaataacttgccaaaaatattttttaagaagaaggtgcaaaacttaactggataattattaataatagtccatggtgtataagttacagctgggaaacaagtttatggactgctagtacaggcatttagatgacccagtttcaaggtgatagagctcaggagtctaacaagatgaatttcaaggtcacagaaacaattgattacacagcaatcaatgcattgaactcataaagaaagggaattaggcaactctacaaggatttgaactcctggttctgtatggggaaatattttaaagtccatacttcatccatgaagtcattttcctttccagttggtgaaaccctaaaggcattctgtaaaattgtaagactacagtgtccaagccattatataaaaacaatcagcctcatcaagctcactttaacaatgcctttttgaaagggagttttgctttgggtttcgaaagcaatgatgttcctgaaatagtgggaaggaaaacttgcagtagagttagaggcgataatttgcatcaggagactaaaatacataaccctttatgttaaagggtagctgccaacagatgtagccaaagaatcctacatttgtttaaaacaagtgttaaaattaattgattttttagaatgaaaagaaaggctttgatggcaaaaaaccttgagaaagtaaaactttaaaagaagttttctcacatgcaagtgctaatgagtaaaactacctccactttggagttcatttcattaatgagtattgcatggaaattaacatataatgatcctatatgtatgctctttctcgttatgtttgtttcaagctcaggaagcatgtgtctcaaaactgagcctttttcagtatgtactgaagcttttctaaaaaatgcatatttttcaacttggcaattatttgaaaataattaaggctacattttaaaactttggccaaggatattaagggcaacattattgaaagcatcaaactgaaagcatcttaaatgtccaacaatagaggatagttgaagaaactgtggtacattcaggcaacagaaaactctgtagccattaaaaataatgttatgaagttatatttattgatctgaaaagattttatgatcatgctccatgatcattaactcattttgtggtgtatatgtgtacatcaaagaaagtctggaagcataaaaagcaaaataagtgtggctctcattatgtggtaagcttatagatgattttgcctatctttatacttgcctgtattccgcatttttatacatacaaaattaatttgcgattttttactaaacctgataaccttatgataaataagttcgcttcaacatggctctaagccatatttagttaccttactaagaaaggctttctatgctgtacttagcagctacgcacacaataaaaccacagtacaattaataataaatctgattatgttaaagtctagtgaaatattaatcagctaaaacacatagatgattgatagatataatatgatctccatttcacaaacaaggaatacagggcttagaaggataaagtgacttctacaagattcacacatccagaaaagtcctggtcacgggggtggaagctttaggatgccatgtatcttcatctgttcgggctgctataataaaatatcataaactgggtaacttataaataacagaaatttatttttcacggttctggaggctggaaagtacgagatcaaagcaaagtcagtgtctgatgagggctcgatttctggctcctagacagtgccttcttgctatatcctgacatggtaaaggggactagctagctctctggggtcccttttataaggacattaatcatattcatgagggctccactctcatgacctaaacgccaaccaaaggccctacttcctaataccatcaccttggtggttaagatttcaacatataaattcgaagggggcataaatattcagatcatcgtaccaagctacactgttatcacaagaaacccacacaggtgtgaacacagaaaccttgatacaaaggctaagtcttatagatctgccacatattcacaacctttcattttttcatgttttatttatttacttttttttgagatggaggctcactctatcacccaggctggagtgcaatggcactatctcagctcactgcaacctccacctcccagattcaagcaattctcctgcctcagcctcccaagtagctgggattacaggcatgcaccaccaggccctactaatttttgtatttttagtagagatggggtttcaacattttggccaggctggtctcgaactcctgacctcaggtgatccacgcgtatcggcctcccaaagtgctgccattacaggccaccacgctacaggctacaggcttgttcacaaccttttatgaaaaaagaagaaatacatgaatgtggggggaatgaattgtatcccccctccaaaatgtatatgttgaagccctaaccccacaatgtgactatatttggagacagagcctatgaggagtgaataaaagttaaatgaaatcataaaggtgagatcttattctgataaggctagtacccttacaagaaaaggaagagaccccagagattgctctctcgactctaccctaaagaaaaaagaccacgtgaggacagagtgagaaggcagcctgctacaagccacgaaagaggcctcactaaaaaccaaccctgatgaacccttgatcatgagccttcagcctccagaactgtgagaaaataaattgctgttgtttaagcctcccagtctgtagtattgtattttttgttatgccagcctgaactgactgataagtctcccaaaggtatcaatctaaataaagcctctcaaaacttgcttttctacaaagtcaaattcagaattacaaagcaaataaaaaggtatggccgggcgcggtggctcacgcctttaatcccagcactttgggagaccgaggtgggcggatcacgaggtcgaggtgggcggatcacgaggtcgggagatcgagaccttcctggctaacatggtgaaactccgtctctactaaaaacacaaaaaattagccaggcgtggtggcaggtacctatagtcccagctactcaggaggctgaggcaggagaatggtgtgaacccaggaggcggaggttgcagtgagccgagactgcaccactgcactccagcctgggcgacagagcaagactccatcttaaaaaaaacaaaaaacaaaacaaaacaaaaggtgaccaccctcctttcctggatcagtactctcagccgtttatatattctactttcagcaagtataaattaaactgaccttctatcctgccatgccaaacccctaccccttaaaaattacctcctcctcaaggattttctgaaactaaggatggaataaccatgcaccaatagatcaagcctaaaacttagaagttacagctttccctgtcactcatcccctaaaccccaatggccactgtatccattggtgggctcccggcagtacacacattcacatacacacaccacccgcacacaatgtgtccctcttctgttgacctggaatgcacttgcttaatccacaagattctacacttaaaggccatgtcaggcatttttgcctttccattgtctgagcagatgcttaggaaaggtttatagttgaaagtcaactgctgttcaacattgtttaattttccaaaaaccttcctttatacctcatccccagcaggactcagcatctccctcccccagggctttacctgaacttagttataacatattacaatcatttttctaggtctgcccatcaccttagactgtgaactcttgcaaagcaacagttcagggaaaggcatggagacctcagaatgtactggcatagacacgatatatccaggcattcaagcctatatggggatgggggagggggcagctgaaaccccagtgattgtggtgagggaacaagtttgatctaattccgaaggcttaagttgggagtaggtttgggtatatgagacttcactcctcaaggcctccttcaaagatacacagatgcaactttgccttcggctgcccatgtgttttctgagcttattctacctttaacactaccaagaaagtaagactcaaaaaatccggaattaaagcaccagtctttaatatttattatatacttttttcttttttatttttatcagttttcttttatttccttttttcccctccacctcttcccatctgatatttattatatattttattaatttaagcctcagtttcctcatctgtaaagtgagaagcatgaactaactaaaggatttctaaggtccttcccatttaaatattctccaaggctataaagagagatttttttgcttcactaagctatggcttagaagaggctttccctctgcctctgtcagtgactcaaactgttctatcttgccataaggctgagaaaagacaataaagaaccatttaagatgtccccattgtttatagtactataaagaaatcttttggaaaaacaactactcaccctgggcaaacatcgtgtttcatatgtgaaatacttgtatatagatagctagtctgcctgttaaaataatgctgcctcctgtattaattagggttgtgttacaagaaacagaaaatctgactctgaatagctaagaggctaaaaaaataaaaggggggggacaaatttttgtggctatcataattcaggatatactggctctactgagctgaaaggtgagtcatttccactgaagccacaggtagcaatacaacaggggaaggtgagaaagtacttgtggatgctacaggaagtgacaagtacctccaacagcaattgcttcttccatcttttttcccttttcttcttattacttaaatggattgctttccaaataggttggttcattgccattgttttattctgtaaacgtttaacaaatattctacctgaatcagctaaaaatcacatacccaacatttagattattaaaagttcattctcattttaagattgattttccttctaaatctctctagatttattacagaagcattagagaaatccaaaacttctcatttggttaagctgtcctcctgctaagatgagatgatgttctgtcttttctcaagttgggtctatgcttgtaacttcccaattacttaagttgaaaagaaaagggatcatctgtttctgctgtgatacagagtcaaaataaaaataatttgcccagtaatatactctttgacaaggtctccagccttgcagctgcattttgctctttgtaaggccgttcaaaataacacaagggccacccattggcaggtgaatatctgaaaaatgttagaataattacggggcactcttaacaagtcaatcactcaggcatttttaaatactcttctcaccttatataagaatgcaaggcactgggggaaagtttctttctaacagttctcaagtgtgtaagctggagccagtctatctgggttcaaattgtcaagcagtatacatggccaaacacatccatcatttcgtgccctggcctttccatgtgtaaaaatggggataataacagtacctgacttacaaggctgtttaaggatgaaataaattaaaactggtagagcacttggctgatggtcatcattccagatacttttgtgaaacgttaataatttcttcccaaagatatttcctatcttcttcaatttgtgtttattgagtgatatagtttggatgtttctcccctccaaatctcatgttgaaatgtgattcccagtgttggaggtggggcctggtgggaggtgatcggatcatgggggcagatctttcatgaatgggttagcaccatcctcttggtgatgactgagttctccctcagttagttcacacagatctggttgtttaaaagggtctgggacaaattagccaggcgtggcgccgcatgcctgtagtcccagctacttgggaggctgaggcaggggaatcgcttgaactggggaggtgaaggttgcagtgagccaagatcacagatcgcaccactgcactccagcctggcgacagagcgagagtccgtctcaaaaaaaaaaaaagagtctgggacgttgtccttctctctctcactcccactctcaccatgtgaatgcctgttcgcctttgccttgggacatgagtaaaagcttcctgaggcctcaccagaagccaagcagttgctgaggccatgctttctgtacagcctgcagaaccatgagacaattaaaccactttttttttttaataaatcacccattctcaggtctttctttatagcaatacaagaacagactaatacatggaggaaacatgatattgattttgaaatattatgacgtactcttagatttagggaaaataaaaataagaaagagagatggctagctgggattgttggaagagcttctccatcttttctatgttacaagatcttagacctagattgtctacccaaggatatatgaaatacccaaagcagagtactcaacattctatcttagaatcttagtaacctcatagtctagaagttcataattgagattagcatccatcccaggacatttcaaaatgcaagggcaggttttggcctgtcaaaatgactgaggacgacaccaggatttaccgctcagggactactagggctactaaattctctataactccggtagtcccagccacttgggagtcctgtaaaactccattcttcatggagtttcactgaatgaagaatcatcctgtccaaaatgccagtggtgctccttttaagaaacacaggacctccaatctttcactgttaggtaccctggggtcatgcagccaatgtgaacacatccaaaaaatatgcctcaaaaagcatcacactctactcttgcctagttcaaaatgctaaacagttcttctttatactgagccagtgaatgtttgtcctctggtcttcatcctgcctgctgtggcccacagaatttgtgtggttatgtgaaaaatgaaactttccaatcctcaaaaccaatgtaaagtatttacaaattgctgtgtcaaagttgctgatctaaggagcaccagatgtgtctccaaacagttatttcttggtctctctctctcattcttgctctcactttcactctcccctctctctctggctgttggtctctcaataaaaaggagagtaaagcaccacagctcagagaggctgcatccacattcactctgcagtgaaaagtagcttcccctaatgggatattaagtattttctcaaccagaattctcattggcagccagggctcctgattaaagagtagctctaccatgcctatgaactaactgagtttaacaaacccattacctttaattcgcatgtttaagatctacacaaagcccaaagccgggcgcagtggctcacatggctcacgcctgtaatcccagcactttggggggcccaggcaggcagattgcctgaggtcaagagttcgagactagcctggtcaacatggtgaaaccccatctctactaaaaatactaaaaaaaattagccagtcatggtggcatgtgcctgtaatcccagctactcgggaggctgaggcaggggaattgcttgaaccagggatggggaggttgcagtgagccaagatagcaccagcctgggcagcagagtgagactccatctcaaacaaacaaacaaacaaacaaaaactacacaagtaatgagaaatttcaataatgtaattatggatgagagcaatgtgtcatctttgctgttcaccgtaaaagaaacagaggctaaaaagataccaaatcaaagaacttatccactacgctgggctggaaaatctacatatgtgatttgaaaagcaactgaacaaggtctgagagatagtttctttgttgtggttattttactttttattaaagtctagcaaatatagagaaaagtgccccaattcaaagtgcacagtccagagccagtgttaatggtggaatctttcaaatttgcaaagaaaagatagttctcatgcacattaacattctacagtgctaattttttaatgtaaaactattttaattttataaatcaattatagtaccaaaacctgatgaggaaaggggagagagagagagagagagagagagagagagagagaatgtagactaatgtcacctggatatttattagaaattcaaaataaacaataaaaattgtgacacttactgaacacttaatagacaccatttccttgttgagacttagatatattatcttatttaacactaagtatacccatgcaataggtatcattattcccattttatagaagagaaagccaaattactaaagtttactaactagcccatagtcacatagtgagtggcagagctgagattaaaattcagttggtattccaaagttctggctcctaatcactgttttcaattaacaaactgaattcaaaagaatttgtcaaaattcactgctatctaataaggcttttttttttctacaaatgcaaagagagtttatggtttatcacgagaaaaaatctactaatatattagatctcataaatacaaaatacaacaaaccaaaaaagcaacataaccaagataaatatgtaaatttaacaaaattcaacattcactcctctgagaagtgtttaaaattaatatgatattaagaaaatagatctgatattatagttaagttatatccattaaaattggtcataaggatgttcacaatctaccctattatttattattggtctgaaaattctgaccaatgttgtaatataaaagtttgaaataagaggcttaattttttaaataagagaaaaatacatatatgattgtttgcaatggaaactatttgctctctagaaaactccggagaattaactgaaaacttattagtattcacaagatagttcaataagaagattggatgtaagataaacatacaaaaatcaatagctttcctgtagatcagtgataaccagctagaagatataattgaaaatattggaaaaactcaatgggttgtgttttctaatcactatctcttgtagaagtcaacaatcctttttggggaggggttctttttagtgtatctagttttcaaagttgcaataaaagttatgattttcatacggtaaaacattacttctcttcagtaaaagattttatggttctctagaagaaagatctaacaatgctttttaaaaagttttagtacaattgctgaaattatagtgtaggattcttgtcatattcagtaaccatttaaaattattgaaaaagttgtagctccaacatgttgtacaagagaatcccagaatcatgtatgaaggctagaataaattaggtacttgggcttattttagttaagtacactagccattctttatcctatggaggaaaacttccaaaagtcagatcatttgagaccattcagtggttgattccaaatcttttaaagacgcttttcattcatgcaaagataatgttttcacttctccatcaacatgagtttttttttcttacaaaaacaaccacactcttaccttggtttagtgtatcagtgctaattttaaactctaggatacaagcagagaggcaattctaaaagaaagggtttgaaaaagaaacctgaatattcatatattactttcaactgcacttctttgctggcacctccttaaagaacacagtaatgaaatctcaatctctcccattagttaattagtacctttgcaccctaaggactggaagcattacattgttaattatctacaagtccacgctcaaaaaccagaggctgcttatgtcttctttttcttatgcataggtctacacaacccctaaaaaaataaacaagcctatcaaacattcttctctaagcacaggctaaatattacaaaatggagtgccctaacagctaaaggtgaattcagtcaactagtgcccttgtattgatctcttatgtcacccaacacttttcttctaatcctctccataattacatgaacggctaaagctttcctgaagctgtcaattcctcttgcatccattttcaaatggccagcggagaagcgatctgggcactagatcaagctgtcaatgttccccacttgggctactgacagtcctcttgaagcctcctggcacctctgtcaagggcctcctagggttcttcaaaactcttctcccttggaagagtgcgaggagggtaaaggagccagaaaggtattgatccattcttttaacatgttaatttgcctggggctgcttcagccattgccaggctgggcacttcaaaaggaaactgtttttcaaagtggagatgtcttttttaaacacttaaatctgaaaacaaatgaatccaagcctcaagttcacagtgcaaagcaagagaggttggccaaacacaaacaggatagctaatatgtagaaagatgtcctaaaattaattgatgaattttgatcgagaaatttgatcgagtattttaaatgtctaaagcctgtgaatgcatcataaccaattaagatgcaacctatttagtaacattagtctatggaagaaaaattaaggctgatataattaaactgatgtaaaacattaataacattgatattgatgaatacttgggcctctccataagtgatgaaaatggaaaataaaactgattgttcatttaattgcacctctaactggcaacacatcatgaggctagacaagaaaaaggaggggttggggaattgccacattataaaagtatctttgtttactgcctttgttatcagtttattatttcatcagtgaaacatacagtagggataagactacaagacataattaagggcctaaagattgcaaagtattaccatattcagtttgtaaaattcattcatcaaaagcaataatttgcttgtagttttcagctcaggtatttctggggatagttagttgcgaacggttattaaaggaagaagtcacataaaagagacagctgcgatcctaatgaagaatccactgtggaaagcaatagctgggaaacgtgaagtcttaaatcagggaagttcttaaggacaaaagcccaagagaaaaagcattcctaactgagctgagtcttaactgatcatgaggttggcccatatttacctgccatggtattataggaggaaatcagtattctgttaacctctgacccctcagatctgaagcagacaaaggcccaatctggagccctgggagaacatagccaaatgtcaaacagcagggaagcgattgttacagaaacatttggcttgggcacaggcagcttcattggggcaaactgctattcacagaaacaagccatgaagagataacgccataaaatatgaacaacatggaacctttttcgccttgcttctaaattgttagctttatgggacttcaagctgaacagtatgaaaaaaatccaatttgctttgaagcgcattagtctgtctaacatcctaattattgtttacattgccatttgccttctattaagaattgaataattacccagcacttcatagtttaaaaatacaagcaaacaggattatctgggtaattaagaaactgtaccacagctttgtactggtgcagaaaatatctgtaaacggaagggaaatgataattatcaatcaacttacttcaaatggtattttaaggattttgagcaatttgagatctgtaacttattaagaagaggttagtaagatcacctttgagaagtgtgggtctgtttaaatccatcctgagaaacaagagccagataagcagctgaattttctcatccgctaatgacaccagggaacacaccatgtacagagagcattctgctgctctttaatcctaataatccatcccaaatggactttgaacagcatcatcaaactttgtcagaccatgtggagcaaaaccaaagctcttccacatttagatgttgttttaactgactttgcttttacttaattagactgcaacgtctagctatgcccattttctgctctgtgaaattagtttgaactcaagtctaattgaacttcaaaaacatttcatgcaaagtcctcttcttctagtttatagaatgcatatatgatcgtggcctttcagaagatagtgctggtttcaaccagagttaagtttgttgggtaaaatatgcagtacgcttgccttcccattctagaaggaataaaggtaaggttaaaaaataagtaaatttggagacactggggggagtggggaggagggagacagaaacaaaagacaatattcaacaaaaagtgaatccacaaatataataagaaacagaattatagtcaatacacattttaaagaattttatctggggacataagtgaaaatatgaaattttaattgtgattctaggtatgaagattgatgtattcgttcatagatgaagaaacacagatgaaaatcccagtggtgatttgtacatcatagactttaaatatctactcactgatggcatgaatggactccagcccattagtgacctaaggcctattttcagaacttcctgagctctgacaattctttttcaaagaattgtatcttttactttacaattttttaaagccctttgttgggacacatctgaacattcctagcataatctgaatagtgccatcccctcccacctcagaaagaacagcaagattccagctgaagctgtcactaaacagacaagccaagggattcaccaaggctgggttccttttccaaaggtcaaaatgaaatgagcagcagggacttgggttattttgcatggggcaggggggccggagagtgacaaccagccacactgggggcagaggtgcataaaaagagccctgtgcaaatagtctcctctctgcctcccacccctgatctctggaagcattcaaatcaaaaccgaattaatttgcatggtgtctaaatcattgggctctgcataaacagaaggagattttggctggggtttccaaaggaagccctcattgcctttgtgaaagggggaaatgggtgtgctgttttgcatgaggacgaatacagaatatgcaaatgaagaatctgctgcctggaactgcagggctgggcagacagctgacgacctgcattcacccagaaaaggctgaggtctccaaagggagttgtaagcagtaccaacatgtgtgtttcccaggaaaaagaaatagaccctgaatattcataaaatgttcatttagtcatgggattcttaattaccctccagatcatggaaccaagtgacctcacctgttctcctccccaaaacagctcagaggtaccagctgtaacaggatacagggagaaagcttttatgccttaagtgagatacagtctctcggggtacaggggacagctgaggccttctttaatcattccttctcacgagcacagtaaaactaaagggagcactgagccatgttattggacacagataaccagtttttaaaaagccaagagctataaattgctgcctaattttatagaaatgtctaaagggttgagtaaataaaatgtcattcttctaaactacctaagtctcccagattatgaaaaagtttttagggcttgatttcattttcatttttaaagcctctccatgacctgcagaagtgcagtctgtgttaccttccaaagaaactgaaaagtgatggactaggtgcagtagttctcaacattttcggcctcagaaccgaactctcaaacattttatactctcaaaaattattgagaatgttttcgtgtgtgtgagttataactactaatatttaccaatacaaattgaaactgaaaaataaatttttaaattatttttaattcattgaaaaataacaattaacgcattgcatgttaacacaaatagcatattttaaacactgttgtccaaaacaaaagtaaacttagtgagaaaagtgacattgttttactactttctttctttcttttttgagacagagtctcgctgtatcgcccaggctggagtgcagtggtgagatcttggttcaatacaacctccatctcccaggttcaaacgattctcctggctcagcctactgagtagctgggactacaggctcacaccaccatgcccagctaatttttgtattttttttttttttttttttagtagagctggggtttcaacatattggtcttaaactcctgacctcgtgatccacctgcctcagcctcccaaagtgctgggattacaggcgtgagccactgcgcccagtcactacttttttttttcatattcttgaatgtctggcttaatagaggacaaccagattcttttacagtagtctcctcatatccatgatttggctttctgtggttttgcctaccgaaggtacagtacagtaagatatttttgagaaagggatagaaaaaacgatagagagaggctatattcacataatttttattaagatatattgttataattgttctattttattattgttgttggcattctcttactgtgcttaatctataacttaaactttagcataggtacatatgtatagaaaaaacataatgtataagggtttggtactatttgagctttcagcatctattgagggtcttggaacatatcgtccaaagttaaaggggatcactgtatttgcttctgtattcaacttaataacattatcatacatcagttagcttctggaaaactccactgttcactcatgagagaattagaaaaaaaaggcaaataacatcttagtgttattaagaaagttttgaccttgcagaccacatgaaagggtcttggggaacatagctggaccacatggagaaccacagtgacttggggcacagaggattggatcaatgtagacaagaccagccatttggtaccatcgcttcactcttccctgtatttgtcaccattgcctcctcagaagatcaaaaccaaccaaacaaaaaactctctactctggaacctaaatgaaatggtttctttgttggattgatcaaacagcccatattgtcaccatatttctatctaacaacaataaaaataagagtaacaattttcactttctaagcattttaatgattctaggcactgtgccaggccctttatacattcatgcatatatgtgtgtcatatataataagatactattgccaccaatttgcaaacgtgaacttgagtttagggaagctaagttagtgtctacaattgcacatctgattaagtggctcaactccaaaggcagttcttggccattttgtgctaactgtatgttaacttcatgtgctgcagagaattttgaaggttcagatgtaaagaagattcataaacacgatttaaaaaggacccaattgagtagaaatcatgaacaaggacctcattaatacattagtcacatgcaaagattttaacatatcatattgattccatgaaacataactccaccaaataatcgatgttactactttggttatgcctaatgctccccccactgacattctcataaggaagttctactaaattcatatgtccaagataaaggcagaaaaatagcaaagcaaggttaatcattcaatgttttaacaaaaatatacatgtatgattacacattaatgtgttagtttaaaagtattactaggaaatactgagacaacctagatagctaccaataacgaaaacattaaataaagcatggtatacttatactacagaatattcatcttcaatgaaggagaattaagaaaagctatattctctaatatacagcgatatctatgacagtcaagcatcataaaaacaggatgacaattacaaggatgattccatctattattttaaaaatacatgtatatggctatatttgagttgcctgccaaattgtgaaaaatggtaacttgtaaaatgttggagtaagcttttgaaaactgtgtgtgtgtatgtatgggtggatgtgggtgtgtgtgtgtgtgggcagggaatggtagacttacaatttttactttatgtaattctatatgagaaatttatctgacaagcatgcagtcctttgctaatgttaaatttaccaattacccgttcccccaccccccgccattaactagtaaagttcagttatgtgaaagtcaaacttatatcatgaccacccctgctttgcacagcagtaactgaaaaaccacttaagaaggctttttcctagaggctcagatcttaacagaataattatgtgttaattcatttctgaaagatacaaggaagctcagttagactaaaataagtcatcaaatcttgaataccatattcaaaaatccctgagatgatttctatgcgatgttttggtgaaccccaaatagagactattgcatgattcacactcacaaaggcagcctggtcacacaaagaggaaaaaaaaaagtatatcagaaaaaggacaataattaaacgctgctctcttatagataaagaattacattttttcaatgatcacagccatgcttcaaagccggagataaaagcagccatgtgattcaagcaattgattcttaatgatacgattcaaaggtagaggaaaaatttcaacagtgcaaaggatatggaagcagcatctctgtgaagtagattttaaatatttcctttccattacttctttctcctaagctccttctatagtatagttgaaaaaagaaatcattttttttgacatagctctcttcctcttttcagagcacaagtctgtttattttaaaaccattggaacatttctatcttgttctttctttaaaaagcttttaatacgataccttttgttgatatgagtacattttaatactgatgacctcaatatacaacaaaattgtatacttcagcaaggcttgattcttacctagcttaattttgtcatagttgtaatcatttggccttaagagtgactccaaaagaatgtttttattggtattattttttatatgtatgctctgaaaactgctgattagtatttcccaaagagaaaatctggagctctcctttcatttttcagctttttaattaagcaaaaaatacactaataacgaatctttttggctgggtgaggtggctcacacctgtaatcccagcactttgagaggctgaggtaggatcacttgaggccaggagttcaagaccagcctaggcaacagagtgagacttcatctcttatgttaaaaaacaaataataaaaaataaattaaaaaaaaatttaatggaatattttcctctcttccttctgcttactatttctaaagtaatgaaaacagtcctgtaaaacatctggaacatttcttcattaggggtatgtctgtccggaaggagatgtctgaagtggattttgtttcctttttccaacagtctgatgtggcctggaagcaggactaactagaatcattatattatcctctgcatccaatcactaggcaagttcaaagggctgctaactcctgcgatacattctccttgagaagatgggtaagtagctcatacacattgttgttctactgagaccaagccaaatcatttcagaaaatgttattcaagagcagaatgaacttgcctctgcttcagagggcaaagccaccatccccctgccctcatccttcctctccattagcatgtactgctgggggtaggaactgcaagaggaagtgtagttctgtccccaaggtcctttgacgactcagtggatgatcagggttagagtcaaacaacagcacaccccaggcccccgcccgccctgcccatttttgcccaaggatcctttgtcaaacatttaagatcttaatcaatcttccctctgacctcccggaccccaaggaagatggatgaggaagtaggtgacctttcacctgttcttctatttgtcctgccacagtagaaccattgaaaagacaattggggaggaaactgctgccagagttctgaagacttggccagttttcctttatattccttcttaagctttctttacaccctctttcttgtcctacccacaagtcactttttgctcgttcaaaggaagtttctctttcctatcgaggaggaaaaaaaaatgacatactccatataatattttcaatacaaagtgtgaaaacgtatattattatttgttagggcaaaggagagagatgcttcctatctttagccttgatatcaaggagtggtcaggggatggattttccttctactatttcaactcaacgctcttaaaagtcaatagctatgaccttgggaagagcacaatgacaacagaaatgctagtatcaagttgttgcatgatctctgaggtgacttttaccaatcttacaaccccaagtcctcattgcaagtctgtaaactaaatataactattatcatcccattttatggatgaacaaaccaaggctcacagggcttaagaaacatgctcaaggtcatctagctaagtgaccaaattcatacatctttcctcgtctctatattatttccactgtgcctgggtgctactcttgatgcctatcatgatatcaaggatagggccaactgtttttattattcctaagacttttagagtctcaagtcatcttttaaaagtctcactctggctgggcgcggtggctcacgcctgtaatcccagcactttgggaggccaaggcgggtggatcacgaggtcaggagatggagaccatcctggctaacacggtgaaaccccgtctctactaaaaatacaaaaaattagccaggcgtggtggcgggcgcctgtagtcccagctacttgggaggctgaggcaggagaatggagtgaacccgggaggcagagcttgcagtgagccaagatcgcgccactgcactccagcctgggcgatggagctagactccatctcaaaataaataaataaataaataaataaataaagtctcactcaagcttggaatcctttgtcattcaagttttttcttacctaactacatcagaaatttttacatggcaataacagaaacaaacaaccaaagtgcaaggtcttgtgcaaaaagtgtcttgaaagagttaatcattttattagcagaaaaaaaagcaaaataacaaaaacaaaaaacaaaaacaaacttggttgacacacctgaaaacactgaagtttctcaaaaacgactcaatccacctgcttctgctgtgaaatatctggcctcatgttaggaacagcttgctcggaagtggactagatttgaaaccctaaattcctccccttcgaggacgcacgtgattaactggatcccccaagactatttccataaagcaaaccagaaaaatgttcgattgcttttatattcactttgcccaccatctttttctcttttctttctaattttggttgtaaaaatgtcaaggagtttcacaatgtagcaatgtatgagttactaggctctgtgacaattgaaaatcaatgacattagatacacgaagatgtgctaatgctgagagtgaacattttagcaggaaatggaagccaatgttgtttttttaaaaatatatataagaatcttgacatgtgaagatgtgcggctcctgtcttacaaaacggaaaaggcagaataatttactctaaaatgtgatggcatgtcattgccctgctcatttcactgttcctgctatgatcatagtaatttagttgccagtaacaatgcactcacatattttcttatattaataccagaatatactttgggttaccaattcagtacagcttatctagtagttgctaagtcaagagcaaaccaaaaatcgaggccttaatctttattttaaaaatccttaaattccaacttgtaaacttttaaatttacacatttcctttttttttttttgaatttttaacactgagtcaacagaaaagatagccactcttttttctatttaccacaaaatgaaagaacattcactgttagttactcctagaaataactatagctaagcaggaatgccacttcagacaagtgtaaactatgaatggagtaacgtgtaactttatgacaccaaatcaccaaaaaatgcaattttcttcatgttctaactggattttcagtcaatcaagtggattgccccatagttaatcccaccctgtcattagaatggttgaaatgccagacaaattgtttggcagtcagttaattcaggccctttaaccaccaaatcagatgaaccatgtggcaatgccatctacagctcaacaattacccagagaaaagattaatctgattgttccatagatgagaccagaattacattctaactattttgtagtaaccataatggattggcagccgcagactgttgataactacattataaaaacaagtatcaagcaagacaaaaacttggaataaaagatatttttgagccttatttcacacatgacaaacaatctgtataaataggaattactctcatctcttactcagatataaactttctgtaaagcaaaggactttatacactccccagtattctgacaggaaggggtaaaaaagcaagaatcaactgcatacactgaacctgaggtgagaaaaaaaaatccacttagtaatatggtaagtagtaattaatgtgataaaaatacatagatttcttcaaaaactcaataactgaaatcaataccaaattgggtcacaatttgctattgcttctgaccacagatcaaataagaagactcttgcttgcttaattaccacctcctaagagaaataaagaggtctttcatcaagattaatttcatttagagaacccatcggtgggtgttcagggaacagaatgtacttgaagcaatgtccctccactttgttgggtcatatctccaccggtccacaaggcagaaagaaaaaatggactttcttcactcgattttagtcagtgggagggaactggaacaacttaatcctaatttcacatttagatcattcacgcacttatgcagaagacgggagatatttaacaatctttgtcattttaccaagtccatagacaggaaaactatggctcaaaaatgtgtccgccctctttaagtaaggatcaatcaaggctgtttcttcagcttgttcatttacatttcagagggcgcatcaagccagttcagatataagtgcctgttagcaaatgtgtttggctttctgctgattacagcagcatcatttattttgtcagtattagaaacgtcttagctttgccacctggagctatagcacttactcattagacccctgtgtcccaccacatcccacaggggctactaattactggctttactccatttagtctcatctctgatttaattactcgcactaagccccagtgaaaaaactgcaatatggaccctcttaccttggcattctccgctccgctcctcatgcccagcgttgcataggcagttgccaatgggtaccagccattcaccatctgccccacagtacatttttggcacatctttctcttctgagttgttgacacaggagcctcgaacttccaccagggaagacgtatcagcccctgtgatggtgtcaggaaactgggccagattgcggactgtgagtggacactttttatagaacacacggactgataccagggcgatgcaggcccccacatcctgaaaagccaggtaaaacccctttttgcttaatggccctacatcccggatctcggtgttcagcttcatgattctgtcaccaatgtccacttgggtgaagctctcatcagcagcaatggtgtcaattttgacaaactggttctctctgatgaaacgctctttgtcgttgtctgattcatagtagtacaggttaaacgtctccttgcaagtccccatgacgcccggaagactattgcagtccctcaaggtgaatttaatctcaatatacaccctctgagccccttctcgggtgatccaatcagttcgtagccagttattctggctgggttccatcacattgcacacttggtaggttcggattggtgtatttttttcatccatgatactcacttcctcccactgcaaagatccaaagcagatgtatcaactacaaagtttcatcatgcagtgatttgtcaatcccattttattctcataggacacctgattatttttctttcaataatgaagcaaactactgagcaccaatcatcactaataaaggatcttatgggagataagacaatattttattgaggaagttttttttttgtttgtttaattgtttcaatcttttgcctgaaatccagaggcaatggtggatttactgcttgtgagttctcggcagttccttgtggtggtccaacaacctcaaattcacctattacaacagctacaatttcaagtggcaacagttcaaatttactcataaaggaaaaactagtatgggtattgtttcaaccactgagcagagacctgcaaattaagggcaggaagagcagagcttgccaaaggaagacaattatcagttaattagtagtgctcctgtcagaactttgctctctaatacctcaaaaaaaaaaaaaaaaaaaaaaaaggcaattgatttttttggcaccctcactactctttaaaggtgaaaagaaaatcccaccattctggtttcagtaatcctaggaagacagggagtaaattttatggctggatttctcaaatatgctatcatttataacagtagacaacttttcaagactgtgtattcaattaaaaaatttgtacatgttctcatttttaaaacatagacaaataacaaaactagaaaacagacatgctttgcttctaactcttccgtggacattaaaaataaaatagcaagtgctgtttatgactgaaggcccaagaaaatgaaaggagatggtagcattttctttgcattccacttcctaacacaaagaatctaatggtaggacaacttgcgtctaccactgtgactaaaagtttcactgtcattatagcttttaaaaataatccgaaaagcagcaaaacttttgggactcctactaagctggtaggcagcctcaaattcttcattaacatctacagtaatgcattgatacagatctgttataaatcagcttaagtatttaacaaacatatgaatataattagaaggaacaagagatagtttttttaaaaaattgtattctgtaatagctccaggtaaagctccatgcagtccagtgaagtgcatagaatcataatgtatcttttaataggtttcccaactatgcactggcaaactcttaatggatggaaatgttactatgtgaaggaccataagccataaaattctgtatccttttcatctgccaccattataaaagttgaaactaggagggggtaagtgccctgtggtgatgaaaatttctttttatccagtaagcaataaaatcaccagtaatttacttattttaggaaattcatgtaaatccaaaaatagattcccatcttcaaaaacacctactcagcatgcttctcttctcagaacaatgggaatttggaaaaacacatttgtcaatgaaggcacatagggtatctctacagagttcatgcaggataattcaggtctaatatgaactttgcagcctgaacgtaattgtctaaccacactgatcaattcactggaacagtgacaaatcctcccttagttttatatttcacagtcagtgtcagcaactcaatatactcttttaagtgaatattaccaagaaagtagcttttggctacaacgatgttatcaggagccatcactttccctaattctcatgtcttgcttagttgttcttatagacaaacaatggattgtctctgattctaatttatattttccttggtggtattgtcaaatcaagttgtttttttttctttttaaacataacaacaagaaataaatgtcattatcagaccaaattactatctcaagttaacagtgaataaagacattaaatgtcctaactgcaagcagagattttagaatgatcaagactcaatatgcttttactctcagctagaaagaactttttaaagacaatcaatccattcctcattgacagatacccaattcattcctttgctctaatcctgaaaaagtcctcgtcaattataaaatctagaaattaattaaactttataacttgacacaatttctcaatggctactgtgtattttggaatgactaattcttttatatacaaataaaattatttatcttacaataatgcttaaaatgttacatgcctaatatttaaggaaaagaaaaaaaaacctgcttatatccagcccattaaaagtactgggtcgtatacagtcagctctgcatagttttaaatagacctcaagtcaaccaagataagttttgtgtctagaaaaagtgaccaggtgctctttcagcagctctggagaagaagaagaaggagaagaagaagagggagaagaagaagaaggagaagaaggagaaggagaagaaggagaaggagaaggagaagaagaagaagaagaagaaggagaaggagaaggagaaggagaaggagaaggagaaggagaaggagaaggagaaggagaaggagaaggagaaggagaaggggaagaggaagaggaagaagaagaagaagaagaagaagaagaagaagaagaagaaaaaaatgtctgcagcatattaaattgcaataaaagctttccagaaactagatagactatggactgtaccctaaaatgtgtcagtccttgctgtcatatagctcacacatatatttagtgaaacaagtcaggttcaaaatttgattagatgtatatactctcttcaaacttaaaagcagccagtaagaaaaataaggctcactgaatttattaatacaagtactgacactttccatccttaattttaccagcagttctaatacattttaacctaccaagcaatacccctggtacatgtagcctgggaaagcctcgcctgaatcagtgacctttccagggtataggattaacaatgagtctgactctcaccaagataaagccgtacctttcttcacattcaaaggatgagggcaattgcctgcaatcagtggtgaatacagcctgtctacactgccagaggcctgccaatcactcctccctcctttaaaaagatggttttaagggcagactggaatttttcaggagagaacaaaccaatggcagtcaagttcaggcagaaaaaataggaagacagggcaatctgttttatttcaggtggattacaaaatctgtttgcaacaagacagcctaaaattctccattttcatgattattttcttgcttagtcttagttctgaaatatgtccttgatagcagactctatgaatctttaatttaaaatccttcattctttattcaatggaccggtgtggagcccacgccaggttctagcattacaatttttgcctagtaaaaactcctaatctttcacccccattgtttttaatcaatggactcagccataaactatcaagcctgtgaaggtaggatgatttgtttaattttaaaaggatttgagagttatttcagtttggcagaagtcagttacatgttgtactgttttctttccaaagctgattcattctgactggttatttagggggagtaggagaatgtggccgttgacctagtaagatggaggcagtaatgacaagtattacaaatttgagaataaatgaagtgatgcttttttcagaccttataatccagactactcaatccccaaagattcttcaagattacagacacataaacttttcatatttagcaccattaatacacaggcttagggttttttggacacaagttcacatgactgtctctcagtgtgcaaaagaacagcagctgatttaagagtgagagcaaggtacagagccttcctgcagttcatgcaggtacaattagaaatgtcttctctctcatatctttatttattctttttttttcatctggaagcaggacaattgctcttaaattaaccttgtcaggacttcatggccatcacagtaataggcataaattctaatttggtccccggatcatatttcctgttggtattttagttttaaataggcatctaagtctgtgcctccaccagtctcctaattttgaaacccctttctgcccttttggtttctagttcttccatgacagagttatccaaagggagtataggatttctccaacaaagcgtaattcacttcataggccacagcggaaatctgaccccctcaccacaatcaacaagaatcaagccattaggactctcagaaagttgctaatcactccttttttaccctttggatcagagagcaactcaggacttacccctccttccagagggcttgctatccacccaagttctccctgaacagatctggaatccaataaggtaactgcaaaaaacaaaagaaaaatagatgaatttccaattgcaaaaagccaataacacaaaaaccatttgcctgagcgtttccatatgtgctgaggctgtgcatatccaacactgatcaaaacctaaacttgggctcacttatgtaaataatcattactcatttgatcttctccccctctttaaatctgcaggttcttatttattcaacttgcttaacatttaaaattccatcctaggactcacttgattcatttttctaaaaaggatgaatagagaatctgaagtacaattcaaaaagataaatacatctatgtagagcagttacactccagagcaaaatctgcattcatctctgtctggtatctactagaattatttgtttttgcaagtttcagatgaccacataactcatcagggtgacagagccacaagtgaattctctcttctatcagagagtatcctatccaaagggtcaggaaaaggctctccctaacattttcccttccacaaccaagtaaatagtccctgaatatggtatccgctgcttttttaaatatcaaagtttcagaaagagggaatgccagacgtgcagaatcagaatgcaaacgtaccgaaagtattctctctttctcaagatgtgttgggggacaatcagagactcgtcttccacccgtaggaaatcactggcttgaattttaggtatggagtgctgcctaacggctttagtgtgcttgtgctacacctgagtgcgtcaaagcttggggggaagggaggacagcccaccgagctgcggtaccccgctcaggctagaagagcgctaggtaaggggaacatccaaagggacgcaatgaattcaaaacctctctttcccaccgagatctgcagtcctgggggtcgaaaggcccacctcaaaggaaccactgggttattaatttgatcagccaggctggctcttcaggctgggggaggggtgggaatgggaagccgccatccgtgctcatgcgcaccccaacactcaagcttacccccagacccctggattctgcccactttccctctcatttcacctcaaagtcaatggagttaaaaatcagtctctttcccctacttttcccggggagtctgaattcctggggtctgttaatgattttaaaatgtagagccttccctgggtcgctcccgcctggagttcccgcccccttccctcctctcctctccccaccgccaacccccaccgcaaccattctcttctctctgtccctagagaaaagcccgctacatccatttggatttatgtaaggtggattagggacacaaaggaaacaataagacccaatttacaaaaaaaggagggagtagaaagggagggtaaaagagagaaaaggaaacgtgatgggaatagaaagcaacaaagtgaattaatttttaagggggaggtgggggaggggaggggaacagacctccctccctccccttcaacattagcctagggctctcagagcctttttgtcttgggctcccaagtttttctcccccccccccaaaaaaagagggggtttaaaaaaaagaaagaaaacagtctctacatctggggcgagagaggtctcaggggacgtcctaacaagtgtgtgaagtggccaggagaacgcgggatccacgattcctctcaggggaatgaataaccctagggaccgaggggcggcgacggccgagatggcaccagaaccaccagaagccacgtcggaaggagatgggagatccagagggcgagagagggcccctttcctcccaagcgatgtctgtgggcaggtgtataaatctctcagagcctccgtctggagggctccgggtaccggctgcccagccaaggctaagttggtttttggctccctccttcggaacagagaaaacgatagattacacagggatggatggacggatgtctggagagatggaaagatgaatggatggatggatgggtggatggatggatagatgaatgggtggatggatggagggatggatggacggacggacggacagatatatggatggatgcattatggatggatgcatggacggacggacggatgcacggagagatggatggatgcatggatggatagatagacggatggacggacggatagatagatggatgccggaaaggagaagaatgagagacggatgtgagactagatgcacgcaggccagagcaccagcatacgctggaacagagcacgagcatacactcgaacacacgcgcacacactcaggacatctgcgcacagacatacaatcctccgcgtccgcttccacgcaggcattcgcgcacctacatacacgcagttgcacgcgcgcgcacacacacaggcacacacacgcagacatgcacacacacgcagacatgcacacacaccacacatgcagacatgcacacacacgcagacatgcacacacacaccacacatacacacacacacacacacagttcgcctctccctgggtttctcagaaactaaatgatcaccgcccccccgccccgccccacctcccgacacagacacacaggcacatacaatcctcccagcacgtccgaacggatgcacagaaaactgagcacccagacgggtcccgtcgaccccgcacgttagctctaaactgtgtgcaattctggggcgaaaagctaaaactcgactgcgttcaacttgccggcgggttccccaagtctgcggggcgaagagctcgggcccctcaggcccgcaatcgcaccctcggggcgctgggcttggcgaggagaaaggtgtctgactccgggtgctagaaatcaggtcactggcgcctgacgagcggcgccacgaccgctgcgctgcggagcaggccccgcagcccggtcccgagaagcgcagggctcgggaaactttgcagaaaccagagctcgaaaggctttcgctagaatccgggagcaccaagccttcactgtgctccaggctgcgttttcccctcgccccgggctggctcaggagaggacgtggttcttgtaattttttttttaaatcccggcgttgtctcccgtgcatcccctcagggcgcctcgagcgggcctctctggcggatgctgataaactttggcctttggttacaaacttggacagacccgccgcgtgcacgggtcaccgcctcggggcaggctgtccggcggttccccgctgccccttcgccgatcccctcgcctcagcccccttctcccgaatcgggacgcaccattcacactgggctccccccgcaccacctggccctgcgctcctgaggacccctcacccgcgatggcccctcgctgtccccgaccacagaaaggccgtcccgctcttaccttcattcgcggggtataccctggaacctgtgacagcgtcgcaaatcccgaagagacacgaaaatagggcgaaatagaaaatcccagccatggttcgccggtgccaacgctgctcctgccgcttctatcccag

SEQ ID NO: 735 - DNA, 285130 bp, Homo sapiens
ctttgcgcacgcgcgccgcttcccagtggcaagcgcgggcaggaccgcgttgcgtcatcggggcgcgcgcctcagagagagctgtggttgccggaagttgagcggcggtaagtgagccgcggcgggcgagggtgtagtggggtcttgctgggccggttttggaggcctggagtcaaggggcgagctcgccagggagggcgagggtcacagcaagtctcaggatcctcctctgccagtttctgggtggtccttcctcctccagggactcactgattccggctggcgcccttcgtctgtagccgcgtcccctcagactggttcagtccggggtcttctgacttggaagctcgtgctgatttcctaagtcagcccctcctgtcctcttggtaggcagtgctcagaatcttcagtgttggaacacgggagatgggacatttggattcccagcctggctgtgtctggatttgctgtctctggcacgttccttccccatctaagctgcttttccatctgcaaaatgggaatgataatccgccatttgtttaagtgaggaggttaaataagtttactttctgagaaagaagattctcgattccttggttacagggttagaaactaatgcacaataagaatcaatccggtaaggtaaatataggtgttagaacatttgtcagaaatagagtcaaacttctaattttataagtacagtactaacgtacatgatgttggagaagtacaagccaaaccgtgtgtgtgtgcacgtgcgtgcagtttcctgatttttaaacactggcgactgatgccattttttaaaaattggcaagtaattctggcgtttaaaaacattggcaactcagtttttacaaaaccctgttcaactgtaaccagtcatatctgtggctgtcagtttgggacctctggatcccagactccctttttcattgactacttagatttttttctctgacacctctgcccactggccagatttcttcagtgacagaaagctttctacttctggttgctcctgtttggtcctcccccagttctgactcttaggttgagctgaaagcagctactcggtaatcttagctcactgttcctccttcaggctcttggaatcacccctgcatttaattgccctatacatcattgaaagctgctagtttgtcttcctcttctcaccttttcttctctaggctaagcatatttaatgtatttgctcatagtaaacttaacagtgacagcaaattttgtcatgttttgttatatccccagcatatagagcaatgcctagcatattatatatgctcaataaatatttgttggatgaatgaataaaacaaatatttgcctgttatgtgcctggcattattgtgggcactggtgatctatcagtaaaataagaagaaaaagaaccctgtttcatggcaccttctaataatagtggtggtggtggcggtggcggcattgtcagtaagggttggtaggtgtttccgattctgaaacgtacagggtcatgggatggacagtaattggggggaagcataaaagctagctagtcagggatggcttccctgaggaagtgacctaacacttgaataaagaaaagtccagtcttggaatggctcatgttgctaaactgctttcccatcccccaacgctgctccagtcttgttaagctgcttgcaggtgtgtgtcacctatagccctttgcttctgctgcttcgaacatctccccttcctcttccatttatcttggccaactccttcctgccctcatgtgacatgattttgaaatcctttaagagctgagtactggactttccattactcaaccacaggttccgtttttcgttcccagccagcatctcattatagagaataaacatttattgagcttcagctgtgtgtctggcactgcgctgcaagctgggaatacaaaaatgagtaagatacacatccctgtcctcaaagagtttactttttttttaagccaaggagatagcaacggtatggcatgaagctattgcggaggtttggtagaggaggacttagggtacgcataagtcaggctgactcatcagagaaggtttcagtgaggaggtgctgctttagccaagacctgaaggacgaacgagatctgacaggtgaagagtggttcgaagtgagatgagcaaagggctagaggtgagaatgcatggcctgcttgtggttcactggagtgccagtgtggaggtgtaggatgagaggtgactggaaaggtaagcactagccacatcgtgaagggccctgtggacaatagcatgttacccgcacatagactttgggatccaagatagctgcgtaccaatattcccattgccactgaactagttttgtgaccctgggcaagtcacttctttctaagcttcagtttcctcatctctaagaaggggaaataaaaactgtacgaggtgatatgttactcacttgacactggtagatgataaatactcaataaacagtagtcattaatattgccaggcccagaagtttggactctaaaatgtgggggcgggggtggagagcaggacactgaagattttaaaacagatgcgacatcctctcatctgttttaaattacccaggcagcaatgtggtgattacactggacagaaaaagacaagcaggggaccagttgggtatagttgcagtgatccaggtgacaggatgaagatctggatgaaggcagtgacagtggagatggagaggagtgggaggagttgagagattaaggaggtggaatttgctggacttggtaactgataggatgaaacagaagaaggggacaagaatcaggatcctgatgacgggagggcagaaatgaatttgctgtgtggaattgagcagtaacaaaattctttgactagtgtctctaatagattaaccctgacctctgattttatttggaattcagtttgcctctgtcgtccacttctacccatggaaatgacgttcgctaatgtcttcctctcctctttttttttttttctttttttttgagatggagtctcactctgtcgcccaggctggagtgcagtggcacgatctcggctcactgcaagctctgcctcctgggttcactccatactcctgcctcagcctccccaggaactgggactacaggtgcccaccaccatgcccggctaattttttttttttttttttttttttagtagagatggggtttcactgtgctagccaggatggtctccatctcctgacctcgtgatccgcctgcctcagcctctcaaagtgctgagattacaggcgtgagccaccgcttcctctcccctttctatctcctgatctccccacccttctccagtgcgattaaggcctgattgtataatcaagggacaataaatactggaggtgctgctctgttaattggtagtcagtaggtattaccatgatcttggcagactgaggaatagcctattcactccatctcagaccggcttcagaatgatcacttttgggatttcctcacaccttcatcccagttaccatccttgaacttgctctggtttgtcagcctctctttgagtgtgtggtacagaaaggaaatcctctttccttgaggactctaaccatgcagagcaagactgcacttttcttgtggtaacctaaagccctgccagctccattatagacacattgtgcttttgacactattacactagtgtgccaccaaataggccctcagcgtggctcagccctccccatatcctcaggcagctctcttgtccatttccctttatgtcttcctcatattcattcctctcctcaacctcctaccttgacttttgctccactaagttgcagccattaattaaggcatcgcagcttcctcttctatcctttaccaactgatctttagctgaccctatccttttgccttttattctaattctgtgaaagaaatggtgttttaagactaagtcctctatttgtgcttgagatcccatcgcctcctttgcctcaaggactgggttccatcatttgttcattttcttttctgtttcatcaacccttctcatttaaatattctctgtttactctcattttggaaaaaacaaaaaccctccaattaacctatgctgcaccctgtcacacctcttttacccagccacctttcttggaagagttatctagagttgcttcctgtacttccctaagtcattgctaaaatcctgctctcgtcccaccactccccaaagtcatcagacctcgacattgccagaatacctgaccacttttccttcttatctttcttggcacatctgacattgctgaccttgcccctcacttaggaaaacccagtcctactttgtattatctctctggccatttgtccctcaatttccattgtgggctcctttcttcccctttgtccctcacatgccaatttttgccaagactctgccctctactatattcttttcaaccgcagcttcaaacttgtttatatgctcatgacccctgttctgtatcatagcccgaatctctcctgagtgctaccctcaaactcaaacaagtctaaaactaagctcctcatcttccctttgaacctgccgttctttctccattcttgaatcttgccaattcctctcctttcatttagtcatccaaaacagaaccctgagagtcatctcagactcttcctctggtactagccctcctttccatcttccaagtccaggtagtcatcagagttctatagattcgactttgttgctatctcctgactcacatctcctccatttcctcccttgctccctcatttcaggctcccctccctttttgcctgtctttctgcacagcctcccagctggttgccctgcctcagcagtctggtcctcactgctgtggattgcctttactaaaatagagatctatgcagaaatacagttgcatagcttttcacataaggctcttcatgatatggcctttgcctgcttttatggcatggtccatctactctgccccatgtgcctctccttgctgccatacagaactctatcaggggaacctgcccccaatatttcaaggtatgttctttctattttccataagtgtcagctggctgagaaataaagagaaagagtacaaagagaggaattttacagctgggcctctgggggtgacatcacatattggtaggactgtgatgccgacccgagctgcaaaaccagcaggtttttattaaggacttcaaaaggggagggggtgtgcgaacagggagtgggtcacaaagatcacatgcttctgaggaaacaggacaaggacaaaatcagaaactcctgataagggtctatgttcagcagtgtatgtattgtcttgataaacatcttaaacaacagaaaacagggttcgagagcagagaactggtctgacctcaaatttaccagggtggggtttcccaatcctagtaagcttgagggtactgcaggagaacagggcatatttcagtccttatctcaactgcgtaagacagacactcccagagcggccctttatagacccccccccccccaccaggaatgcattcctttcccagggtcttaattattaatatttcttgctaggaaaagaatttagtgatatcttccctacttgcacgtctgtttataggctctctgcaagaacaaaaatatggctgtattctgcctgaccctgtaggcagtcagaccttatggttgtcttcccttgttccctgaaaatcactgttattctgttctttttcaaggtgcactgatttcatattgtttaaacacacatgttttacaatcaatttgtacagttaacacaatagtggtcctgaggtgacttacattctcagcttacaaagataacaggattaagagattaaagacaggcataagaaattataaaagtattaatttttggaactgataaatgtccatattaaaatgaaatcttcacaatttatgttcagagattgaagtaaagacaggcataagaaattataaaagtattatttgggaactgatatatgtccatattaaaatgaaatcttcgcaatttatgtttctctgctgcagctccagccggtccctccgttcagggtccgtgacttcccgcaacagaactcatttgtattttctcaaacataccatcctggtttgttctttcattgtttcagtcatcaacaagtatttattgggcacctgtgaggtgcgaagactggtgttagaaaaacaatgacgaataggggaaaatgagaagctggcacggttcctttctcatagaatttttatttattcattctttgtttcagtcatcaacaagtatttattgggcacctatgaggtgctaagtcaggtgctagaaaaacaatgatgaatgggggaaaatgagaagctgacatggttcctttctcatagaatttttattctactgaggaggataactgcatacgtgctatgaaggtaaggtagttggtgctctttgaggactagaatacaggaggatcgacctaatccagagctgagggagtcagggaaggcttccctcagaagtgatgattgagctgtgatttgaagtgagcaaagaaattcactagatgatgggtatgtggaggtggccaagaaaattctaagcttatgcagaggccatggggtgtttctgcagctgatgatgtggagctgagtcagcttcctccctttgcctggagagtccccactccctacctctagcctcctcatccaggggtccttgcatggggctagtgctgtcatctaaccctccctttctcaaccatcaggggtgggtttagaagtttgtggagctgttttattttgctttgttttgtgacattgaccagagggcattactgcatttattgagagagagccagagatgctcaacattctgcagtgtgcagggatagctctaaacaaaaaagaattgttccatccagcatgccagtagggcccctgttgagaatctacttggatgttcttaaaaccttgggttaagggtttctataggatattcttaaaaccttggcttggctgggtgtggtggctcacgcctgtaatcccagcactttgggaggccgaggcgggtggatcacaaggtcaggagttcgagaccaacctgaccaacatagtgaaaccttgtctctactaaaaatacaaaaattagccaggcatggtggcgggtgcctgtaatcccagctactcaggaggctaaggcaggagaatcgcttgaacccgggaggcagaggttgcagtgaagccgaaattgagccacctccctccagcctgggtgacagagcaagactctgtctcaagactccgtctcaaaaaacaaaaaataaaaagcaaacaaacaaaaaaaccccaccttggcttaagggtttctataggaaacactgttgcctcatcagtctaatttagatatccctcctcctataacattctgtacaaacgccaggctatactgtatttgttttacctccaaattgctatactccgattcctcttctgttttgttgtctgttttggcttcaaaattgttagctctttaaaggtggggaccatagttttttttttttttgccattgaaccctgaaatgtagcacagggacaagtatgtaacataactgtttattgaagaaataactaatggaagccccaatttcatttcttttcttttcttttttttttttgagacagagtcttgctgtgtcacccaggctggagtgcagtagtgctatctcagctgactgcaacctgcgcctcccgggttcaagcaattctcaagcttcagccttccgagtagctgggattacaggcgcctgccaccatgcccggccctttttttgtatttttagtagagacgggatttcgccatgttggccgggcatgttattggtaaacaatatgatattagtcctgctttttgagtgtctcctatgggccagatgtatgcattttctagttgaatcttcacactaattctgcacagtaggtggtatccccatctaacagaagaggaaacagactcggagaagttgaatgacttgtccaaggtggtgtggctagaaagtagcagagacaggatttgaactcaggtctctctggctcatgaacctatgccctttccagtctagcagaccatctgccttgtccagttgttttcttgaacttagatttagggccctagatttacctctatgaaatttcaaatcttgttaaaataggcctgccattccagatggttggaatctttttttatcctgaattttagtcacttgtattgcctgtttcttcttttgtcatgaaattgataagcaaatctatatcattatccaagttattggtaaaatatggtaataagaatactttattgaatatgtttatttgcctattccccctgctcttagccccagcacagggttcagtgcacatgaaatacttagtaaatgttgataaatattcattcatgtggataaataaaataaattggacaggcccagagactaagccaaagacgtactgctattagctcctttctaattaacattaattaattcagtaaccaagatcctttgaataagattattttaccagttcttaatccctctaattatgtcaggatccaattcctgtatcttcaccttgtctaccgggatttctagagcagccttgtgagagacatttctgagacctgtatgtcctgcgtctatgattcttccctgatcaaggtaggaatgcagttactctgtcatgactttttcttagagaaaccatattggcctcttgtgattacttagggctgcctcatacagttatgcaggctgtgcactgcacaagaggccacatcaaagggggttccatttatatcataggtatcatgggtgcatttttgtaatgacagtggcagagaaggctaccatgtcttgagctaatctaatcagtatattacaacatttctctaactaaaggaagtaaaatcttgaagcagaggtgtaattttctgattgtacaaaggtgctaagtggactagagtggcccatatgggcctttcctgggagcaaaacttctgtccagtggtctttagaacccatctttattcttatctttgaaaaatcaggccgggtgtggtggctcacgcctataatcccagtactttgggaggctgaggcaggtggatcacctgaggtcaggagttcgaaaccagcctggccaatatagtgaaaccctatctctactaaaaatacaaaaaattacctgggcgtagtggcgggcgcccataatcccagctacttgggaggctgaggcaggagaattgcttgaacgtgggaggcagaggttgcagtgagccgagatcgtgccattgcactctaacctgggcaacaagagcgaaactccatctcaaaaaaaaaaaaaaaaagagaaaagaaacaaagaaaaatcaaacattttgaaaatcggaaatcaggcctttgcttggcccagttttaaagtacttctcccgtttctcaggattctttaaacataccagaaatgaaaaccacagagatgtaattatttagaagcaagccttcataactcagccagcttttaggaaaccatcatagattttagttgttggttggcatagggctccacagtgatttagacaaatccaggtgggtgtctctcagatgaacagagaaatgggcaacactgttgatcagtggaggtaacaaaaggactcagaaggaggcacactgccctccatcttcctggcattattgcttcctctctcctctttcccacattttctcagctgtcactgtccctcccatgtaggcttctcaaaccccataatgctggtatccagtgcatccgttctcaaaaactgaagctgatggacaccagattgcatgtgaaggtgaaggatattatagcagaaggaaaccaaaataaaagaaaaacagctcctggaagtaaccaatgagaaggacagataagagtttgaagactgtggatgtgactgcttgttccctggttgacacactgaagaagaaatcatgttgattcagagttggcttggaggtgaggaggacaactcacccatcatagcaattttcctaactgccagtgtgatcagctgttaccacagaaatcacctgaaagcacagtcacaaaccaatttggctgacttgatgatttgatgtcttgtggagatgttagttttgctcagggacatcttgactctaatgcaacttttaaaaggaagtgaggtttctgtacccagctggtttccctgtaggagtcctgagttctcatcttccggtagagcctactctttcttctaagtttagaactttttcccttcttttggaagagaaggctttaaacctccctctttaacagccttgcagattgtttctgaaactcatgaggttgcagaagcatcatttgtctataaaatgtgcattggctccatatgccaaagcagccccctcccgactcctggtgatctctacctcctttttacacatcagcagctaagaacatatgctgtttgtcagcgggacttggtcatgtggtttggtgcttattttaatgactgccagagcttgcagccctgcagctgggaaaatgagaatagaagcctgctctgtgtgctccattttggcccagagaaggcacttcagggccaaattgcagttattctggcacttctgctaagtgaatggccccacatgggctcagagaaatcggacactgagtgctcgctgccctttagaacttgttcttttggacttctcgatgacctgtagtgggagactgaccatttccttttaattaagcctctgttgtgcttgcagagctcttttgagggaggtaggctttaaatgaggcatgttttaggcagaggaaattttcatagtgagcatggggaaggggaaccacattagtcaggcattgttggctaatatggggcagtgacaagaaaaactaccagcagctaccatttattgactgcttgctgtatgccaggcactgtagcaagcacctcacaaacatttagccctcccagcaagttctagagtagttatacctgtccttatcttacacctgagtaaatccaggtgcaggggggtgaaggaacctgccctaacctgccctaggcttctcagccaataggaggtggaggtggaatccacactcgggttcatctgtataaagacctgattcctgactgcattacattacctctccttttagcatcctttccctgaaccattaaaaactctcctgcttgtggtggacatggtggctcacgcctagtaatcctagcactttgggaggccaaggcaggtggatcacctggggtcaggagtttgagaccagcctggccaacaaagcaaaaccctactaaaaatacaaatattagctgggcatggtggcgcatgcctgtaatcccagctatgtgggaggccaaggcaggagaatcgcttgaacccggtagacggaggttgcagtgagccgagatcacgccattgcactccagcctggacgacagaacgagactctgtctcaaagaaaaacaaaccaaaaaaactcccctgctctcctaaagcaaacagacaaaaaactaaaacacacagaaaaatcagagtgtgataatttttagcattgtcaggctggtttatggaaactagaggcctgtgtgtctagcttcccctaaagacaggttctttttgtttttgtttttttctctccctctgttttttattttctacaattacttcttcactttaaagtgaattacttcttcatttaaaaaatcctgtatttcttcattaaaaaatatcctacacttcttcattttaaaaaatcctatactggcttgattatttgctgtgtccaatcctagagggagaatggttgggcggtctcactccaggaagcactcctgcttcaattaattctataagcagccaagccaaaataattccatccttagcttctttagtcacaaaatgccagaaaactttatggaaatgatttctcatttaggctacttatttagagtaatgaattgctttttaccaaagctaaatttaagtaggtcatctgttaactgttggatgaataaatgaaggttctcttcgtaggactggtatggtttaaagataggggttttgttctacttttttattttattttattttttgagacggggtcttgctctgttgcccaggctggaatacagtggtgcagtcatggctcactgcagcttggattgcctgggctcaggcgatcctcctgtctcagcctcctgagtagtcgggaccacaggcgtgcaccaccactccataataattttttaaaattatttgtggagatgatatcttactatgttgcctagagtggtcttgtctgggctcaagtgatcatcctgctttggcctcccaaagtgctaggattacaagtgtgagccactgtgcctggcctttttttttttttttgagacggagtcttgctctgtcgcccaggctggagtgcaggtgcgcaatcttggctcactgcaagctccgcctcccgggttcacgccattctcctgcctcagcctcccaagtagttgggactataggcgcccgccaccatgcccagctaattttttttttgtattttcagtagagacggggtttcaccgtgttagccaggatggtcttgatctcctgacctcatgatttgcccacctcggcctcccagagtgctaggattacaggtgtgagccaccttttttttttttttttttttaaaagcccggccttttttttttttttaaattccttcctgtgacagattctcaccctgtcacgcaggctggagttcagtggcacaatcacggctcactgcagactcgacctcctgggttcaagtgatcctcccacctcccacctcagcctcccaagtagctgggactacaggtgcctggcaatttttttttattttttgtagagatgggggcccaccgtgttgcccaggctggtcttgaactcctgggctcaagcagtcctccttcagcctcccaaagtgtggggattacaggtgtgagccactgcacccagccctattttacttctttattcatggataacatacataaagtgcactgatagcaaatgtttagcttgtggctttttacataggtatatgccttgtaaccaccacccagctcaagatacagaatatttccatctccccaggagccttcctcgtggccttctcaagtcagtagctccacctcaccctgtaatcaccattctaacttctgtcaggttgattggttttgcctgttgaacaacgtataaagctgtgtgtgacacacagcttttatcttaatagtaagataaaattattcttactattttattttggaacagtttcaaacttacagaaattctacaagaataagacagataccttctatttatccatctcccagagactcccattcagtttttgtcccaataatgtccttttatagtggagcatcatcccaggatcacacgtggtccccagctgtcacgtctttgtggtctctttcagtctgggacagctccttgtctccctttgacttttaagaccatggcacttctgaagactataatcctggtcattttgtagaatgtttttcaacttgggtttatctgatgtttcctcccatgagatccaggttgtgtattttcatccaaacaccacagatgctgtgttctttccatggcattctatcagatagcacacagtgtctgtttgtcacgttgctgctggtgttaactttaatctcttcattaaaatgctatattaatgaccagatattgtcactagtagctaccagaatgctttcagaaagaaacatttattcttgactactttcatatgcagttgcataaggttttatttgcactgatttgtgcatgcatgtttcctgcccgctaaggtcttagtcctgaaaaaacaataataggtttagggacctaagttatatggcatatcgtcgtatgttcttcatgattccttactccatattctgtggtaattggcttctggggtttgttctcatagtcatagaagtttgggttatttcttgcttttgtttcttttcgggaggatatctatagaaagttccttgtttttgttttgtgtttttttttttgtcttttcttttctttctttctttctttttttttttttttttttttttttgagacagggtctggctcgatcacctgggctggagtgcagtggtgccatcttgccaccttggcttactgcagccttaatctcccaggcttaagcgatcctccacctgagtctcccaagtagctgggaacacaggcgcatgccaccgccatgcccagctaactttttaaatatttttggtagagacggaatgttgcccatgttgcccaggctggtctcaaactcctgagctcaagctatcctcccgcctcagacccccaaagtgctgggattgcaggtgtgagccaccgcacccaacctttttttattattattattattttatttttaaattaattttttctagaaatggtgttctgctatgttgcccaggctggtcatgaactcctgcccccaagcagtcctcctgcctcagccttccgaagtgctgggatgcaggtgtgagccactgtgcctggctgataaaaggtttctaaaattcatcctagtaatgtttgagagccactcacaagggattagggacattgaaaggaatatgagccaggatctgtatttgtagagtttacaatcaagtttggtggaggcaaacaggtaagcaaagagttgaaaaacaataccaaatgtctaggtggcttagagccaggagtgattaaatatagctgccaggggaggagtatgaggggagtgaagacaggcgaggcacctctgagaaggctttcctgagcaggtcacctctgagctgctctgtgaatgccaggcagtcacagaagcaaggtgagggagaacagggaacacttttcagacagaggggctgtgagttctaggccatgggggcctgagagcggctgctaaggagcatcaagtcagaggtgaggagtgacagggccgtggggtagaactagaaaagtcggaaggcagcagcggcggtctgggagaaagcataaggaaaccatcagaggtgtagtcatatgcctgcttaagatgtagaatgctgctgatgcagtctttccggaacgttatgagccttaataaatatcaaatgagcttcgtcttggcttaatgatgctgagagatgtgtgaatgttttgagtagactgtatttaccagttcataaagaagtatttgcagcattacaaggtgcctattgcaggccagcagatgtggccttagaatctggccttcgccctcagcgccctcactgatctttactgccctttaaaaagattatgccaaaaatatcagtcttcctcaaaacaaaatatactattggcaccttcaaagaatcaaaagataacaggtttggaagatcatttagtccaggagtcagcaaactatagcctgtggatcaagtcctgcccgaggcctttttttgtgcagtccaggagctaagaatggtttttgcatttttttaagggttgtaaaaaaaataaaatacacagcagactgtttgaggcctgcagtgccttaaaatatttactatctggccttcttcaggaaaagcttgccagaccctggtcttgtctgactgcctgatacagcaatcctttgtgcagtattacgtggcaaataatcatccaatatatgcttgaacacttctgctaatggagaactcattatctctctgatctatttcctgtttggacaattcaagctattagtaatttttaaactgctgaaatttatcttactatatagcatccatccattggccctttgtgcgaaaagagagctattatttcatttcaacctttactgagctcttaatatgatccaggcactgtgctcagtcctgaagaaagatgagtaagacatggtgcttgtttcaaggatctcccagctatgatttcttggaaccaaagcagttgagctgctagtcttttatctctctctttgtcttcttgccattgggttaggacttttttctttaattattttagttatttctgtattgttttatatacataatacaaactttaagaggcaaaaaaggtcatgcagtgaaaataagtctccccacactcctctctcctcacctcctagcagctttcttgggaggcaaccgccactgcacatttcctgtggggatttgatcttaaaaaacaaaagatttagatccatgtggacagaaacttttggtaagtactcattcagtgacattttctgagctcctacttgtgctgagtgtgactgagttttattttcattaaagtctgaaatttgcaccaagtttgggtggtagacacagccccgggggattgtattggttaaccacacacgctgctatttcagtttaatcttgactgaacttcttggctactgcaggctttcttacaccactagagttcttgctcattacagtgttgaatccctatcaaaacctttcctgtttaattggcagtgacacaatcccatcttgtgtaactcaggatgtttcacatcctgaaatagtttgaaataaaattgaaacacacttacattgatgcctatgttaatttctttccttgactgtgtctgaatataatgttgaagtgtgatagaaacaatcctttatctttctaagctaagcagaggccgaagtttcacttgcactgtccagggttatacaggcaagccttactttttcaggaagtaggtaatgtttggatttagattagtgacacatgaataactctgtctatgactcacttccccccaaattcccctccgaccattacttcttaaatcttcccttccagcttaagcgctgtagtgatgttacatagacgtgtatgttcctaagtgatacctttaccatagattgtcctgtttaggtatttccagaagattcctcatcatgctgatgttgcttaagacttttctgttttcagcctgtcatggaacggtttcagcagctcaacatcaactatatcctcttatgaaataggcccttggattctgttcagaatttccctaaggccaaataagtcagaaaatatttgaaggatgtgcctcttatgcaaattacttttgtgcaatcatggatcactgcagcctcaacctcctggtgggctcgagctatcttcctacctcagcttcccgagttgttgggactaccgatgcgccctgcaatgcccggcaaattttaaaactttttttgtagaaatggggtctcaccatgttgcccaggctcgtctcaaactcctgggctcaagcgatcctcctgcctcagcctcccaaagagttaggattatgggcatggaccactgcactgggccttttttttctctctctgtaaaagtagtttatttgttctgtttacaaagtacagggaaggaataagggcaatacctggaacccctttggtcgcacatcttcccagtctatgcttctataaataacgtttgtacaacagcaaactcatattgtccccatgtgttttctcacatcctggtagctgcagtctatagtatagaccgggtaggaaatagatgcctgattcacagggtagggctcccctccaattagtgttccagctcacttttgctaatattgaaacagaagtaactagttgttcttaaaaactctctcatgaacaagtaggtcataagcaaattatgtctgcacaactcctagaattgtttcaaataactttatagaaaggcagtgactaaggccctttcctctttcccatctttctaagtcctaggctgccttcattcagcacctggactgccgcctgggtcccccacatcccagcgcggtgatggaggaggggcaggccaggccaagcatgaggaataagctgtctttactgggctcagaccaggagcccatggtcttgaggaactctgtatttatcagttttcttctccacgttctcttccacctgtttctgcagcctcatggcctgtttttacttttggtagtggatcttggccttctccttcctcttctcctccaggtagctgtcactgcctggtacttccagccaacctcatgaaccagccacccccaggtaggcagactttattttaggcttcagacgcacaaccttgaaggcaccaggaaccactatctgcaattaatatacaaaatgtctgttatcttctttttttttgagatagagtttcacccttgtcgcccaggctggagtgcaatggtgcgatctcagctcactgcaacctctgcctcccgggttcaagcagttctcctgcctcagcctcctgagtagctgggattataggcatgcaccaccatgcccggctaatttttgtatttttagtggagacggggtttcgccatgttggtcaggctggtcttgacctccttaccaagtgatccacccacctcagcctccaaagtgctgggattacaggcgtgagtcacttcacccggccatgtctgttatcttttaagtagtcatccttagtcgcttttacccagctaccgaagtgctgtagaatagagttttcttttttgtctttgtgattctctggcactggtaaaattccatcttgatgtccttagcaggtcatcaaaattatgatgaaaacaagttacatttgtccttgaagagaaagttgtggatgactgacatatgtagggacttgatgatctgtcacacagaggattttagatgaaatccttttgtaccactgtctgcaactgtgttgatttccttccacattggatgatagctctggccagggcctttttgttttgactgttggagaggaggttagcttgtgaataattggttattttttagcatgtgtgaggctgatgggcagtagaaagttcctgaaaagaagtttcttccttcaaggcagtgtaatatagtgacgagaacaggggctttgaagctagcagacccgggttatcatctcagctctaccacttcctgtgtgactctgggcaagttacttaagctcccagtgtctcagttttctcttcagtaaagtaggcataatcttaccactggggttgtcaagggaataacatgtaaactgtttagtgtagtgcttggtacagaatgagcatttaataagaacagttactaatatgacattactactgctgttatttaaatagtttttaacagtattatcaaaacagcaagcacagttcatggtggtaaatgccctaatggaagtgttcatctgtcaccattgagaagggaactgttaatatccactgactgttactgacagcttcataaggaccttgtgagatgagaagtacttttcctggtagagaggggaaaggtttcctaggaacatcagccatgcagaagatcaggaaactagcaggctaaggctgcagcaccttattctctgtgtagtaaggccagtaagctttcgtttgtttgtttaaacaagggagccacctgtgcagatcattcctggtggcagtttgtcaccttgtttggaggagatgggccaaaggcagtgacccgtgagtatatcactgcaagagccgaggtgtgagatgatggagcctggcacgtagcagtgggaatggagagaaggcaggcagacctagacaggaagcatgaagttgcatgaggagcatgggcttcagagtggcgtgaatctggaagctgaatcctggttcccctactttcctagctgtatagccttgtgtgaatttatttttttctttctttctttcttttttttttttttttggagacagagtctcgctctgttgcccaggctggagtgcagtggcacgatctccatcttggctcactgcaacctccgcctcctgggttcaaacaattctcctgcgtcagcctcccaaatagctgggattacaggcgtgcaccaccacacctgggtaatttttgtatttttagtagagatggggtttcaccatgtttgtcaggctggtctcgagctcttgacctcaggtgatctgcccgccttggcctcccaaagtgctaggattacaggcgtgagccaccacacccagcctccttgtgtgaatttcttacttcttggaacctcagtttcttcctctataaaattggagctattccttagggcttctgagagaattgaattcaattgaacaacccttgctgctgtgcctagttttggtctgtgttcagtaactgttaaccttcatctcattccagaggactgtttaagattgagcttctaggaattagtgctttattgcgttgagagagagaaaaattgaagatgactttgaaatttcttccttgaattaaggtgatactattaagcaaactaggaaatacagagaaaggggcagaatttagggaaaatatatgttgaattttggatttgttgaatttgagattctgaggaatctaagtcctggctttaaaggacacttaaatatatgtttagaggttagagctagaagtacagtcctgagattcattggcatacagacagaacttgttgtagaaagtgaatgatttggccgggtgtggtggctcacgcctgtaatcccagcactttaggaggccaaggcgagcagattgcttgaggtcaggagtttgagaccagcctgtctaacatggtgaaaccccatctctcccaaaaatataaaaaattagccgggtgcggtggtgcatgcctgtaatcccagctactcaagaggctgaggcaggagaatcacttgaacccgggaggtgaaagttgaagtgagccgagatcgtgccactacactccagcctggatgacagaatgagactctgtctcaaaaaaaaaaaaaaaaagaaagaaagtgaatgactggccgggcggggtggctcacatctgtaatcccagcactttggtacatcaaggcaggcggatcacttgaggtcaggagtttgagactagcctgaccaatgtagcgaaacctgtctctactaaaaaatacaaaacattagggccaggcatggtggctcacgcctgtaatcccagctacttgggagtctgaggcaggagaatcacgtgaacccaggaggcagaggtttcagtgagccgagatcatgccactgcactccagcctgggcaacagagcaagactccgtatcgagagaaaaaaaaaaacattagccgggcatggtgacacacacctgtagtcccagctacttgggaggctgaggcaggagaatcgcttgaacctgggaggccgaggttgctgtgagctgaaattgcaccattgcactccagcctgggcgacagagcaggactccgtctcaaaaaaaaaaaaaaaaagaaaaagaaagaaagaaaatgaatgactgaggagagggctgagcatggaagccttcaaaaaccaacagtagaagaaaacgctagctgcattgtagaggaaaagagggaaagggagagattagaggcccaggaaacaacaggaggctgtgagagtgtttctacacgtgtgcctcaaatcctcaaatcacctgttttctttttattttattttatttttttttgaaatggagttttgctcttgttgcccaggctggagtgcaactgcaacctccgcctcccaggttcaagagattctcgtgcctcagcctcccaagtagctgggattacaggtgcactccactacacccggctaatttttttttatttttagtagagatgggggtttcaccatattggctaggctggtcctgaactcctaacctcaggcgatcccccgctttggcctcccaaagtactaggattacaggcgtgagccactgagcctggccaaatcacctgttttccattgggcaaaattataaaaattctttcaaacaattaaaagccaaaaaatatttaataggagttgagggtgcattcaaatacatttgaggtgattttgaggtggggcctccaaaaataagtgccagtgacctaggcttcaaaatagcaccaaacctacagcagcatcacctgaggcactaggcaaactccagactcctggcctccatcactatcccttctcttatcgaatcttctttcctccacaggaagtgggagtgagacccaggcatcctcattttttaataagtgctcaaaggccgggagcagtggctcacacttgtaatctcagcactttaggaggcctgggtgggcagatcacatggtcaggagttcgagaccagcctggccaacatagtgaaaccacatctctcctaaaaaacaaaaattagccgggcatggtggtgcacacctgtagtcccagctactcaggaggcttaggcaggagaattgcttgaaccaaggaggtggaggttgcagtgagccgagactgtggcactgcactccagcctcggcaacagagcaagactctgtctcagagaaaaaaataaataaatatgtgctcaagatggtgaatgttggaaaacgcttggtcaggcgctatctggggatgtgatgctgcaagccacactgaggcagtggggaattttagggacagtgatgtgttgtcttttgtgatcaatgaagcttatcaattatatagaaaaataattattataattcccacctcattccttctgtttgcttttcagtttttttaagaccttgttgtgagtctttcattcattcaaaattggatttctgttgccaaaacatctttttaaatgtggaaagcatattcagcctgttgaaaaacaacaacaaaccacccattaggaatccagtggcagactaacctgccccactggaacttgctacggacacagtcagttactcccctctggtgattctgccttttatagcctgttctcttttaagcaatctacaatgaaattgcattttagaaagccaccaccgcactccttttaaacattaaatacaatgtttaaatgaccagtcattttctttgattcctagtgtccattcatcattactcttctcaaagtttttttactgcttagagttggtagatatatgtactgtcctggtgttccaactacagctttctttgttttactggttctatttctttctttcttttctttctttctttctttttttttttttttgagatggagtttcgctcttgttgcccaggctggagtgcaatggcacaatctcggttcactgcaacctctgtctcctgcagttctcctgcctcagcctcccaagtagctgggattacaggcatgtgccaccacacccagctaattttgtatttttggtagagacggggtttcaccattttggtcaggctggtctcaaactcctgacctcaggtgatccacccgccttggcctcccaaagtgctgggattacaggcatgagccaccgcgcctggcctactggttctatttctttttactccctaactgcggacattctctaggactttgtggggctttttctttctctgagtaacttctaagaactgatcattgtcacctgtgttagctgttctctcagtatccatgtccagttttcttggcttatctttgccctgctgttgtccacagctgaaaatgtctttcattattactcttctgaaacttgctttgcctctcaagggtcttctctttcactcaagctgccattctcctagccatttgtggcttgacaccccaagagctttattctctcttttcattgcttgagtccaccaagataccaagttaggtcaccttttattttaaatcagccccaacgagggtcccctccttttcacttttactcctctgctctaatccaggtcttcataaatttttgggcttttagctgatttccctgcctgcctctttcaaagccctttacccactgcggaatcatatttaccatgcaggactgccactggcttcctcctccaaaattcgttagcctcacatttgaggcttctccataggtgttcacccatgtcacctgctcagctctgtgtgtgctgctcctgcacagcacaaaccctccacatgaggacagctggtttcacgtgtccctatttctgccatgagtattcctctgctcttcttgttccttctgccctccacccatcttcccccaccccttacccatccttttcaacatcactcagtgcccatctgcttcacggtgtctttcccagggctctgccccacattcatcccattcttcttgatttgaataccttttatgtaggagcactaactttgtatttcattatacagtttctatcaatccaaagctccttatctctaattctaaatccaacaagtttggaaaactgaaagctttttaatagtcttggcacaaaactcaagcaaaacctccctgagtagatatgagctgtttttaaaaaatatatcccatttggccaggtgcagtggctcatgcctgtaatcgcagcactttgggagaccagggtggaaggatcacaaatccaagagctcgagaccagcctgggtgacatgacaagacctggtttctactgaaaatacagaaaaattagccagtcacggtagcccatgcctgtagtctcagccactcgggaggctgaggtgggaggattgtttgagcttgggaggctgaggttgcagtgagctgagattgtgccactgtactgtagcctgggcagcagagcgtgaccctgtaaatgtatcccatttacagtgactgttcatatgttctgctgcagaaatacttgtatgtctggttgtggggtaattggacagaatggaaagtgaagggaccttatcaatttgctttttggagctgccagatttctttagtattgtccttctcaaactggggtatgttaccccggagagtatggagggattatagaaagttacagtatacgtatgcatgattgccaggaaggtcaaatttattagatgattcgaagggggaaatgaaataataaaatatatatcatggcacaaaatacaaaatttccatgcattgaaaagataaaatatgagatttcaaagaaatttaggcactgtgggaggtggggagaagcatatcctcattatctgcttcagctagaggtgttaaagcactgctctcagacagaattctgacagtttgggttgttgcatttctgagtggctggatttaggattttgtacttgcagagttctccaggaccacacaagatggcaaaaatttctgagacagtgtctgtgtcgaagaaggaataacagtagtgcatcagtcagactgactcaaggaaggaagaagcataaacattaaggccgcaaaggttacttagaaaaatcactgtgtcatcggtgaaaccctgtctctaccaaaaatacaaaaaattagctgggcgtggtggcatgcgcctgtagtcccagctacttgggaggctgaggcaggagaattgcttgaacccgggaggcggaggttgtagtgagccgagattgcaccactgcactccagtgcaacagagtgagactccatctcaattaaaaaaaaaaaaaatcactgtgtcatgaggagaatcagcttgacaacacaggccaattaggatggttttcaaagttgtgtcttaagtgaaataagccagtcacaaaaacacaaatactgtatgatgccatttacatgaagtagtcaaacctgtatagacagaaagtagaatggtgggtgcaaggtcctgggggtaaggaaatggggagttattgtttaaagagtatagagttccagttttgcaagatgaaaaagttctggagatctgtttcacaacgttgtgattatacttaatatcacctaactgtttacctcaaaataatcaagatggtaaagtatatgttatgtgtttcttaccacaatccaaaaagaagttgtgtttcaaggtagcctgtaaacatctcattactttttgtttgtttgaattaaactttattacaaatgttctttctcaccaggttttgcatggatatgttattttgctgtgttctgttttgttttttaataggcaagaaataatggcggcagctacgggggatcctggactctctaaactgcagtttgccccttttagtagtgccttggatgttgggttttggcatgagttgacccagaagaagctgaacgagtatcggctggatgaagctcccaaggacattaagggttattactacaatggtaggtgattgtaaatttcattttccatcatcttctgttatcctcacggtcctccagtatagtgtcagctttcctttagaaagagacagccttgtcttttataatcagtgctcttcactagtttctattttacttcctgactttttgatcccagttcattttcatttattttctcttgttgtggggaaaaagaaagagagtagtgaaactcaaattattaatccaaataatacccattacttagcattgctgtgggaagagattggaaatattttttccattgaatcttttttatattcttggcgaatgtctcatattcacaagagctctgtcacattctgccatttatctatccatacatatattatctatgtagcatagataatcagaaattggatggggcgccttgggctcaacaaagagaagaaaactattcataagcatttttgttatgaacgctgctatttctgacttgtcattgaaaatgtgataatgcttctgtccaggtgactctgctgggctgccagctcgcttaacattggagttcagtgcttttgacatgtgagtatttatttgttcaaaatctgaagtaaagaatactacttttggcaaggaataagcatgcttgcctccctcataggtggaccacaggaggactagggaagttcccggtgggcagagtcagcccccctcatgattctcttatacctcccatagagatgagtgctggatacttaggtctgcctggttaatttttcaccacctatttatcagagtcaattaggtgccaggtgccatctagattgattgagacatagataatatccctcttgattttgattgtagttaatattttgtgttcttttcttgatacctctcttgattcactcctttagtccatgggcattgtccatgggcattgatcaatgaatgtttattagtctacttctgtatacaagccactgtgcaaggcattatagtgctatataaaggaatatgatagatatatccttgaagaatttttttaaatctgcttgggagctgtggggagttgctggagagaagagacacacttttttttttttttgagacaggatctcactctgtcacccaggctggagtgtagtagtacaatctcagcccactgcaacctcttcctcctgagttcaagcttttctcgtgccttagcctcccaagtagctgggactacaagctcacgccatcatgcctggctaatttttgtatttttttggtagagacagtgtttcaccatatttgccaggcagatcttgaactcctgacttcaagtgattcgcctgccttggcctcccaaagtgctgctgggattacacgatcgagccaccacacccagccaagagacacatttattgagcacttaattaggcattttcataaacatctgttctttgagactcgccaggtgtgatttttctctcttttttcagatgaggaaagcatgggatgaaaggtaaaaatggcttgcccagggtcacacctggccaaatttagaaagcaggggtgagagaaaaaaatgtatttataaatgtatttctgaaacacagtatgagtagctacagggattttgctatcttctacagaaatagagaaaccaggagggggatacaaatttaggaggagacaagtttggtttagaatatgttgagtttgagatgacagtgtctgctagaaatgtccaggaggaactggagacggggagaaaggatcagactagatttgggagacatccaggtagaggagaaagagaataaagatagtctccaacttatggtggtttaatgactttttgactttacgatggtgagaaagcgatacacattcagtggaaattatactttgtggacccatacagccattcggtttttcactttcagtacagtattcaataaattacctgagatattcaacactttattatggaacaggctttgtgttaagatgattttgcccaactctaggctaatgtaagtgttctgggcacgtttaagggaggctagactaagctatgtctggcaggttagacgtattaaatagagttttgatttatgatatttttttcaatttatgatgagtttatcaggacatggtaagttgaggagcatctgtatagtataagaacaaaaggcgcaaacagtgaatggctctaattagggaggtgaaagatgatacagaactagcgaaggacacaggggttgtcagaggaaaaccagaaaagtgttagagaaaccaaagaaggcaatgctttctggagggaaagagaaactaacagtgtcagaagcacagaggtcaatgcgagggccactgtgtttgttgattaagtcattgtggtccttaagaattcagtttgagaaagagggtggagctgaaaccaagatgagggcctttaagattattgagaattgaaaaaggctacagtgttttttctgctttattgtacctcagcagtatcaagatggggaattttaggaaggtgaagaagtcttataggtctttctggcttttgaaagtggcaatggtcaactattaggatatttaaaataaagtgtccctagaattttttttaatctcagaaaatcaatactttttttccctttatctcaatccagttgcaaaatttgaaagcacgatgtacatccacaatgattttagtatttgtatctttaaaaatgtatgtgttggtgtttcttgttccctttggagctttcttgctccatcgtaaactgcttgtggttacctgtcaaaagaaataaaatcctaataatctctctcttgttttggcaaactaacttattttggagccagtaagatatgacgaggaaactactggaaatgtacaagcattaaattgtctgaagatggtacgggggagcatcaacagtctgttttgtgtaatctggagagcctcatatttatctcagactaacctcactcctatccttatccttctactggactgtttgttttataaggttttaataattttattctttagaataattaattagaaaaatgcagttcacagaagttaggtttgaacttactacaaaatgtgagcatcttaaacttaattaatctaaaaattttggttgaaggagataagaaaatctgtgatcctgcagctatgactttcacacaaattgctcattttcactcatcatattttttctttaaccgttgaataccctcagtgtgcaaggcactgtggtagacagtgggatgtgaacagaaataagatgtggtccccattgtgtgaaaatagccctggattcgaagtttgaagatttggaatctatggctaattaactgtgctacttcaataagctcttttagttttctcagcttttgtttcctcatctttaaaatgggttcttgctttctaatgttctttccagttttaaaagtctgtcactttctgagtccctattaggatggctgagaagtttaatgaaagtgcttgggacttctcagaaggcctgatttctttattccaaattatttcctttattattaccccatttttgttttgattgctgtatatctgcatgggttggtagagaaagtctttatgaatttatttatcaaagaaggaatatctacaatgtgcagatgtgtgtgtgttaggaatacaaagacttatgaaatatgttctccagagctcctctactgtatgagagagagaagtagaaggcaaatatttgcattatagtgtgctcagtgctgtaataagcatggagaggtaatcattatttcaggaaaacttattgattgcttcctctgtgtcttgataacagaatgtgctaggtgctgggcatacagacaggaatgacatacagttgaatagctaacaatcccagtactcacttatagatgtcaagagtatctcagctttgcatagcactggataagtctcttctactctgtgcccctgatagtcttatggatctctaaggatcctgttctctgaattgtattagatgaattgtcagtcaagtagtattttatcaggcaccaactgtcttaaactggaatatgctgtcttgagttagggtatcctgctggatcagacccaaaaatgtaagggcccaaacactaagaagttcatttcttgctcatcaaatagcccagggctgctggtccagtcttcttccatgttgtggctccattatccctgaggactttgcattgtgtgctgattaagacagttgtcactttcaggtaacaacagattaatgaggaaagacagccaaggtgcaaacaggtggaagagacacacttagtctcttaaaggccctggagggaagggacatttatcactccactcagattctactgaggagaactcgtggcctcacttgtcttgcaaagaagactgggaagcgtggaacccagctaaaacgttatgtgtgctttctgtttctgttgacaaggaggaaaatagattttgattgacaatctctatacctatgtgaagctgagaaaaaaaaagaattttccgccaggcgcggtggctcacgcctgtaatcccagcactttgggaggccgaggcaggcggatcacgaggtcaggagatcaagaccatcctggctaacatggtgaaaccccgtctctactaaaaacacaaaaaattagccgggcgtggtgccggcgcctgtagtcccagctgcttgagaggctgaggcaggagaatggtgtgaacccgggaggcggagcttgcagtgagccgagatcctgccactgcactccggcctgggcgacagagcgagactccgtctctaaaaaaaaaaaaagaattttcctttctctgggcctcaaatgatcaacatttgaatgaagaacatttctgtgggtttctttcccttgaggaatatttgtctttattcataagaaattttcttttcggccgggcgcggtggctcacgcctgtaatcccagcactttgggaggccgaggcgggtgggtcacgaggtcagggatcgagaccatcctggttaacacggtgaaaccccgtctctactaaaaatgcaaaaaaaaaaaaaaaaaaaaaaaattagccgggcgtggtggcgggcgcctgtagtcccagctactcgggaggctgaggcaggagaaaggcgtgaacctgggaggcggagcttgcagtgagccgagatcgcacgactgcactccagcctgggtgacagagtgagactccgtctcaaaaagaaaaaaatgtttttcttttctatgcctcaagttggacctaattagagaaatagaaggcataattcttgccctcaaagaactgaaaaggtagtgaaggaagtaggagtcttaggcacactcgtgtgtggggcagaggctgtgtctttcttattctctgctgtatcaccagcacccaacacagatctggggtgtactatttgctcaataactgcctaattgaattacaagcggtctaagcgcatggctgtcaaaatcacatgtggtgtggttgatggaaagacaccagtggactgtgttagaggatgttacaaacagaaactctgcgattgctagggaagtcaggagatgacaaagaagcatgacccccaacatgacccccaactgactgtgactttctgggttcccagcgttccctgtgggcatgtgaagctgtgtgcgaagtagattcctccaggtatgatgagcacaggtgctcttccagaggatttattccgttctgaccacctgcctgcctgttggccaagtgtaaataactggtgcaacacagccccagcactttcctgagtcatcgctgtgagactgaatgaagtgaaggccaagtgtctagctgtaatgtccccaaagcaggcccagtcttccggcctttgtgagatccatttttactaggttagtatacgcattatcgcaagttcactattggccttagtatgtggagaaaatttctaatttgaattctttttaggagctatgttgagatataattcatataccataaaattcaccccttagtttaaaggggtacgattcagtggtttttagtagattcatagagttgtgctgccattactattaattccagaacatttccatctcccaaaaaagacacccttagcaattactctccatcccccctcctccatactcaccagccctagccaaccataactctactttctgtctctgaggatttgcctattctgcatatttcatgtaagtggaaccataggaaactaaactaggaagtgtcagaaccaagatttgaactaaattctcttgtctccaagtctcaggctccttccctctcattatcactttttaaattcattttcctgccacctcccatggtggaactttagtcatgaaagatgcttctcctttgaagcttccgattgtcctggctaattaacttgcataagtgctgatgctcctaggagcctagccatcttgcagttgcttgagttcttggtatgcagttttctcctttcacaaaatgaggctttggtatggctctcacacacctgggaagtttgggaagaagggtaccttcctcttctgtgcttgtgtccaaattagatcatggcattcttccttctgtttccacatcctgtttcagcagtaatttcataaagccaagtctgaatgtagaaggcctagtttaccaactgctctgctttctttgccttccctctgggcttaatcttttccctttgtgatttctctctcttcaagaccagcttggatgtcctcatctcacctggatgaaaaatattcttttattggaggagcatggtgacaaacaacttgtgatttgctgactcatacctcccaagagaaggttctggccattgaaagctagctctccctgaggacttggcatttgagcctgacagacggcatttgacagagccatgtcattcattgcaccccttcatacctgttctaggtttagatttctactctttcagccccataaacccaattttacatggactttaaatgaaaagacataggttcttctaaactatgcagctgtcatcagtgcagtcagtgaaaaggcattctgtctgcattagctgcgacaacattagtaggctactaatgaaatgaatattttcatttaacatctgtaaactctgaaatgcaagttaatcatttcagagaagagaccagatttgtccacatctgaattcgtattcagaatcaactcctcttctcttctcctgactttgcttactctgaggactgtgaggcctttgggggcaatgtagagtgtgtaaacctggtggcacgacagattgacaggtagcccaggtgtgagacattttgtctgcagacaaccgtcaggggcttgcccagcagcagttttgtgcagagccctgtttggggtgggctaggttgtggggcagtcaggagaacacatactttctatcctcaaggagcttagtgtcctccagctgggtgggtatgactgtagttcttgaaaatgctagaaaatattatgctgagttttatgtgccaactcttagcagagaaagtggagatagctttccggaagaggagagattgattagagcaggaccttgaagcctgggagggtctgagaggtggcgtaggcacagcacagtaccttggactcagctagttctggttttagattcaagctctgcctattattatgtgaccttaggcaagttgcttaaacctttaaatgggggaaaagagctgttatgagaattcaaactgtgcacagctcaacaaacaatatttccctcaggttaaaggtgggaaagaagaacaaataggaaatgaacttctctttgggggacagtagaacagcatcctgataggttagagtatagggaatatataggcttttaggggggaatggtgcctgttttttagttcttgagttatgatattcatctttttccaagaaaacatacagttaatcttctgtttgccctgcagagcaataccctttttatcccactacagtggtggttgacttgtctctccctggctgagtcccagctgtgcctgactaaccgtgtttctcttgtatctaggagtgctcccaccccagcccgttgctgcccagctattggaacactgtataacaccaacacactcgagtctttcaagactgcagataagaagctccttttggaacaagcagcaaatgaggttagctgtgaaaacgtgatgtatgtgtcatatttcctgtggtcctggcaggtgcagtgtttgtgatcaggcacatgggtctgctgcagaaactggcatatgaagggaacttaaagacacttgtgggctttggtatatttctccagagagaatactcccagctgtctccttctgtattggcaggaaggtcagggagaggacatccaggctctcacctgggataggctggaaataacatggcagggcagaggttaagtaatcagtttgctgctcatctccagccagcattttgaagcagccagacctctgagagttgtgttcctgtggctgaatgcctctaggcactctgtttattgtgccttggagaggcttggcaatcctgtgcaccatggcggtagaggagattatcatgtagtctctgcagtgtcttcacttatctactgcatctgattttcaaggcctctgtggcctggccctgttttcctcttttcctttctgacctctttactcttgcccttgcattctctgagtctgtcatagcaaatcacatgtaattccttctacctactttctgttctgtcctctctccttgggaatacaatatcctctctgcctggaatgtctttcctttgcttctttacattggagttagtgagaggaattaaaatgggaggtgggggcagtttatcccaatcctgtctaaccgctgtaatcaaggagtctttataccagtctttatcacgacatgaatcttgttggtgtgggtgcagtggtcaggtcctgaggcaggcttccttcacatccctcgggatggacgcagctgtgactcaggagaggatggtcgtttttcttgacctgtggcttgactgctcctgggcctcctgctttggctgcacatttaaaagggagtctccaaagaattgggtcaggccttaatcatcttggaaaaaagcaggctctgcccccacaggaatatcccacccctcaactggggcccagaattctcctagcagcttctgccccatgccccctcggcttaccggaaactgggggcctctcttcagtggtccagcttctccaaggccagtatgtcagtagcaggaacttacttctgcttacttatttccctcttccacccacacttagggaatgattcttattagtgcaactgttttgtcttgcttagtaacaccaagtttagctacgaatcttatctacaaaaacatcttgtgatccacagctgctgaccagcaccagcatttgctcctagtctcagtacttgctgagtatacataaatttgaagtttgttcttctttcttcatctctcagggcaagataatctcaaataagacttcaagaaacccctatgtgtatttcacagcatttcctttgagagcccctcccaggctctttactctccccgttccccagcagagtctgcagaggattcctcccataaattctacctacttctgtgacagcaaatcctacatggtggtgaagttatacatttacgccagtctctctatctagactgcgagtgtcttgagggtagggactgactgtgtcttttatttctgtaaccctgatgtgcctggtatatagtagacaataagtaaatatttgctgaaggagattgtgaaggcatgaaaatggcctggttgccccctcggtgctgagatctgctgagaggaggcgcctgggttccctcacttggcttagatgttgaagggagtgtggctgggagagaggcagtgtgaagtcggcagagtgaggtaacaacccacttcattgtttggggtaagtggtgctgggcctgtaggaaagaagagcctggtgcttttcagctccacacttcacctgagagtgagaaactcagagatgcctggtaacctgccttgatgcttttcttcttcttgcagatatgggaatccataaaatcaggcactgctcttgaaaaccctgtactcctcaacaagttcctcctcttgacatttgcagtaagtaaatgggctctcggttgcaccgaggttggtgaaatcccctggcttagcccagtgtaccagtagaacagtctgctcttctctccgaagctactaccttctgttacttaaataatagctgttaacgaaacgctcatttgattagtggccagatagtgctggcacctattaccaatgctaacttaattcacccctatggatcatactggcagtaattgcatagtttatataacacagggcatgataaagtcaggttcagggaatgtggtttcattgttgctaacgcctttgttaaataccatcctaaataccatctaaataaaggaaaggtgcttctggattagaggagatcacactgcatagcttgaccacaaaatcgcttgttgattttttttttttgtttttttaaagacagaaacatgttttctgtaagcgaaatctaattaaaatgaacgttaagggcagccttgaaaaggaaatcgtattagggtaacatgtgctgcccagtgaagaaggggtaggatgtagatggaaggacctggccttggtgagggaaaagtagggaaaaggtaagggtcgattatagagataccagctatgcatgcatgcgcgtgtgtgcgtacacacacacacagataccagttatacacaggcacgtgcacacacacagcaacacacagatgtgtgtatatatatctgtgtatataaaactaatttatatcctttattattatattgactatataacattctgtcaaatgtatgtttcatagattcctgttatatatttaggtggtttctaatattcactgttataaaaaatgctagtctgggcacagtggctcatgcttgtaataccagcactttgggaggctgaggcaggtggatcacttgaggccaagagtttgagaccagcctgggcaacaccttgtcacttcaaaaaatataaaaattagctgggtgtggtggcgcctgcctgtggttccagctactggggagctgaggtgggaggatcatctgagcctgggagattgaggctgcagcatgccatgattgcaccactgcactccagcctggacaacagagtgagaccctgtctcaaaaaaaaaaaaatactgtggtatattgaaaaatatataatattagccatattgatcttttctcctgctcattttacttctttagaataagttctttggagcgggcatataaacacagtaatgttgctgtgtattaagtgtgctgtttcaccacagcatcatcagctttggacattaatcctctttcccacttctttttttggcaagttttccttccccgacctcccaccgttcctcctagattcctagatgcaggggaggcctctgatttattgcccaaggcaaaggagggtatgatagcaatcaaacaaggccagtgggtggctatctacaaggaacacattttctaacaagttataatgctttctatgtaatagtggaggagagagaaaaatgtttaaattttttgtctgattacttggctcagtttggcattaataatctgtctatacgtttgggtaattctgtagttttttttttttttttgagacggagtctcgctctgtcacccaggctggagtgcaatggtgcgatgtcggctcactgcaagctctgcctcccaggttcatgccattctcctgcctcagcctcctgagtagccgggactacaggcacccaccaccacacccggctaattttttgtatttttagtagagagggggtttcaccgtgttagccaggatggtcttgatctcctgacctcgtgatccgcccgcctcggcctcccaaagtgctgggattacaggcatgagccaccgcatgcagcctgtaggctctttactgggataaattgtaagcattgctagttaaagatttctagttacttgaacgtcagtacgctttctgtaccaagaattctcatagtagaacatgctgacagtttgcatttaatgagaaaaataacattagctcttacttaaagttttaaggtttgcctagagtcagtatgtgtgttggtcttgctgccttgtttactgagcattcttagcctgacttaaaaaaaattgtaagtatctactttttaaaatcttcagacaccaaggactttatgtttaatttaatggaggtcatttctatcctgaaaagaatcctaagaaatgcaagctttttgacttttgaaaatgacctgataaagtttcttagaattcgtgaggtccggccgggtgcagtggttcatgcctgtaattctagcgatttgggaggccgaggtaggcggattgcctgagctcaggagtttgagaccagcttgggcaacatagttaaaccccgtatctactaaaattaaaaaaaaaaattagctgtgcatggcagcctgtagtcccaactactcgggaggctgaggcagaagaattgcttgaacctgggaggtggaggttgcagtgagctgagatcgtcgtgccgttgcactccagcctgtgtgacagagcaagactgtctccaaaaaaaaaaaaaaaaagattttgtgagtttcttcatcttgaattgtttaaccttttactaaatatcggttatgacaaatcatttaagtacaaagaagagaaaataatctctggaggtgtttttgctttccttctgctgttttttaggactcataggactagacagttcattaatttcagctttgcagttcattttgccattgtgaagagggaattttttcttagttgatcaatgaatagcagaattagagaccgcagagattacaattattagactttctcatctgtacacatgattacatatacatttacattttaaaactcatctagtatgatttcatttatatgaaaagtccagactaggaaaatccacagagacagaaaatagattagtggttgccaggggatgagaagagggggaatggggagtctctgctaatatgtatgagatttctttttggagtgatgaaaatattctggaattaatagtgatgatggtacaaccatatcactatactaaaaagaaaccactaaattgtatactttttaacatggtgaattttatggaacgtaaattatatctcaataaaaagtcatctaacaaccatccaattttaattcttagcaagattcaagaagaaatattaattagctacataaactgcattcatattcagtggtcacaggcttgtaggcaagctgccaaatacccacatatgtctggaatgctaccatgaatttaattaaggccccaaaagctgtaagaattctgaagcaagagccattagcgtgagtgggaacagtgtcaaagacagcctcacaaatcctttcccctggatctcctaccctggtgggggatcggtcagatatacccgtgaagatgtaacctcttctattcacccatccagcttactacttagagcctctccatggctctaatcatgcactcgctttatctctgctctgtccacaaagtgagctgcctggtgtctgggactggggtttattcatcttattgtcagtgtcttatgttttgccttgtacatagcaagggcttgatagttgttgacttaaatccactaagccatttacaaaagcaatattgtattatttcaggcatgcatacatatgtgaatagcacagcttccttaataacatgtaatttatttgattgtgaagagaatggtaactgtttggaagttgtgcttctgtagatagtacattaagtatctatggtcagtggaaaaaagcttaagttttggaagcagagttctgatctcttctctgccccttgccatcttttttgttgttgtttaggttttttacccctttgtaagattcagttttctgtttataaaatgggataatagtaaatacctcccaggggggttttgtaggttaaaggatgatgatgataatatcaattacatattgcacattttctgttagcaagtggtcaataaagtatattatgtttgtcatcatattattagtggtggtatatgagactattttgggaatacaaaagtcctttatttgatcatgagttctgttggggatgaggatatttgataagctggacagactttgtttgcatagctttgctatcttaattggccttgagaagctacattaatagatgcatttcaccttaagttaatggtgctattctaataacttatttatacttttttttctaggatctaaagaagtaccacttctactattggttttgctatcctgccctctgtcttccagagagtttacctctcattcaggggccagtgggtttggatcaaaggttttcactaaaacaggtatcaacaaataaccaaaatgcacataaaattgggttgaatgtgcaagagtagttatgtagttctttccaaagacaaacaggcacttctctggatgaagacgtggtaactgaaatcctccaaaggtggtactaggagcagacttatttagaaaatgtttgtaaagtcatttttttgtatatatatttatatatgttttgagactgggtctcacccccattacgcaggctggagtgcagtggcacgatcactgctcactgtagcttcaacttctcaggctcaggtgatcctctcatctcagcctcctgagcacctgggactacaggcatcccatcacacctggctaatgtttgtcttttaatagatatggggttttgccatgttggccaggctggtcttcaacacctgggctcaagcaatctgtccacctcagcctcccaaagtgctgggattacaggcatgagccaccctgcctggtctgtaaagtcattttgaagatgtagtgcacagtaattttccaggttttcagtggtatttggtgaaatgctaagccagtaagggggaattataggaatattttgaaacactgaaagaatttaccaaaatgtggtcttcattttcaatgtggggaaacataaggcagtatagtctgggaaagagtctttgaaacaaaacagaaggcattctcctacccttgtaccaagttgcagaacttttctacctggagcagtacatgcagagttagtcggtgacatttgggatagataataagttcattagagatggttcccagaagagcagttaaaataatcaggctggtataacagagaccctaaactagagaattcttattgttgttaaggcaaagattatgtgtcaagatgatttgaattcttgaaacacatcaatcactaaagccctgaatactgatgccatcattcagggagctctcttggagctgttcagggagcagccattattgattaaattttttttgttgttgttcgtacaaatccgaggttgtggttttgtggaactaatttcccaagaggaaatataagtaaggaaaaaggattttggctgagtattgactgctggcaggtatggggtttcttttattgaggacaaaaatgttctgtaattattgctgtggtgcttgcataaccctgtgaacatactaaaaaaacaaacagcacattgcattatgtactttaaatgggtgaattgggccaggcacggtggctcacaactatagtgtaattccagcactttggaacgcagaggtgagcataccacttgagctcaggagttcaagaccagcctgggcaatatcgtgaaaccccatcgctataaaaaataccaaaaaagttagctgagccatggtggtgtgtgcctgtggtcccagctactcaggaggctgaggtaggaggattgattgagcccaggaggtcgaggctgcagtgagctgtgattgcctgggtgacagagcaagaccctgtctcaaaaagtagtaaatgggtgagttgtatggtatgttagtcatgtctcagtaaagctgttgaagattatggaaaggttcggggtaaaattcatcaggggtagattcatgttgggttatcataggagagaaagaatgtttcgttaccgctctaaaactctgattgacagcttagggaactaccatgttgtagtccctttgtgcccctaagacacacaccaccatgcccctggaaagtgttatataaaagctaagtggtattatttggaggcacttctatgttcacttgctgtaatagagtaagaggagtgtgatcagtcatttctagtcttctggttttaaggtaccttttttttgagttagtttttagcccagaactagaaatgtaattttctagagaataacaacgtgttttctgttttcagattgaagcactagagtgtgcatatgataatctttgtcaaacagaaggagtcacagctcttccttacttcttaatcaagtatgatgagaacatggtgctggtttccttgcttaaacactacagtgatttcttccaaggtcaaaggacgaaggtcagataaactttgagtatcattttattatatagttttttaaaaaatctgaagttcatgttacaagagaccactgcaaaattcaaacttgtttagatttccttagccttcaaaggatgtttaagaacatttccttatctctatcctctcccacccctacagttatcgaatcagctcctctaggtttttctagctctactacagctcagaataattttgataccttactctttttttttgtttgtttgtttgagatggagtctcgcactgttgcctgggctggagcgcagtggcgcaatcttggcttactgcaacctctgccttcctggttcaagcgattctcctggtcagcctcccgagtagctgggactataggtgcccgccaccatgcctggctaattttttgtatttttagtagagacagagacgaggtttcactatgttggccaggttggtcttgaatgcgtgacctgcttcggcctcccaaactgctgggattataggtgtgagccactgtgcccagccaataccttactctctattagtgctaaagttatttccgttttccctcctgatgtattttaccctctatgttttaatttttattcccagaactaccctgtagttcaggcccctcatatcacactcctggacacttagaatcttgtttccatgttgtgcaacactactgtagaagaatctcccttgaactacccacatttagtgtatcattcattgaccaagagcataatggtgtcttccttctggctccaagctgcctttcctgccttatcttccattattttcctcataaagcattgctccagctaatcttatctatttttctccagaatctccatccccttcccgtcagatacatctaaaactttttttgtatctttgtttttcctcgtgttgtatcatcttcctaaaacatgttctacttgtgaaaaccctaagaaattctctctgtcttattgaaattctatctccactgtgaagcattatcatggtgtggccatatatgatctatccctatctgaagtcactgcatttattccctgatcctcatttgcaggtccagtaccttgtacaagtttctttttgtgccatattagactgtaagctccaagagggcagggcccaagtcttatgaatttgtgtctgcatagtgtctagtacttgtctgaggccctcaataaaattcttttgagtgaatgaaagagtaccgtaaatgtcttttagaagtgatcagatatataggaagttgtcttagccatacaggagactatgaattaaaaatatcaaagattatgagtgttatgaagttctgaaatcaaatggaatcatctccatagccatgtgaatatatcagagctgaaaaaaggaaagcctttaactgacggtctggttattctttagcctgaacttaggatgacttttttttttaaaagcacattttaaaatcaactacatttacattttatttttcagaggaagcccacctccccttttttgttgtatttttattagagatggggtttcaccgtgttagccaggatggtcttgatctcctggccttgtgatccgcccacctcggcctcccaaagtgctgagattacaggcgtgagccaccactcctggcccagaggaagccctttttaaattgaggactgaagattgaatttttattaaaattctttcccccaggtgatttcacagaaccacagctaaattagtatagcaataagaccgttaataatttaaagtccaatctagtgtgaagtcctcttgtcatagcaggcaggattaaatggcctgtgtttggaagcgaccgtaggtcaggttgtatgtggtaaataagtggtcctccccaaagtgcagctctgccaaaataataacagtttgaacagtgctttacaattaatttaaaagggactttcacatacttgatctttttatgataagtctgtgaaacaagcgttagttactacctgtggttagttaattagtatctgcattttctgtttgagactcaaagtcacacgaccacattgtctgattccgaagcctatgccctttctttctttcttttttttttttttttttttgtttttgaggcagagtcttgctctgtcgcccaggctgaagtacagtggcacgatctcggctcactgcaacctccgcctcctggcttcaagtgattctcctgcctcagcctcccaagcagctgggactacaggtgcgcaccatcatgcccagctaatttttgtatttttagtagagatggggtttcaccatattggccaggctagtctcaaactcctgacctcgtgatcctcccgcctcgccctcccaaagtgctgggattacaggcgtgagccactgtgcccggccacaagcctatggcctttctaccattcccttgaccttggggaaactgcataacttttctttgtattagtttatctgttaaatggtggtaatgccacctccttataaggttttgtgaggattaaacatgataatgtgaataaaatgctgagcacatggtagatgctcaatatgtatccacttcctttatgtttcaacagcagtatattttgaaagacaacaaatctctggggtctcctctgaagtgctctgagggattcaccagaaacctgtccctgagactaactgcctgtctgcttgtcggattcaggcacactatccttcacttggttagggtggtatctcaggaaagcctggaattactcagcacacgtgatgaacacctccttatgggccagaaattttgagatacagttgtacttgttctcacaccacctaaggtcttctagaggagatcagacattgacctgtggaaaattaaggagaaattcaagtaatggaagataagttcagagaattgatacgggtgatactttggttggtcttctatgccttatcttattctaggaaagatcaccagaagccttagagcatgatggcctcataggagttttatagccttcatgctgcctttcctacctgtggccctgaatgttcctgtctcccctccacactgctgtccaagtgcattttctaacgtgtaaatttgatcatgtaactcttctacttaaaacccttctaaggttcctgttgacttcgggataacgttaaaactacttagcttggcgtttgaggtctcttcagttccagttcctgtccaccactagcctcatttaatatttcccaagatacatcctgtgctctggctacccctgtgccctccaaatgccgcagcttcccccatctctctgcctgcagacatctctctgtctcccttctgtcacctggctgctgcctcacctacctttctgattcattaccccaggaagcactggctgattgcttgcgccatttcatttctctcttctgtgttctggtagcagcctccttcctagcactgactagtctccaaagtaattgttgatttgcttttctgcctgccccatatccccagcctgtgagcaactttagcacagaatcttgtttgtccccactctgcgtcctcaacatttagtgcaatgctggacacttaagagacacatgatgtgagaatgctgagaggaaagagagagaattgtggactggtatgaaaattaaagaaggcttttgccgggggcagggccgaaccctagagaaataatttctagacatcattttcagtggttcttgcttttattgcattaaccttgttcactctctttagcatgattccagtttcccttcgagccacgacatttccttgaaggttttcaccctcttttttcaaaaataggcattcttttcagtatgaaatcctgcacttgtgttctggcttcatgttttacttgattctgccccctcctcctcctaccagcactttgttccctgaaaagtcactgctgctctttgagccctgtgtcctcatgtgtaggatggagaaatgttggaatccctctgagtttctctcttcaacctgtttctcttctgggttatctcattgtgcctacaactccagaaaccatttcctcccaagtaattcaattttctctcaccggcctgaacctccctctggaccccgggccatattatccagccacctgcttgcctccttctgcaccttacaatctttgccccaaggctggtccttttctggcttcattggctcagaatgatgctgcttctatccagtcacacaagccagaaatctggttatcctaccggacagctgtcttccccctaccacccctgtgtcttgtggatttcatgtcctgaatgtctctcagcctaccaccttgcgtttcttctgccaccacctcaatctctgctatactgcagcagcttcctaacaagcctccttgtatctactgtgggcctctccagttcattcccatatcatccccacagttttccttagaaaagcagatctgatcgtgtccctatcataatgaaacacctgaatgtcttcttccctgtgctctaagagtaggggctaaattctttaatacggcctacaagagtctgtgtggcctggcccctgtgggcatccagccccaagtcattccgtgttccctgccacagggcttttgcatgcaccttttgcctggaactctcttctctctcttttctttacttctacccctccctccccctacctcccctttgctccgttaagtgctcactctttcaaggaaaccttccctgacctctataaaaaggtttattccttctgttgcgagctctcatagcactgtgcatcccttcttcttttttttttttgagatggagtttcactctttgttgcccaggctggagtacaatggcatgatgttggctcactgcaacctccgcctcctgggtccaagtgattcctcctgcctcagcctcctgagtagctgagattacaggcatacgccaccacacctggctaatttttttatctttagtagagatggggtttcgccatgttggccgggccagtctcgtactcctgacctcaggtgatccacccaccacagcctcccaaagtgctgggattacaggcgtgaaccaccacacctggtccataattttacattttcttgagtgatctttgattaatatatttttctcccatttaaatgtaagctctaccaggacaggtaccctatctttgatttcccaccattgtgtctgcatcccatggcatcatgcctggtgtgtaaaatgcaatggaaggatgaattcatgcataaatgagttgtgaagactggagattgctcatgggaagcacctgggtcagtgcctggcacacagtaggccttcagtgagtagagggtagctcttattattagttcattgtaagtgttctctttaatgtgagcattctgttgtctggttaaggccacgtattttacaaagactttcccaaattgtctgtacacctcaatttatgtctaatgagttacacacatggttactggcgtgacaggagacagaatacaggggaggtatatgatctgcatggctgattcagagcaggggttcttaatttggagtagggtgcagatgcgtaatgtctgggaatgttttggaagtaatggatcctcaccctagaaaaatccacatgtgcacacagttctgcgtctaatgtcagagacgcacagagtgctgacatgcttggaggaagatgaaggaaaagacaggagttagcctgcctagtggggagcctatggattgttaaggtcaggaggtgaatgagtcctctttgttccaagtcagagtgggagctttgcatgtggaggtactgttcacttgtgtgtgaagccttggctgactatgagagagtgggtacctgcccctgaagaggacacattgccagccaccaacagctgggactgccatggtctcagttttgaccgtgaccagcatgcagctggtcactcatacatgttatcacttatccttacatgccctgcaaagtgagaagtgttgtctgcattttacagatgagatgaatggaaaagagactagggaatggaagcctcttcaaatgtgaatgatcttacctcctacagtgagaatgcttcctatagtgaaaaaggaagcagccattttttttctgctcagctcacaatgtgttggggtagagtaggaaggccagacttcagttcccaacagcttaatgggtcgaaccctctgagcctcagtttcctcagtgtgtataagcatacagtaacaacacccccttccttgtaggtggctgtgagaactaagaatcattaagtttcactcacatgttctaattgttcccactatattttcttagaatgtttttcagttttcattttcaaaggaaaattttctttgattaaccccagtttccagctattccataaaaatggagttttaaggtcccgagtcacacagccaactctgcctttaccaaaggaaggcataagagaagcccctcctgagattggcagggttgccagttcagcagcccccgggacatccaagaaagttttaccagttcactgatggtattgtctttaaatgaaagctcaaaagcaaatgcgcctgtgattggtttcatctcacttcttgggtgatgtatggttgttactgtgattgcttaatgctggagttctttgtcatttatagttaaaaatacctgttataacccaatacatgtctttgaatctgcacccacacatacacataacaaaacaagacttttgcaaaataatgctttcctttttctgttttatctttttgaaaaattctagttgtgacccagtaaatgatttaagaatcgcaaatagctcaccacctgcagtttgaaaaatgctttgtgaccattttatgaccattttggaaatactggcaaataaatgaactgtactaggtgaggttccattcattagttttacttccagctatatatctctgtttttaaaatgtcgcaaaggttttcagctattcttttacatttttaggtttttttaatatacaaactttttgtatatttccttttaatcctgtgcattttttaaaactaagattgtacagtattttgttttattgtagcattttagcataatagtattatattctacacaacatcctttttaatggatgtatgatagtatttttaccaaggttttgacatttatatttctcataattttttcactattaggactgctttgtgcatcaaatttttcctctttttcctctccttatcccctgtagttttaattatttccatagaaaagatgtctagatgcggaattactgcgttacagagtttgaggctgagcgtggtggctcacgcctgtaatcccagcactctgggagacctaggtgagaggattgtttgaggccaggagttcaagaccagcatgggcaacatagcagggctctgtctctacaaaaaatttaaaaattagctaggtgtggtggcacacacttgtagtccaagatactctgaaggctgaggcaggaagattccttgagcccaggaatttgagtctgcagtgaactgtgatcgtgccactgcactctagcctgggcaacagaatgaaactgtcaaaaaaaaaagttagaacatgttaaggttcataatcagtggtgtgctggtaaatgtttaacagccagctcttgtgaggtaggaatagtcctgtttttgtagtgttttcttacttgtatggtaccagtactaccaccatggccaattgcaggctaccagtgtgaagtcctggaatgccgaattgaaaagagacattaacagttggctcccagaaaagcctgtatgggccaactccagcacaacactgcttatcataaatgtttccccaagaccctgccagcttccctcctaccagctgtgtacccttaccaggatcagatgttgtagtattgtacacatgtgttaggttgaaaatgggccttaagttcttctctcaatgaaatgtggattccacagtcgcactccattgctacaacagatcaccatctttcaggccagttcttgtgattacattaaaaatagctcataacattgtcccattaccaatcttttggggaaggttacttgactcttctacttcattcagagcagttattgaagattgaatgtttgggaaatgttgtgtaatttcaacaacattagcctttaattctagggctttaaaatctgtggacaagagcaatagccaaggagcaacaatttatatgctgttagttgggctctttcttcacttagtgatctctccgcatcttggcagctgtctgtgactttgaagtgcattaggtatttcagttttttcccccatactttaaaaacgtgtaatctcctttgtgcatttcctgttatatcaagtgtttgagttctaaagacagccatttgttagattagcatgttttatgggatcattgtggaaaatgttcttgctgaagacaagcaagttggcaattttgccctcttttctttctcacagtgtactttttcagcaaattgcttggcagactgatcatgactgaatcatttcaatgaattgtatgctctcagccaagtagaaaggaacatttatttcataaagcttctaaacaaagtttttcttcagttacgttgagcttctttctgctgatttgtattacaaaaggaagtgatttgcccaagttcgcacaattaatttgtggcaaagccagttctaaaaccagaactcctagtcagtgattatttatgaaaaatattttttaaaaaattctgtttaaccgtagtataagctggcttacctagcattgtgccaactaatcattcctccaatgattaagatagattctgagttgattcctaaagcacttaaagattttggggtcacttttgaatcatcaaagaaagattaaatgatgttcagcttagtgttaaatggattttgtcattttcctattcgacgcctgccttctgcacttatgcctcatatgggtaggaaagttaccttaaaccattttcaagctgacctgcttttatgggtaagtggtagattttcctccttagcagatcattcctgctctctatagcccatgttaggtcaggttgctctaagaaacttattcctagtcttttctgctcaaaaaaagatttttttttcactattctaccccattgcctttgtccttagggtaagaaatatgcttattctttgaaattaagcatccacttgtagcatctaacataatattctagtttatataatttagatatcatttagttccaactctacatttgcacatgataaagcctagaccccgagaatatttgatagactagaacttatccctttcttttctttgccagttaagaaaaaataaccttgaaactgaagacagctaactatgtacagtcacatgccacatgatgtttcagtcaacaatggaccacatatacggcagtggttccataagattataatactgtatttttactataccttctatgtgtttagatttgttcagatacacaaataccattgtgttacagttacctacagtattaagtatggtcacatgctctccaggtttctagcctaggaacaacaagctataccaggtagcccaggtgtggtgtagtaggctatacaatctaggtttgtgtaagaacactctgtgatgttggtatgacggtgaaattgcctaacgatgcatttttcagagtgcatccccatcgttaagcatgactgtcatggtggtggattggactgaacaaagaggtcaatgaagttactgcaagacagtgtatttatgttgcttttgttgttactatttgttaagcgctggcctcattctcagtttctgtgctaagtgcagttaagaattatcctataggccaggcgtggtggctcacgcctgtaatcacagcactttgggaggccaaggtgggcagatcacctgaggtccggagttcgtgaccagcctgaccaacatggtgaaattctgtctctactaaaaatacaaaattagccgggtgtggtggcgcatgcctgtaatcccagctactcgggaggctgaggcaggagaattgcttgaacccaggaggtggaggttatggtgagctgagatcgtgccattgcattccagcctgggcaacaggggcgaaactacatctcaaaaaaaaaaaaaaattttatcctatagatgagaaaattaaggcatagagaagttaagtaaattgctaaaggttacacaagagcaagtgatccagaatgtttgattaagggcccaggtttatgaagtcatttgcaaattgtaactcagtgtctctgtaggaacggcattttctagattgatactgcctaggttcttcctaagtaacccatttaatagcctttgtgtgttttttgttgttgtttttcctttgctggtttgaataccctttagatactctgtaagattgagctttgatatagtctgtgttgttttgtgacctatagggtattttcttcttaaacattctctaaagttctatgattctggagcctgaagaaatcctttgagatgaaaggttcaaccccttcatcttgcaggagagaaaggaacttcccccaatgtcttaggatcagttagctgcagaattaaaacacatacctgcttactgttaagcaagtgagtttttcactacatcaggccattttctaattgtaagctgtttcaatgttttggaagtagaaatgctagtttctcccttctccccctttttacacttgatagagttgtaaatgctgttttttttttgttgttgttgttttgtttttgagacagagtcttgctttgtcacccaggctggagtgcagtggcccgatcttggctcactgcaacctccacctcccgggttcacaccattctcctgcctcagtctcccgagtagctgggactacaggtgcccgccatcatgcccggctaattttttgtatttttagtagagatggggtttcactgtgttagccaggatggtcttgatctcctgaccttgtgatccacccgcctctgccttccagagtgctgggattacaggcgtgagccactgcacccggcctagagttgtaaatgctttttatgaataaaagcaatgtgaagttgaagcgacgattgctaaataaatgtagttgtgtggcagacgctatctgtcatgattggcagaggggagcaaaataaaaagatgtccctgatggaagagtagcaggtggggtggccacatggaccagaagagctcaaggaagacaacttcttaattcggtggaagccctggactggaaatcttgttctcagagttctctcacttctcatccgaagccctctttttttaaatcttactttcacattctcacctaggagaatcccagggttaaaatgccatgagaccctgtaatgttgagaaaggaaagaaggaaggaaaaggaacttgctgagatgctgcatcacagttttgtatggaagcttcaggtctgcgtcagtcaggcatcacttttcctgctctagctgcctcccaggatccctgctcaagatctttgcagagggggagtccgtgtattgaagcctggagaaatgtactagtctgtcatctattcaatagatacttgctgactctcaggcactgtgcttaggtaactagagatggaaagatgaatacagtgctcttgccttcacagagagttataaaccagcaagacatcaaatataacatgcatcctgtgttttctttattctaaaatgcttgtttctccatattttaatttttctacagtcaggaatttcttacaattgtgtatatttatgcagtgaaccctcttttaagcaaatattttcttcttttgactgtagacagctagtgctaagatgatagtgtacataagaatcacatgcggtattcactggacatgcaggtattggtggtacctagagaggtctgggatcagattgagtgtatgtatgtgtgtggatagggtgttgtgcaagttcatcaagcttctaggcaattctgatgcaggtggtctctgctggaccatactttgagaaattgctgcagacaatcaagaagtttgtaacttgcacattagaatcacctgaggatcttttaaaatgaccagtactcaagccagactccagatcgattaaaccagaacctctggaggtgggacccaggcagcagtatttttgatagctccccaggtgatacccaagcatcttcaagtttgagatccacggccattagaaggttgaggaggagcagtgcttctgaaacttccatgggtgtatgaatcacctgggttcttattaaaatgcaaactctgattcagcaggtctggggaggaggccggggattctgcatttctgaaggctcccagggaaggctgatggatgcatgctgctggggcatggaccacattttgaggagtatgggaagatgtagggccaatccagagttttcaagataatgacagttcagagatgttttctttggtctgtaagagcaccctctctaatacaccccaaattcaagtccatggagtggaccagctgcatcagaattattcaggagcctggtacagataaagatacagattgctgggctcaccactggagattctgagtctatcaccaataatgatattagtagctctatgtatgtgctggacttttcatgtttagtatcagctcatttaatcctcactacagctctatgaaataagtaatatattatttcctccatgattaaactgtggcttggagggttgagtacttttccctaggcctcatttagtaagagactactcagcgtagtaagctctgtttttaaaagtgccctagatgctgaaaccttatctctgtgggaaaggaaatctcaaataaaaatatttcctgaaaggatgaccatatctatgaacctgtttgtattaaattaaatacgaatctgtctatttgcgtttaagaaacgaacatgcatttagaaaaaaaatgcttcaattttaggaataagaaaattttatataacggaaaaggtagcaaatattttaaagagtgtctttgaaataatacagtaaatatctgataagaccatagtaaaattcattttcagagattgagcagatgaagactacttaattgtccttcaaaaggaaatagaaaaaatttggtacatcaatacaatggaatgccattcagccattactcacaatggttatagaacatttactagcatagaagacagttcacaatacaataagagatatgaaacaatatttaggccaggcgcagtggctcatgcctgtaatcccagaactttgggaggatgaggccagtggattgcttgaggtcaggcgttcgagaccaacctggccaacatggcgtaaccccgtctctactgaaaaaatacaaaaaattagcagggcgtggtaacacatgcctgtctgtagtcccaggaactagagaggctgaggcactagaattgcttgaatcctatgaggtggaggttgcagtgagccgagatcgtgccgctgcactccagcctgggtaataacggtaataacgtgagactctgtctcaaaacaacaacaacaaagacagtatttatagcatgatcccatgtttgtttcaaagtcctagtaattaaaatatatttatgcaaagaataagttcatgggcagttatacaccaagatgttaatagttctctcaggatggtggggttatgggtattcttctgaatattggttaagctcctactttgtggctgatactataccaagcattgtgggaaataaaagggagtgtttagggtgattccatccttacagaactaactggatctagatttaacaaaaatttatcagccgtgttttcatttaacccatgctatgcttatgaaggaaacctatgggtcaatttatggttctctgccagcaatttccctccctcacccctactcactctacatccttcctttctttcttccacccatttatccatccatctacttttttatcatacaaaaaacattcaccgagtgtctgctctgtatttatgaaggagagatgaaaaagatactttctgctctccatatgctctttgtcttccttttattaaaataaactttttattttgggataattttagatttacagaagatagtggcaaagacagtacagagaattcccatgtaccttcacccagtttcagttttttctaatgttgtcacattatatcaccacggttcatttgtcaaaactaagaagccagaattcttacattactattaactcagctctagacatttccgatttcaccagttttttcctgcaatactctctgttcaggatccagtccaggatactacattgcaattcgttgtcatgtctcctccttagtttcctctgatctgtaattgcttctcaggctttctttgattttttttgatgaccttgacatttttgaggagtactgattagttatttttatagaatgtcccttaatttgcatttgtctgatgttttcttgtgattagactggggttatgggtttttggaaaaaataccactgagtgaagtacccttatcacctgatatccacatgacatccttggtaatgttaaattgattgcttgcttaaggtaatatttgccaggtttctccactgtaaaaatactattttttctttgaaagtaaatcagtaattccagctacctttaaggaggggaaggtttaaattttgcttctgaagaggccagtatttgcttatatagtttggaaattttctttaaggaagacttgtcccttcacatttattccattctttatttatatcagtgtggactcgtagatacttattttatactttgggttataattcaacatcatattatttatattgttgcacaaattgttccagccttggctattgataactcttacagttggtgcctgtatcaccttggcatgccccaattcatttgttttttgagtacctccttctttcctgatattataagatgctccaagcttctcttgtattttccctgcctgagccctagaattaaccatgtgtccaaggagccccgatttattttcttggagaatggtatttagaagtcagtatctgggtgctgggtgctcattgtctttgaaaggaaggagacagaaaatgaaaaatgttatatacaaggttcaaagagctgtgaaagcagcaaggacaggccaactacttctgccagcagaagtcttcactgaagaaacggtattttaaattgagtagagttttccagatgaagatcgggattggagtgggatgggaaaggggagggaggaaatatatgttagcaaaatcaagagtaactggctgtttaacttgatctgactgtacacttacattggtagtggcccttctttgattttctcattgcataaaaatgagcaattttcacagattatatttctttgtttacaagaggattttctctacaaactctcttgactgtcctccttcattccccatcttccttccagtcttttttccttctacgtgtatttagctcctactttctgccaggcacaatgcaaggcacagggggtgcagacaagaatttgatagcccctgctatcaagaagttctgtagtgcagtgtgagatcctgtggctttcttctcctccccttagccctttaccagatgtttaatttttaaggctttgcagaaagcataaaaaagcaaagaggaagtatgagcaatgtctgtattgtgaagctgacatgatactcgacttactcagaaagtcttttttgttcacagataacaattggtgtatatgatccctgtaacttagcccagtaccctggatggcctttgaggaattttttggtcctagcagcccacagatggtatttacaagagtgtgtgtttgtctgtctgtctgcctttgccagtatatgttttacaatgtgtctgtttctatttgtatctctgttttcctaaatgcattattttttcattttgggcatggaaaccaggtaatcaataaatcagtcataacccaatttccatactagtgaaccttaagcaggtctgttagggacctgcatactctgatcattctgtgctaaagatgttttagtgtatggtagagttggtagccagaggtcctgacacaaattctgtagccctcccttctagctgtctgggtttctttcagataggattttcctactgctgtcattctccatttttcttaaccctaaaataattaaaacagaggatatcttaaaagccaatatacatttgaaaagatgcccaacatcatgtcattaaggaaataaaaattaaaaccataatgagatgctactacatatccaccaaaagtatttaataaaaatgtctgtaccaagtgttgtcgaagatgtggagcaaatactgctggaaaaatgttgggcagtatctaccaaaattaaaaatatctatggctcagcaatgttactctcaagtatattactcactgaaatacctacatagatagaagcaaaacacatatacaagaatgtttacagaagcattattctcaataaccaaaagctgggaatagttcacacgttcttcaataatgaaatgaataataaatttaagtatatcccttatgatgaaatgtcatatacaatgaatctgagtgaactattaatacagagatcagcatggctgaattttaaaaacataatattaagtgaaataagttggacctaaaataatacatactccatgattccatttatgtaaagttaaaataggcaaaaccaatgtatggacttagagtagttgttacttttgaaggcagtggttaatgactgagagaaggcataagacagccttctttatacttgggatttgtgtaatgtgtctgctttacttaaataaaaatgtttatttaaaaatatgaagatagataaattatagattgttctctgagggagacaatctacaattatccaggtggtaagtctacacagtgcaaatgggcttcctaactactgactgaggtactgctgcttaatatggaagttcagatggggagagcagagggaaccaaaagaacccacgtcctagaggattttttctaaatgtcttgtgagcattttttccgcatttaaaagatttacttgtcggaattatttatgtgcaatatgattgtagaaagaaatcacctagaaagaaatcacagccaattcatttttcagcctctaaacacttggacagaggagccatatatgaatatgttcaaaagagttaaggccatctcctgtgggtatcagagaggcataattagaatgcattgaattctctccaactggtttgctgaagctcttatgtgagctttttcttttccttcctttaaaaaaaaataataaataaataaaaatccgggcatgacaacaggagtagcagtttccagtctgttgaagttgtttgcttccgtgaccgtaccatgcagggggcgagagacgttgcccacagcatcatcttcgaagtgaagcttccagaaatggcatttagcccaggtaatttgccggtctttgaaaatgcatataattatcatttatcagaaacggaaccaggtttactttcttttcatatcgtcacaatggcagaagaaaggaagagaaaagtacaacttgtacctctttgccaatgcagacacctacttcgaacagagggcatgctctgctattcagactggaacaaaggcaaagattgtgaccaggaaattttctctaggcagttttttcagtcttcaggatttgttcccctctgctccccccgttttcaattttacttttctttaacacaaaatctttattcctgtccattcttaaaggaaggatgaagtattaatgcacttaaatatttatttgttatatacttaaagttgtatgtgatcctgttcttcatatagtaaaccagtcaggaaaaatgccatttctccttccacatttaatatcttcatttgatccttatgtgacagttatcagcttttacccccattttataaattgagaaacttagactgagagacattttatctatagagagatatatgtgtgtgtgtgtgtatatatatatacacatatatatatttacatatgtcacagagattgaatacatattcaagtttgagtaaaataaggatataatgcccagctccggatatatttctttttttttttttttttgagatggagtctcactctgtcgcccaggctagagtgcagtggcgtgatcttggctcactgcaagctccgcctcccgggttcatgccattctcctgcctcagcctcctgagtagctgggaccacaggcgcccactaccacgcccggataattttttgtatttttagtagagacggggtttcaccgtgtgttatccaggatggtctccatctcctgaccttgtgatccgcccacctcagcctcccaaagtgctgggattacaggcatgagccaccgctcccggccagcttcgggaatatttcttacccggaatccatgtcctatgtcaaagtcagagcacgatgtctggcacatcataggtgcttaataaatgttatgtaaatttcctagctcacataaagcccagcacttttatacttcttgccagaataattcctcatctctatgtgatttatatgcttttcagagcactttcacaacatttattattattattattgaggcagagtctagctttgtcacccaggctggagtgcagtggcatgatctcgactcactgcaacctccgcctcccaggttcaagtgattctccctcctcggcctcccaagaagctgggattacaggagcccgccaccatgcccagctaatatttgtatttttagtagagacaggtttcaccatgttggtcaggccagtcttgaactcctgacctcaagtgatccacccaccttggcctcccaaagtgctgggattacaggcatgagtcactgagcctggcctcatatatattatttagcttgttccttatatcatcctcatggttccaaggcacatttctttccttatgccatagatatgccttaaaatgtgtgtgtgtgtgatgggggaggtggtgtcaaaatctcttccaaggccaggcgccgtgggttatgcctgtaatcccagcactttgggaggccgaggcgggtggatcacctgaggtcaggagttcgagattggcctggccgatatggcgaaaccccgtctctactaaaaatacaaaaatgagctacgtgtggtggcgggcgtctgtaatcccagctctcaggaggctgaggcagaagaatcgcttgaacctgggaggtggaggtgtagtgagccgactgcactgctgcactccagcctgggtgacagagcaagactctgtctcaaaaaaaaaaaaaaaaaaaaaaatctcttctgagatatcttttctagagtgctacagtcagaaggattcaggattggcccacatgacattttttcagcgattctatgctctaacacagatgtctttacacaattcgctgaaagattgacagagtacttctgcttgatcaaaggacgatgctgcttttcagtttagagcctttgcctttctgctgtttttagatatttgcattggatgtagcaccctctcctggcaaattctaaaatagctcctgtgtaatgttaacttacatgctatacctttgttttattaaaccacacttaaagatagtcgcaggggtgtccaatcttttggcttccttgggccacactggaagaagaattgtcttggaccacacataaaatacactaacactaatgatagctgatgagctaaaaaacaaatgcaaaaaaactcaatgttttaagaaagtttatgaatttgtgttgggccacactcaaagctgtcctgggccatgggttggacaagcgtggtcttagggaatgaggtgagagttagctaaaaagtaatgtgggtctggtctgtgtgtctgacaagctgccaggcaccttccatggggtaatcacttaattctgccaaccactctgcagagaggcagttttctttccacttttatgacaaagtcactgagttattcttacatcctactctctatgataaggctcatgcttgatgatgctgacattttttttgctttttttgagacagagtcttgccctgtcgcttgaggctcgagtgcaatggcacgatctcggctcactgcaacctccgcctcctgggttcaagcgattctccagactcagcctcccgagtggctgggattacagtcgcgtgccaccacgccttgctaagtttttgtatctttagtagagtcggggtttcactgtgttggccaggctggtctcgaacccctaatctcatgatccacccgcctcggcctcccaaagtgcagggattacagatccacccgcctcggcctcccaaagtgctgggactacaggcatgagccactgtgcccggtcatttttttttttttttttttttttgagacagtctcgctctgttgcccagactggagtgcagtggcaggatctcagcttactgcaatcctgggttcaaaagcaattcttctgcctcagcctcctgagtagctgggactacaggtacacgccgccacacatggctattttttttgtattttagtagagacggggtttcaccgtgtacccaggctggtcttgaactcctgagctcgggcaatctgcctgcctcagcctcccaaggtgctaggattacaggcgtgagtcacacgtccagccgatgctgacatttaaactcaggaaccacaccgtacatttccatttgaaaaaggttttctgtcgtccactaatgcctttaacacatcttcttaatgcctgatattaaatgtagattatttagcttaggaaaggcaaatgaatttcctgtttttcatgtaaattaatatgttccctcttagctgtaaataaaactttatggtaaatacaacttcataaagaatttttctatatcataatgtaaactgaaaatataagtatggttgtacttttcaatacttctaagacatcccatagttgccatggtaatggtataaggagtattattttaaattattttattttattttattttttgagacagggtcttgacctgtcacccaggctggagtgagtgcagtggcaaaatcatagctcactgcagccttgacctcccaggctcaaaccatccccccagcttagcttcccgagtatctgggactacaggcatgtgccaccacacccaactaatttttgtattttttgcagagacagggtttcactatgttgcccaggctggtcttgaactcctgggctcaagcaatcctctagcctcagccacccaaagtgctgggactacaggtgtgagctaccttgcgcagtcgaggagtattattttaaatatcctatgtcttcttttgcttcctcatggtgtgttgtgttacagctctggcacctggtggaggaagatggcagacactgctgcgggtagagatcccatcttaactctgttttttcttgtgctgctcctgcttgcccactatgggagacagcacctaattttttcctaaaaaatattttcttggccaggtgtggttgctcatgcctgtaatcccagcattttgggaggccaaggcaggcggatcatgaggtcaggagattgagaccatcctggccaacatggtgaaaccccgtctctactaaaaatacaaaaattagctgggcatggtggtgcgcacctgtagtcgcagctactcaggaggctgaggcaggagaatcgcttgaacctgggaggcggaggttgcagtgagccaagataagtgccactgcactccagcctggcgagacagcaagactctgtctgtctctctgtctttctagctctctctctctctctctctatatatatatatataatttaatttggtgtatgtcttataggtatagattatatggatgcaggtatggtaaattacatactattgccatatgtgttatttttttcattattaagtttaaagggcatctaattttcttagaaatggctatagcctttattattattattattttttgagagatgaggtcttcttatgttgcccaggctggccttgaactcctgggctaaatccttcctcctgcaatctttcctcctgccttagcctcccaagtagctgggactacagacatgagcccagcatctgtaaccttttgagtatagagaacttttaatttgaaattatgtcttatttttgtctaataatttcttacctgtatcaagagaaaacctaggctggagttatggattacaatactaggctgtgattctgtagttcttgtcaagttccttgctatgtatcaaagacacattaaaaaaaaaacttttattttcggttcaggggtatatgtggtttgttatataagtaaacttgtttcccaggggtttgttgtacagattatttgatcacccaggtactaatacctagtacctagtattttttctgatcctctccctcctcccacccttcaccctcaagtaggccccagtgtctgctgttcccctttgtgtccatgagttctcatcatttagctcctacttataactgagaacatgtagtatttggttttctgttcctgcactagtttgctaaggataatggcctccagctccatccatgttcctgcaaaagacatgatctcgttctttttttatggctgcatagtatttcatggtgtgtgtgtaccacattttctttatccagtctgtcattgatgggcatttaagcagattccatgtctttgatgttaagagacacatttttaattgaatctaagagtagtaataaaatcaaacaaaatatcaattaatggcaggtgggaactcttttttttccccacagaaaaacaattctgaagtcttaacctctttatgaaactcaaatctgactgggtatggtggctcatgcctgtaatcctagctgctccgaaggctgaagctggaggatcacttgagcccaggagttcaagaccagcttcagcaacatagcaagaccctgtctcaaacaagaaaactctattatttcagttttaatttttcatggcattaaaaaataccacatcagagtgcccgatttaaaagggggaaggacgtttgttttctggcttcttgctgtgaatgataccctcagccaaactggggcccaactagctttcaaggataattggtcctatggtttctcattgaccgtcctatcccagaaacaaaagatcgtgtaaaggaaatcagtaccttctaggtcccgtaattatattgggcaatactatttttttaaatgtcaacagctgaaaagtttcccaaggaaaggaaaattgtgatcttgatagaaattcaaaagtaggagaatggacaaagaaaaccagtgtacaggccgggcgtggtaactcatgcctgtaatcccaccactttgggaggccaaggcgggtggatcacgaggtcaggagatcaagaccatcctggctaacacggtaaagcaccatctctactgaaaatacaaaaaattagccgggcatgctggcgggcgcgtgtactcccagctactcgggaggctgagacaggagaatggcgtgaacccaggaggtggagcttgcagtgagccaaaatcgcgccactgcactccagcctgggcgacagagcgagactctgtttcaaaaaaaaaaaaaaaaaagaaaagaaaagaaaaccagcgtataattagaaacaaaattaaaattcccccagtcccatacatcttaacttcaagtcaaggagtttctcttcctgcagagtctgttgcttaaggcagacagtggaggtgatgctggaagtgtaggctgtggtggggtgaatttcttgcttagtagttcaggttttattgtgagcagtgggaattcaatgagaaagggggagtagcagaggtcctgagatgtagggagcgcaagagagtgggatccactagcaagatttacaaggctgtggttccaccaaggcaagcaaagctttcattaacatgagaaggtagcaggtgtgttctgcaaagcaattgagatgtttaagagaattttgcaacagtagaatacagcagtgtttccctgaatgtgtcccttgagattgtaattggtatacagggaaatgaagggagatatggagagccacgtaagtgtgggaaacacaaagccaaatcaaatcacgtgggttctgtactgcaggtttctcagagcttttatctccctcatgtgcaatgtgaatggccaggtttgagtggtagtgggggctggatatagaagacagatataagtatagaagcatttccaaagtctgtttagctacaggatccttatcctctgagattattgaataggacacactttgggaactgctagaattggagttaattggagttacagaggctcccatagcagggattaaaagagggctgcggggaagggagaagtcagggaagggaaacttctgaatggataaagatgagcttaaaggaaagggcagcttaatcaaatgacagtcaccttggactgtgatctgctcacaggtacagaagggacatacttaatttaaggttcaaatcccaataggaacctcagtgaaggggtgctgcagttacattggcttggcttgcttagatagagaagcctcagtggggttatacctaccccagaaaagattgtctttttttttttttcagcaacttccaataacagtgaaagttgagccaccttgggccagagttgagggctatttcagaagctcctgtacaggaagattgcttgggtttgatggtccctaaacaagattcccagtagttgggaaagatggggaggcaactgtggcaagtctgtggaaattcaggccctcaagtctcttttagaaagaagcaaaccaaaagcttgtcaatgcatgggccattatgaatgtcgatcttttttatgtaaggtcgttgcttgatctgcttgtttttattcttccctccttcattaaactttgtgttttatttgccttaagattgtcctaaagcagttggatgggaaaagaaccagaaaggaggcatgggaccaaggatggtgaacctcagtgaatgtatggaccctaaaaggtatatttgggaagctgttttctccagtcgggctttttgtaaccaagacacacaccaagttctgtcaggccaacacaacattgtgtaattcagcccagggggtgccagtcatgctgccgtgtgttactctgctcttcaattgaagtttggttgtgagaattaatattaacaatgcatatcctgaagggcacactcttcatctgttctagacattctaaattttgttcttgtttaaagctcatgctctcagaccaccagcgtacctgtactgccgttcagtcctttatgcattgtcctctagcttggtcctattggcccactcccccgccccgtcccccaccccgccccagacagagtcttgcactgtgcaggctggaatacaatggcgcaatctctgctcactgcaacctctgcctcctgggttcaagtgattctcctgcctcagcctcctgagtagctgggattacaggcacgcgccaccatgccctgctaattttttgtattttagtagagacagggtttcactgtgttgcccaggctggactcgaactcctgacctcgtgatccacctgcctcggcctcccaaagtgctgggattacaggcatgagccaccacacccagcccttattggcccaccttgaaggatattagaagaattatttcatggaagccagtattgtgtttaagggcgaatctcagtgcactcttttttttttttctttttttttgagacagagtttcactcctgttgcccaagctggagtgcagtggcatgatcttggctcactgcaacctctgcttcccgggttcaagtgaatctcctgcctcagcctcctgagtagctgggattacaggcgcctgccaccacacctagctaatttttgtaattttagtagagagagggttttaccatgttggctaggctggtctcgaactcctgacctcaggtgatccgcccgctttggcctcccaaagcgctaggattacaggcgtgagccgctgtgcctggcctgagcgcaggagatatgggaggccttattaaggagatatgggagaaatttctgttttcagtactaggaaaaactttcctcttaatcagatggtgtgtttttattcatggacaccatgattcctatcactggtcatgctcttcccttttcaccttggctgctggaactcagtatcaaatctgtggccccctcgttgcagaggactccaacagcatgctgctgggtgggaagctttctcctccctgcttaccctccagtttaattttctttttcctttgatcccaatttccttattatttcttattttcttgcatagccacttgaaatctttcagaacaagattattgcataaaggagtgactgaataagtaaatctctccttttctaggttagctgagtcatcagtggatctaaatctcaaactgatgtgttggagattggttcctactttagacttggacaaggttgtgtctgtcaaatgtctgctgcttggagccggcaccttgggttgcaatgtagctaggacgttgatggtaagtcggaggtggggggtgcaaatggcacctttgaagttgtagcttctcttcttgttttactctcatgattgccttccatctcccagctccccatcccctccatctctccctcccttcctttttccttttcttatctttttaagtgtaaaagaaatacaaccttttatcatcagatagaaacagaaagtcctccacacccatcgcaagtcccatttcctattaagcagactttgtagattagtatgcagcctttttcccagatgttattgtagacatatctaaatatagagaaatcagtatctttgctgatatttatttgtatttataaagattagatcatagcatactatctataacaggtttttatttttaactagatagaaaaatgactgtagctacctttctgtgtttccatagtatgtatgtgtagtattttgttgtatgactatgttctttatttaatcaatttcagattactttctatttttttctattagatactgttctctattagagaacattcttatacttgtatgtttatatatccataggatttttttttttaggaaaaaaaccctggacatagaattactgtgttagagagagtatagaatttgaatgtcaatattttatatatttgtttgtcattaattttttttttttttgagacaaagtctcactctgtcacccaggctggagtgcagtggcatgatctcagctcactgcaacctccacctcctgagttcagcgattctcctgcctcaacttcccgagtagctgggactacaggtgtgcaccattacacttggctaatttttgtatttttagtagagacggggtttcatcatgttgtccaggctggtcttgaactcttgccctcaagtgatccgcctgccttggcctcccaaagtgctgggtttacaggtgtgagccaccacgcctggccaaacatgtttttcaaacgaaattgccttccaaaaatgttacacatatgagacacagaacttttttccacgctcttgccaaaactggatatatcaacttttgaaatctcagtcagttaagtaacatttattgtttgaatttgtgtttctttaattagcaagggtgagtttaattttatttcttttgtgagttttatttcttttattcatgttctttgggttgtgtcttttattgatttagagttctttttattggggcaattaaccttttttctgtaatatgatgcaaatatttttctcagtttatctaaggtgtctttagccatataaaagtttttttcagctttatgttattatatgtgtcagtcttttcctttgtgggttatggaactcttgtttttatgttagagctttatgaatgtggaaattttttggttacatgataaggggtaaagatctagctacttttgcacaaaatggattgttagttgttttaatggcatttattcagtaatctaaatcatcatttttctgtctttatcaaatgctaaacccccttatatacctgagtctctttatggattctctattttgactcattgatctatttttttattcctatattcatgctcactgttttagttgaaattacaatgaatttatagataaattagaagggattgatgtatttttatgacattaatccttagttctgggagcatggtgtatctcttaattagatcatctttgtttttcagtagcattttctttatataggccttccatgtatctaattgggtttaaatatggtatttctgcatatttaatgatgttttttcctttagagatattttctcccgttaaactttccagttgactattactgggatgtaggaaaaatagtgaattttgcatatttgtctttggccatctttctaaactctcttagttctaagagttttttgattcttttgtagcttaatagtattcctcaccaacacttatatcttccttttccttgtcttataagattggctagaactccacagtaatgtagaagaatggcagtgagagttgatatctttgttttattgctgactttaatgagagtgcctcttgtttttatctttaattttgatgttggtttctggtaagtgttctttataatttaaagaagctgatttctgtttctgcacgtttatatcagaaatgtcgagctttatcaactacgtttatcaagacaaagtattctaatgttgagcattcctagaataaaccctatttgtacgtggtatcttattcttctcatatactcttgaattcaattagtaatgttttgtttttaaatgttacattttggccgggcacggtggctcacacctgcaatcccagcagtttgggaggccaaggtgggcggatcgtttgagctcaggagttcgagaccagcctgcacaacgtggcgaaactccatctctacaaaaaaaatataaaaattagccaggctgtagtggcgcgtgcctgtagttgcagctgctcgggagctgaggtggaaggattgcctcagaccaggaggttgaggctgtagtgagccaagatcgtgccactgctctccagcctgcgtgataaagcaagacactgtctcaatcaaccgatcaattaaccaataaattttacatctcacttcataagtcaaattggtttatagtcatgttattccttgttctatctttgtatattttatagctacattatgctagctttataaaataaacttaaaacgttctgcctttttctaagttccagaacaatttaaataaatgaattatctgttctttgatggttaggtaaaattcagttataaatccgtctgggcctgatgcatttaagaattttgttgggccgggcacggtggctcacgcctgtaatcccagcactttgggaggccgaggcgggcggatcatgaggtcaggagatcgagaccatcctggagaacacggttgaaaccccgtctctactaaaaatacaaaaaaaaattagccgggcatggtggcaggcgcctgtggtcccagctactcgggaggctgaggcaggagaatggcgtgaacccaggaggtggagcttgcagtgagcggagatagcgccactgcactccagcctgggtgacagagcaggactctgtctcaaaaataaaataaaagaattttgttggttggggtagtaagggtggtgggaatctttgtaaacttttacagatgtttctgtgttgactcacctttttagattttgtactgcttttctagctttaaaaattaattgacataaaatacatatggtattctcttttaaatcttccttttatcttttaaaaaatcttttcatattcctaatgttgtatatttgtgttttctcttttttcctcatattaagccttgctagagaggcttgtctatcagtttttttggagcattactttatttattctataatttttgtttctgtctcattttgctttcagattcgtaaatatctacttttatctttattaattttttcctccttctgtggaatttattttactgtctttttctaggttctagaatttttagatgcttagattttcctaacatttttcaaaatttcaaagtcaacataaagccattatagaaaatataaaagtcataaagcaggaaagaagacactcattttcctaccgctttttcacttgtcacatttcagtgtttaatgtgtattttaacattttattagatatataataatgtcctttgctcttaccaattaacatgtcattaaaaatgatgcctgtctatgaggcctttttattttttgggacaggttctggctttgttgcccaggctggactggaccttgtgatgttcccaccttggcctcccgagtagtcaggactgcatgagttcactgcaatgtctgctaaagctttatgactgtagaatatgccttctgataggatgaaacataacttactgaacccttctcctaatgttcagcattaacattgtttccagttttttacaattgtaaattgtgctgcaaagaacatctttgtgactgcatcttggtcagtatgtcagattatttcttaggataaattgctggaaataggtcataggatatgggtattcttaagattctagaaacatactgccaaattgctttccaggaagattagaccactttaacattctcaatcagtaggatgattttctccctaccacatcctcaccagcattgagtattgtgattttctttaatctttgcagattagccatttaaactgtgtagcattccaggaaaccaaaagttaagtgtgtgcaaatacacctgcatgtgactaacctatggcatgtttgtaatgtatctggctttcttcccactacccagcacgttcccagagtgccttccttgctatccactcatcagttgctttaaggaatgcaaaaatacttcagaaataaacattcccaaagcaagcacaagtgactttattctgcctccatggtaggttgcttagatgatgaaaataatttacaaaactgggtgggtagaccaaaaggttaccagtgggcttcaaaacagtcagtctaacctatgcttatgaaaggcagattctggcctgtcgttctcgacacagaaaacaaatcttgggtccttgttggctggatctctgaaaccttcaatctaattgagtctctcagtttctaatggaaagatattgaaataagagagagcagaatcttagccttgtagccagtcatggcaggacatctcttaggtcagtatgcttacttatgatctactaaaatatacccactgtaccctaccccaagaagtaggcaacttcatttggttgcacctctggagagctcattcattcccaccattaaccagatgtatctcttaggcaaatcacttatctttcctgggcatcagtttccatatctgtaaaacaaagtaattggaccaaggattttagagatcccatctacctttaaaatcgtatggttttataaaactgttataggagacataattgaagtctataaaaccgtgaaaactatttctaagaatatagacttgttccctaaattccagattattaataaggctttgcctcttgaagaaatggtacaaaatgttctaaaatatcatacagtgggaaataatttgtgagtcattttttggaggagttcattcaggctttaaatgagcttcaagagtagttgttatttatacttaattattcgttaagggaaatcaaggacatttaggggctattgctaatctttttaaaacaacaacatagacaattcttatgggattcacctccaaatctttggtgacactgtcaaaaataattattagtctgttccacttgacattttttagtcttattacaggaaaccaggcactgagtatataattatgttgttttctaaggaaagtcaacattctgtttatcgtaacctgaatttgcacaattcagtttctgaagtttcttgtgttttgaggttcccaagcttctccaaaccaatattctttttgagatttcaagagacagcaccctgtgaaatgttcatcagaaacacaccatgatctcctgtttccacacagggttggggcgtgagacacatcacatttgtggacaatgccaagatctcctactccaatcctgtgaggcagcctctctatgagtttgaagattgcctagggggtggtaagcccaaggctctggcagcagcggaccggctccagaaaatattccccggtgtggtatgttgttgcttttgcagaggttttctgttatatgtataaatgtttaagtcttgggaaatgaggcctgtggcattgaagaaagagagtcagatatctgtcactttctaccagccactcgctatgtggctgaacctctgtttcctcatctcagagagggataaaaaaacacaaccaggtcaggcatggtggctcatacctgcaatcccagtgtgtctggagttggttccttcagtgcgttcttggtcttgctgacttcaagaatgaagccgcggaccttcgcagtgagtgttacagctcttaaagatgatgtgtccagagtttgttccttcagatgtgtctggagtttcttccttccagtgggttcgtggggttccttccggtgggttcttggtcttgctgacttcaagaatgaagctgcagaccttcgcagtgagtgttacagctcttaaagatgatgtgtctggagtttgttccttcagatgtgtctggagtttggtgggttcatagtctcgctgactttaagaatgaagccacggacgttcgcatgttacagctcttaaaggtggtgtggacccaaagagtgagcagcagcaagatttattgtgaagaacaaaagaacaaagcttccacagcgtggaaggggacccaagtgggttgctgctgctggctggggtggccagtttttattccctgatttgtccccacccacgtcctactgattggtccatcttacagggtgctgattggtcagttttacagagtgttgattggtgcgtttacaaacctttagctagacacagagcgctgactgatgcctttttacagagttctgactggtgcatttacaatcctttagctagacatagagcgctgattggtatgtttttacagagtgctgattggtgcgtttacaatcctccagctagacacagtgctgactggtgagtttttacagagtgctgattggtgtgtttacaatcctctagctagacacagagcgctgattggtgtgtttttacagagtgctgattggtgcgtttacagtcctctagctagacacagagtgctgattggtgtgtttttacagagtgctgattggtgcatttacaatcctttagctagacacacagcgctgattggtgcgtttctacagagtgctgactggtgcatttacaatcctctagctagacagaaaagttctcccaagtccccactcaacccaggaagtccagctggtttcacctctcactagcactttgggaggctaaggcaggaggcttacttgagcccaggagtttgggaccagcctgggagacatagtgagaccctatctctttaaaataaaattagccaggtgtggtggtggtgtgcatctgtagtcccagctacactagtggctgaaacaaaaggattgcttgagcctaggtggtcaaggctgcagattttgagctgtgatcatgccatttcactcaagcctcggtgacaaggcaaaacactgtctatataataataataataataaataatccatctcacatattcttgtgaaaacgaaaggaatgtatgaataaatgttttgtaagttgcacagcattatgagtttaagttgaggaatttaggagtgtatatatttttatatcctgcctggttccaaagaggtttacagtggctcagatctaatgtgttatttttcctccatcaccaggatacttggtggttacttagtacaggtttatgaaattaaattgaatgcaagtcttcatgaagaagaaagattgggctgaaagtttagctttttgctctagctgcttctggtttttgagttatatcattagaaataccagataacaagagaaaagtcattcagctcctttcatttaaaatcttgacagttttctttttttaaggtcaaccagcaaatgatatcctgcctcttgaaaacttaatcattttatctgacaggagttagattaggtgtctccagagcatttgcttatacttaaagtgccagaagaggttctcagtcctaacaaaacaaacaaaaaaacccactttctcaaagtttctctctttagtcactttgtattagattcatccattttaaaaatctttgctttagaagcattgttaatgtttttgtccatttcactagagtccctgaggaacatcatcttgggtttaacagtattaattgaccacccactgtgtagccagctatgtgctaaatgctgaaaaaaataagaatacgttgcaaccctgtcattgaggaggcatattagttagatttctgctgtgacaatattgcatatcacacaatcccaaaatctcagtggcttacaattgcaaacatttatttcatgttcatgggtgtgcaggttggctgtggttcagctgtgtcactaggctgaacttactcaataagccacataacttcgagtcaggttccagtccattgtatgtgttattttcaaaatctaggctaaaggaggaacagtcatgtgggtcctactcttcctatggtggaaggtttaagcttaaaagggttggtgattattatgccttaaagtcttagctcaacagtggtacagtgcaatgtcttccatttctgttaccaaagcgagtcacaggaccaagcccaaagtcaatgacattagtcaatgtactcttcctggtaggaggtcttgcaaaggtcatgttgcaaagagtgaggatatataatattactagagggaggaggtgcctaattgggaagaataatccagtctaggctgcgcacagtggctgaagcttggaaacccagtgctttgggaggctgaagtgggaggagatcgcttaaggccagaagttcgagaccagcctgggcaacctagttgagaccctagcccaaaaaaaaaaaaaaaaaaaaaaaaagcagtgatccaatctatcgttggagagtattatgaactccctttaggacccagacagacctggctttgaacctgagctctgtcacttattagatgcctgaaatttttgtttactcaaatcctagtcattgtcagtgacccaatacaattcccccttcccactgtttatttgtttagttgctctattacttacttgcgtgtcaggtagtgtatttaagacctcccgtgttccagggacaggggaactagacagacatgtggagcttaaagtctagtgggggatggtcattaacaaataatttcacaaatacttatcattgtaatacatgcaggaagcaggagctcagttgccatgagaatatataacaggtaggcctgacctagatgaggggtggactgggaagacttgagaaaacaaacccctgaaggatgagtgggagttagctagattgagggtagcagagctgtctgtgcaaatgcctgaggtaggatgagtgtggtacttttgtggaactgaaagaaaaccagggtggctgcaacatagaggtcaaagaagatgaggaggaagagaaggctgaggtgggagcaagggacgccatgctgggcctgagagagcaagtccaactgttcttggaaacagccccctggcatcgagcctcttccttcacacttacattgtgttactctgttttccctgttggactattaagtcccccaggccacggtccaagtcttttatacttttatccttcatgccttataaataataggagataatatacacaacccatcaaagtactggtgtaattcatcacgttcatgaaaaatacttgcgaaactatttaacttattggttagccagccttaaggggctttccttatatgcttgatttagtatagtttctttttttttttttattatactttaagttctagggtacatgtgcacaacatgcaggtttgttacatatgtatacatgtgccatgttggtgtgctgcacccatcaactcatcatttacattaggtatatatcctaatgctatccctcccccctccctccacgccacgacaggcacttgtgtgtgatgttccccatcctgtgtccaagtgtgctcattgttcaattcccacatatgagtgagaacacgcggtgtttggttttctgtctttgtgataatttgctcagaatgatgatttccagcttcatccatgtccctacaaaggacatgaactcatccttctttatggttgcatagtattccatggtgtatatgtgccacattttcttaatccagtctatcattgatggacatttgggttggttccaagtctttgctattgtgaatagtgccgcaataaacatatgtgtgcatgtgtctttatagcagcatgatttataattctttgggtatatacccagtaatgggatggttgggtcaaatagtatttctagttctagatccttgagtaatcgccacactgtcttgcacaatggttaaactagtttacagtcccaccaacagtgtaaaagtgttcctatttttccacatcctctccagcacctgttgtttcctgactttttaatgatcaccattctaacttgtgttagatggtatctcactggatttagtatagtttcttcattcaacagatacttattcatcaccttccttctaccaggccacggagaaaaggcttgacctaagtaaacaagacatggttctgccctcatagagcttatattttattgaattataattgaaatactaaatgctaaaagggataagtagacattgctcaggaaatatagaagagcaggacctggacaagtgtggggcatgtgccagggaaagccttcttaaggaagtaacatttggtccaagctctgaaggaattgatcagaagaggtcttgaggagggaggcaaggaccagagagtggtgggaaaggccagtggccaggaggagcattccagggaagaaaattggccttttgaaggtaagaactgtgttaaatgcagacttcctagatatttggttacctggaaaagttagaaagattggttttattaatgcaagattatctaatttggggtattccttacttgttaagttattgcaagattctaatctcagtgcttgaagtcgagtgacatttgacttggaaaagaaaaaaataatgggtgatagcccctttaaaaatgtttaaattttgggccgggcacagtggctgatgcctataatcccagcactttgggaggctgaggcgggtggatcacgaggtcaagagatcgagaccatcctggccaacatggtgaaaccctgtctctactactaaaaatacaaaaattagctgagtgtggtggcgtgcacctgtagtcccagctactcaggaggctgaggcaggagaatcatttgaactgagaggcggaggttgcagtaagctgagattgcaccactgcactccagcctggcgacagagtgagactctgtctcaaaaaagaaaaaagaaaaagtttaaattttgaaatagtaaattcataggaaatgatttgatttggatgtttgtcctctccaaatctcatgttgaattgtgatcctcactgttggaggtggggcctggtgggaggtgtttgggtcatggaggtggatccctcatgaatggcttggtgccctctccacattaatgagtgagttctcgacctcttagttcacgtgagcgagagctagttgtttgaaagagcctggcatctctctttttccctcccttgccatgtgatgcatctgatcccccttcacctttcaccatgagtggaagcttccctcatcagaagcagatgccagcactgtacttctcatacaacctggagaaccataagccaaataaacctcttttcatttaattgcttcaaatattcctttatagcagtgtgaaatggactaacacaggaaatacaaagaagtgtaccaggaggtcatgagcaccctttaccctgcttcttctgggtgacagacttcaaggacagggtggtttcactgggtagctggcctgaaaagccttaaacactccctcagaactagagagtttgacatttgttttttgctctaaaatatatgtatcccagactaaccgtattctggccccagaccttccagtatgtcaaatgtcagctcataagaaacccttgcattttatctgcatggtattctttcactaattccttctcttctactccaggacataggtgtcatattgaccctttccaggtgcctttaaaaaagctatgataaaattacatgaaaagaagcgctctgctacagataccacacctgatcctggggaagagtaaattgaataagaaaacaactgatcttttataaatcatatagctatttgaggcaataagatgtcagattatgaggccgggcgcaattgctcacgcctgtaatcccagtgctttgggaggctgaggcgggtggatcacgaagtcaagagattgagatccatcctggccaacatggtgaaaccccgtctctactaaaaatacaaaaattagctgggcgtggtggcgcacacctgtactctcagctacttgggaggctgaggcaggagaatcgcttgaacccggaagtcagaggttgcagtgagccgagatcacgccactgcactccagtctggtcacagagtgagactccatctcaccaaaaaaaaaaaaaaaaaaaaaaaaagatgttggattatggagccacacttgaggttttaaaacccaaatctggacatctgcttcaaccctaatgagtagtggatactggactagctctgccaccataaacaattacacgctgggacaaaatacgtaaaattactcttttcagacagtgaacagtaggtagtgaaagactatggtcataggtagtgaaagactgtggtcccagacagagggaaggaaagatttgtcccagcttataacatgaaggcactttctggcccatgccatagcccgtgagagcccagggagattctcttggtctcagtgagctgaggaaacaaccagaattcagagcagctgaggtggctggaatttgcaggacgtagtaccagaaatgagggagctgtgcacaggagtgcctcggtagcaccttgagtctttgactgaatagcgagctgtgtgtactcacagcacgactctcgtcagaccaggcaaaaacacactaccagagagctatgagcagaatggagattccagagttcacacgagctgggagacactggagttctgtatacggagtggagagacctcattgaatactctgagcccttatgtgatacccagaatggcccctataaagtttcgaggggaaagcatcttagtggtcttgtgataaagatttcttaggacctagtaaatactatgaacaaaaaatggtaacttagttgactttataaaaatttaaaacttctgcttctcaaaagatgcctttcaaagaagggaaaaactagccaaactgagaagacatgtgcagtcctcttatccagaacacgcaagatgaacaactcctaccactcaagacacacaaagcaacttgtttttaagggggaaaaaagcttgaacaggtacttaatttatggtgaagatctatgaatggccattgaacacgtgaaaatgctcaacgtcaatagtcatcagggaaatacaagttaaaaccagagagatatatcactatacacctactaaaatggctaagattaagaagcctgacaatgctaaatgttgtcagggtgtggagcaaccaaaacacttatacattgctggtaaaataactactttggaaatctggctgtttctcatgaaatttaacatatgcctaccttgtgacccagaaattgtacctttagatctttacctaagagaaatgaaaacatatatacatgaaaatacttatacaaaagtgtccatagcacctttattcaaaacagcccaaatcaccatcaacaagagaatcgataaattgtagtataattataccacgaatggaatgtattattgatacttaacaatataatgaacctcaaaagcagtatgctaagcaaaagaagccaaacacaaacaagtatataccctagcatatcatttatgtgatatgttctagaatagtctaatctatggcttatgaagtcagatcagttgtcatctgggggcaagtggggaccgactgagggggagcacaagaccatgttctggcgtcatgaaaatgttctatatcttgatagctgtatgcagtggttaatctatcatttgtcagaatacattgaactgtgcatatgagatctgtgtatttcactttatgtaaattatacctcaacttggctacacctttgaatcatcaggggagttttagaaaatattggtgcctgggctcattcttagagatttccatttaaatggtctggggaaaagcctggccattaaactctctaggtggttctgatatacagccaagtagaaaaccactgtgttgaaagttgctgaattccagcctcttgggtgtggacataactgatgggctctaacgttagcttactggctgaaattttagcaagtagagatttatttaggttagcaaagttattttattattcaaaagttcagaattggtattgcatgattatacttccatcttggtgtcatgaaaatatatacttaatagttatttggatcaagctaccaccatttaacatgctttgtcaattgtagtatgtcagtaaggtattgcaggtattattattactgtagttgttgcttttattattgcttattacggcatttggtacatagtaggtgcacaatacttaatggattaattaatgagatcctgatagctgtgctagtctcattattaaaatagatgtgtgctgtgctagtctcattattaaaatagatgtgtttttgcacctttcttcttcctgaaatcctttctgcctcaggtcctttcctgctttgcttgccactcttttttacattccttttgaaattgttgttcttcctttcttgaattccagagattaggtttaaagttgaagataataaaaaaaatccacaatctacaaatttgatatttctttgtaaaaagatctgcttgctgtgtcccttgagctatttttccagtaggtgaggggttttggcaaatgagtgaaaaagctgatgttttcaaacacttccctatggccagtgatatacaggggttaaaggtacagtttatgattctagaacacattttttgtggaaagtcagtgtccctggcttcattagcacccatatgtgactcactgttaatgtgccaaaatattatgtggtcatcaaggggcagatggtaaattataaagctgttctaaagcccatataaaaaatcccaattcaggggaactcaggttgatggacagcttctacttttggacagagagtgaagccttactctgtcccacactctgacatcacccaccataactcctgccccgataaaaatatctacatactcctaagtagattttttggctctaagttagcaagtagagttttttgtatttgaggttttttaaaatgcatatacccctgaaaggattaagacaagatcatcagtcattgtaaccttatgtgaatgtattaaatcaaattatatttgctagaacactccatatggagatgtttaacactgaggaaacagaagggagggcaatttggaagcaaataggaagagatagcccagttggaaagaggtactttggcagggtacggtggctcatgcctgtaattccagcactttggaggccgaatcaggaggattccttgagccaaggagttcgagagcagcctgggcaacatagtgagacctatctctactaaaaattaaaaaatcagccaggtgtggtgacgtgtgcctgtagtcccagctacttgggaagctgaggtgggaggatcccttgagcccaagaggtcatggtttccgtgagctatgattgtgctagtgccctctagcctgggtgacaaagtaagaccttgtctcaaaaaaaaaaaaaaagaaaagaaaagaaaaaaaaagaggtacttgggtaggcagaaggtgctgtgataaagtttcttggccttggatggctggaaagagccaaagatacacagttttctccagtgtccttacctcaggtaggatgtgccccctccactttggaactgagatccgtatgtctctgtttgctgccctgccctgcctcagggccctggggtgataggtcaaggtgttctaggatgcagaggtgaagaagagagagggcgtgggaagggtgcagcataatagtgcacagggagctctcatgtatgtgaacacaagtaagtgcaggcagctgtgggaagtgtgggctctgagatattacctataccattgctccagacataactacgtcctggtgtttccctagaatgccagaggattcaacatgagcatacctatgcctgggcatccagtgaacttctccagtgtcactctggagcaagcccgcagagatgtggagcaactggagcagctcatcgaaagccatgatgtcgtcttcctattgatggacaccagggagagccggtggcttcctgccgtcattgctgcaagcaagagaaaggtaggccctgtctctaattatgatttatgatttaatgcaccaccactccagagggaggagtgtccctaaccttcccttccccagggcagagatgtggtttgtgtgacctggtagcatagtgccaaagggcttctgcttcagactctgtctttgcctcgcacaccatcacccaatgtaataagtaccatttactgcttaattttcataataatcttttgagatactctacactgaaagatatactgtacttacattaaaacgtaagctccaagaggacagagacttggtcttattcaccactacttggtcaatgacaacttcaaggggcaacaatgttgaatagtgaactaaatcatggtgcatacctatgatggaatagtatgcagccattcacagttatgttttcaaaggactttaataagatagaaaatgccacattatattaaataaggaagatacaatattgtatatattttataccaattatgtttatatataaacattgatatgtattttcttaagtatctacttatctgtctattgagagaggagaaagaggacaagaagaagggagaaagagagggagagtatgggagagaaagggagaaaatagtaggtaaaaaatacaccaaactattaatagtaattttttgagctgcgggttgtgagtgatttttgttttcttttgtagtgtgtttattcttatttttcaaactttctatataatcagatatttgggataataagttaaattagaactatgaaaagttgttatagtataatgaaaaaacggtttcttaaaaatttatgtgttgggctggacatggtggctcacatctgtatcctagcactttgggaggattgcttgacccaggagtttgagactagcctgggcaacatggtgagactctctctctagaagaaaaacaaaaaattagctaggtgtggtgatgcacacccgtgctcccagctactcaggagggtgaggcaggaagatcacttgagcctgggaggttgaggctgcagtgaaccgagatcacgccattgcattccagcctgggcaacggagtgagatcctgtctcaaaaaaaccccaaagaaacaaaaaaacaaaaaaaaaccaactatgcggagccaggcatggtggcatgtgcctgtaattccagctactgggataccaaaaaaattctatgtgaagggtgaattatatggtatgtgagttatatctcaataaagctgttataaaaacaaatctatgtgaacatgacagtatagcataatggtggaaagaatgtgtttgagaactatgtagacttggttttatatacctacctcttgccagataagtgaccttgggcaagttatagaactaacttctctgactttcagtatcctcatctataaataagaaatgtttgttatgagtttttttgtttgcttttttctttttcagagatagaatcttgctctgtcacccaggctggagtgcagtggcggaatctcggctcactgcaaactccatctcccaggttcaagcatttctcatgcctctgcctcctgagtagctgcgactactggcgcaagccatcatgctcggctaattttttgtatttttaatagagacagggtttcgtcatgttgccaggctggtctcgaactcctgacctcagacagtctgcccgccttggcctcccaaagtgctgggattacaggttatgagccactatacctggtctgttatgagtttcaaatgaaattaaatgagataatttatgttcatcacttatcaagtcttttgtaattaataagccctcagtagtgggtagattttatcatcattagcttttataatctaattacacttacatgcaaaaaataaattttaaaaagttgagcaaatatggaattagccacagcttgaaatatatgtgtcttttaactctgctctttcattccttgaaacctgcagctggtcatcaatgctgctttgggatttgacacatttgttgtcatgagacatggtctgaagaaaccaaagcagcaaggagctggggacttgtgtccaaaccaccctgtggcatctgctgacctcctgggctcatcgctttttgccaacatccctggttacaagcttggctgctacttctgcaatgatgtggtggccccaggagatgtaagtggatttctctatagttccaaatatttcctatcaccaacttgtacactgaggcagaccgacttggccctttcatttatgactatttaaatattatcttttaacaaagagaagaattctccaatttggggaggatggcattatctcattatgaaccttgactggcgtcatcaactgtacacctgttccttgttcaccaatataaacgcggctacaaaccatatttttggaaagcttattgaggaaaccacagcagactagtccctgatagcactccgtattgtctccggtgcttctcttagtcaagataacattacaaatcaggagtctaaagaccagattccatcaatggcttgacactgcctcccaggtagttctaaaaagtctcttaggttccctctacctttgcaaaataggagtgatgtgtaggcttgtcagatttagtaagtaaaaatataggattcccagctaactttgaatttcagttaataatgaattcttttttttttttttttgagacagagtttcgccctgtcacccaggctcgagtgcagtggcacaatctcggctccctgcaacctctgcctcctgggttcaagtgattctcctgcctcagcctcctgagtagctgagattacaggtgtgtgccaccatgcccagctaatttttgtatttttagtagagacggggtttcaccatgttggtctggctggtctcgaactcctgacctcgtgatccacctgcctcagtctcccaaagtgctgggattacaggtgtgagccaccacgcttagccaataatgaataattttttggtatatgtcccatgcaatattcaagacccacttatactaaaaatttatttatctgaaattcaaatttaactgagtgtcttgtattctccctagcaatgctaatagaggagggaagaatacctgccctgtcaactcacagtgcaaagtgggtcaagtgcgacagtgctttgaacagcaagactacactgtacaaattaagattctatgactttcagaactccacacaagtcagtctgtatgtaggtctgttcctttatcagaacagataacgatttccagtgaaacaatgcagagatgttttctgtaacctcccctctatttttcctttgttttaaaacttttcccttaataactcatatctcttttggatgactggcttttatgccctcccaatataaagaaaagaagatgaccattctcttttatggagaaagatggcttgatgatctctgttatggtgttataatatatagctggtcttgttatttagtgattgtcaacaaatacgattagtggtcccttgcagtaaagtcccatctgctcataaggtaaaatttttatagagtcaaaaatatctctaacaacctcttaatttgcccagagttggatggttagactctctttggttgaaccagcaaaggcttgtgcttagagccatgttgtagaaaaaaaaaatacttgtagtaaaccctagaatcacacagagaggtgatgcccatgttgtgagaggcacataggaactgagggccgcaggaatagtaaattgttgctcccatctcacggtcactttgaggtgttagctcagttaaaatggcagggcagaatcatttgcacttttcaaatcattgttcctttctgtgtctctgtcacttaactaccaagcacagtagaactgaattgagtcacttaaaggaacacatgatgcagttccattatatgaggcagctaagccctcatttttggttaatatcccccaatctgtttaggctactgatcctttttagcatatcacctcatttagttacctaaattgtatattttgtttatcttgataatctcaagaaatgatgtacttgaggctggatgttctttgccaacaatgagcatctggttataatttaaagctttgtcacagaggatttcatacttgagacagctagagttgaatggagtagaacgttctgcacacaccaatgattgtttctttgcagtcaaccagagaccggaccttggaccagcagtgcactgtgagtcgtccaggactggccgtgattgcaggagccctggccgtggaattgatggtatctgttttgcagcatccagaagggtgagtttgctagtaggagatgagtatttaaacaaagcttttgtaggcagttgttcatcagtgtctcccatggccttttctcagtctgactttacagagaatttcactatttcaccctcaaaaaaacaagactagaaaaagcaggtctggttctttgggctgagataacttggcatgtttcctttgtggccacatttctgcatctttccggacaaagtcactatggtttattttatttttccaacgcttatatagggcttactttgtgctaggcactgttctaagcaccttagaaattttgcctccttcaatctttttttttttttttaacgagacggaatttcgctcttgttgcccaggctggagtgtaatggcacgattttggctcactgcaacctctgccttctaggttcaagtgattctcctgcctcagcctcccaagtagctggaattacaggcatacgccaccatgcccggctgatttttgtatttttagtagagatggggttttgccatgttggtcaggctagtcttgaacctctgacctcagtgatcagaagtgattcacccaccttatcctcccaaagtgttgggattacaggcgtgagccattgcacccggcctcctttaatcttcatagcaaacatattaggaaagaactattattattagtcgcagttttgatggggaaatcaaggcatagtgaggataagtaagtggccaaatttacatagtaaatggaaaagccagggtttagctcaaccagtgtggctccagactatgtttaatgactttgttatgctgtttgcaatacaggcagcagaaaatcgaatttttgaaagatttatttttccagttctcagaaagtcaatatgcaaattaacatgaatattctatttcttgtgtgactcaaagctttcctcagcagttgaaaattgtggttgtatatgtaactagtatgggtactctgagataaatgaaaagcggggcttttttgtcttcctctttgtcatccaccttagctatctgtcatttaagtttattgccactctctgacaggaagtatttgggataaaatctttgagagctgactttatgcttccttgacactgagcctctgtctgccacatttgccctggtcatagtttaaacaccaggtcctgtgtcacatctttttggtgccacaagtatcactccattgttcagagagtagtgtattagttctgcccaattcattcttcacttttatttcttccatttcattagcatttatatcagctcaagaagttaaggttagaaaattttccacttcaaattttcagtacagaaatgtgctgtgatgtttgacaagactatttcatagtaagtgagttaatgtttattggcctctgatatgccgaacattgcactcggcagttgatgtagtagattcctcatttattaatcagagctccctcattcctactttatagatgatggatctgaagcacagaaaagttaagcaacttgcctatggtcacaagctcaggtctttctgactccaaaccatgcatgtttaaattactcttcttgccctttgtcccagggaaattagttttttgctaacttacactgcccagcaaggggcattttagttatccttatgaatcttatgtagatttctgctagatcatcctcccatgtgttaaacttggattaaatgagcagctctgattgtttcctgtcctcaggggctatgccattgccagcagcagtgacgatcggatgaatgagcctccaacctctcttgggcttgtgcctcaccaggttagtgatgtggaagtgaaatcacaattcttttggtacagggggaaagcatgtggggtctctttgccattccatctgcccagcccacttcatatccaccctacttaccctgcagctgggatttcaatgggagagctttctgaccacctggaaggtattccattctgcgggatagtgatgggaggaaatcacgaacgagaagcattgcccagagtctttgatgcgttttgtaaactgactagaggcctcataatgcaataggaacagaaaaaacaggctttggaatcagtcatacaatggtttaaatcccagccctgccgttataaagatggccttctttggccaagtcactaaacttctctgaggcttagttttcttatctgtaacatagagaaggtaatgctgacatcacctggtagttgtatggattatggatggttgctagaaagggctcagcaacagtgtatatcataggccctcaacaaacaatgcctgctgtttctttactgttgcttgttattattattgactctgaacccaaatagaaaacctttataggcaggcatgagaaaaacattagaagcatgcagggtcaccaaaaagtggggtgtcttttcagaaaaagaatccaaagcatcatgaggaagttccatcccttagggagtaaaaagaaaaaggcagtgggatgatcttttagaattcatgttgcctcttcagtcattttcattactatatttttgggagattgaagaggttttccagtcttatttggaaatcatttttttttagattccatgtatgtatcctctcctgtaatgtgactgctgttcccatcagtgaaatcgtgatggtgcccaccagtcctatctggtgatttgcaaggacagactcagacgagtgcagagagcagagtgactcagctcatgcttgtctctctcttcctcctcgccacccaccttctgccagctagggcggcactgtcatattcagtttaggatgagaatcagaagaggggaaacgacttcttcatggtcacagagacttagtggatgagccacaatccatacctaaacttggcagtctgacaaatgttctttcaaaggtcttgtgagttgaaagatccgtggcctgcatgttgggagattttgcttcctgttggtaccccagcccccttgcacaaaaccacccataatagaacttgtgggccgggcgcggtgactcatgcctgtaattccagcactttgggaggccgaggcgggtggatcacgaggagaggagtttgagaccagcctgaccaacatggtgaaaccccgtctctactaaaaatacaaaaattagctgagcgtgatagtgtgcacctgtaatcccagctactcaggaggctgaggcaggagaatcgcttgaacccgggaggtggagggttgcagtgagctaagatcgcgccattgcactgtggcctgggcgacagagtgagactccatctcaaaaaaaaaaaaaaaaaaaatagaacttgtagagttcacttagcctcccagagtctcagtttccaaatcaagaaaagcaggtgctttactttgtgtccaggattacatctgacacggccttgaaaaccacaaaacactatgaaaatgtgcccccctctgtcccccacacacaaggtggcatttttttttgacatgcatgtgttaatcttttctacagagacatttcacgtaggacccaaaagacgcggtaataaccatctatcataaggaagctgatctccagagcctacctctgctatttatgctgtcgtatctcatttgaatctttcccaagtctcccgccttcttctgaccttgagatgtgccctcatctcctttacagactttatattgagaagggccttaattaaattttcagtcatgcccctgcactggtttccttctttaagtcctttatgttaaattactgcagttgtagttttctcagtgctgaggccagagggcaaaacagtctctttatagaaggggcccagtgtcaaaatgcatgtgcccatgtttttaaagtactatggcaactaatccctctcggtgttatttatccccattgagcctcagaattatttgtcattcaccaactcttctagttctttctcctcgttttcaaatgtctgaaggattattttggttgttggccatctcttcatttgcccttttcaaagactgaagaataacgcagccatatatgggaaaagctgtgtgtgtgtgtgtgtgtgtgtgtgtgtgtgtgtgtgtgtgtttacttgcttacattgtttcaagtttcaagcctttatttttagctactttctaagaaagaaagtggagaaagaactttaaaaattaatcagggttgtgtggtccccatgtataggctttaaacaacttttttccccctaagtggagtgagtccatttatgcaaccatgttttgattaggggaccatcgtttccacgtttccacaaaaacactgggctgtgttgcaatgccctgttgcaaactcagcacttccctcctcctcttcctggctcctagagacaaatgatttcctgttggagaggaacttggtaaactcctttgtgtactttgtatgcaaagaagaccagtgaagtttactgggctcatttttctcagttcccaagaggagaagttttattaattggcccctgtggaagagatgtagtagaaaagtgatagtccttggactgagaatcacaaggccccccaccagcaactcattgtgtaatttggagaaagttccttaacttttcctgtgctctctgggtctctgctctcctctgtgtcagacctaggaggcctgaggattacttagttgttctgtctctgggtccacaggcagaatttggcccatccaaagactggccaagtgccaaaaaaaggcctgattaggccctgaaattcagtgaaattctgcctgaagaaacctcttattgaatttgaaaaccataaaccatttcaggtgagcttatgggtttgttttgggtttttttttttttttttaagtctctggcccaatgtacgtggattagattctgcaagcaggcagcagtaagtataagctaatttctgtctataaaaagaatgattaaaaaaaatcattttgttgatgtgtggaatagagattatcacacacatcattaagtggtaatgtgatgaatgatcacaaaacgaacagtcttatacccagcacacagatcagaacaaagtaactatcaagcaccttcaatgcccccctcatgcctcttcggattattattgcatccttcctatagagaggtaagcacctcttgattatcagcaccatgggagatgtttgtctgattttgaacttctgtaaatgaaatcatatagtatatactctttggaatctgttgtcttttgtagagggaactttttcattataaatcttatagtagtgttgttccttcttcccatcaacagtgttcttttacttaaaaaaaaaaaaaaaaaaaaaaagaagaagaagaagaaggaaagaaacactgctttttccctcccggctggtggctgagctctgcaaggccagatcctttttctggttctttggtaggaggcacagttcaggatttataaaatgtacaggccactcttgatatctccaggaagttggtttgccggctggcaagagatcctggatgtgacagaaattaacagcctgttggcctgctaattctttggctgtacctcctcaaaggatgataatgaggtgacaaggctaggcacagtggctcacccctgtaatcccagcactttgggaggctgaggtgggagaattgcttgagcccaggggttcaagaccagcctgagtaacatagggagaccccgtctctacaaaaaattagccaggtgtggtggcacgcacctgtgggagtttgaggctgcagtgagccagtatcacactactgcattccagcctgggtaagagagggagtccctgtctcaaaaaaaaaaaaaaaggaatcaaggtgacgctacaacagttgtccaaacaccaaggtaattgatggggcattcctgctttatcccacttgtggaccaagcagttcacatcttttgtctttaggtgaatgaactcttggttctaaagtactgataaaaaaagaccctgaatgtgtatatgccattcttctgagcttggaattgccaaccccagggttttctcagcttcatgaattcttttagcttcagaaaagtaatacaaagccaaaactagggcaggaccctgggagggacctggcctgggaaaactctaattgagtcacatgctgaggtggagctgggatctctagccatatctcgggatatttggcctttctgcacaggctgtgtcccccaaatcctcaagcctttagattttgaaaaaatctctttactgtgttcagaaatacttatctcagtgtgctcctagggacatggacagatggactgctgaggagggaaatcttagcagataagcaataagagcatatttcctgagatgcagcccaggaaaggagcctcctttacccctctggttctaaacctctctggttgatgatgatggatatagcagaaaaaatgggcaggcctcatgtttcactatatcaagtgctatcgtttgtgacctgttcatcttatttccctccctccagccatcccctcaacaggtaatctgactctgccaagtgccaagcactatgaagttcagggaagttaagtaactggcacaagatcacccagtgttgagttccatttgcgtttggggtaatctaaggtgatggatgtatcccaagccatttggatgtagtagagtctggttccagtggggaggcctctgaatacaaggaaggatccgggtataggtctaacaatgtctgggcttcctctgtgaggtcccagaagaagagtcaagattgctgtttccctggaggataaattataatgtcagcgttcagaagcatctcagattgcatctcttgtcccaggaggagttgggcctaaccttacaggttgaaggatgtcactttgccccatgagttttacccactggatgaggctgtcctgtttaggaggtgcgtgtttaggaaggcagcctgaaggttttgtgatcatacagatctgattagaaccccagctttgtctgttaatttcacattcagtatctcattttacaaaaccagttggggcagctcttagcacttgtccctgtttgaccttgggcacgttacgtatcttctctgaacctcatgttttatatctgtaaaatggggataatataataagctcttggaattcatggatggattaagtcacacgtactaagcattagcacagttctgggcacataagagacccttgtaaatatcggtttcatctttcacttttaattaaaatggaaacttatccactctcctaaaaaggaatttataaagactctcataaagctctgaaagcaatgagtagagagggagtggttgggaagatttgctccattctgcagtgtttttctaaggataacactggctcatgtccagcttagtttttctgcccccttggtgactctagcttaatagcgagagttgggtcagtggtgggagctgaagctcttagctgaaacaaagaccattctggtgtgcttagggttttgcaattgctacactctccattttggcattgaacttgattaagactcttttcagcatccaagatcgatctggagtttggagttagtttttatttatgcgaactccaagctttagaaatattgccaggcctgctggaagctagtgtgaagttaaagcagcaagttccagttgtggctgcaactgtgctttctcagaatggctgtttgttgctgggcattggatcttagcctcccatcgaggcctgggtctgaagctaattttactcagcttaggtgaaaacaccaccaggggtgggtggcccagaaagaaagaggaacctttctattcttgatctatttattttgtggccaactgggcataattgactaaagataattgaatccacctgataggtgttaagccctctaggtgttgagtttttgttcgggagttttgttttttttttaattcctctagcctctttcttcctttctacctctttgcttttcagctttattcctcaggctttagagccagaaagaacaaaattcagattcctggctttgccacttggtagctgtggacccttgggcaagccatgtcactttcctgagcctcctatgttcctatttggagatctgtgccacaagatggtagtgaggccaaaatgagatgcaatgtatgaaaacacccaggagccctgaacacaggcatggaattcagtaaattttagtgctctcctccctccattctctggggtatcattttccacattattcaaggacatgccttcctgcctggcttctaggattaggagggaacatttgtttatttgaaagggaaaaggaagagaagtaagtgctttagcagggggacgtagaacaggcagaaacaatggctgggaaaggtgctcagcgagtttgaggaagggaaaggccagtttacctgcgagacagcgagtaaaggggcacagcggagaaggcaggaatgcaggggccattggaaatgcctggaccttcaacccggggccctgggaggccgttgaacgctgaggtgtgatatgagtagatttggttgctgcatggagaatagactggaggtgatacgagtggctctgggaataggatttgagtcgtttggtcttaaatcagaagacagcctaatccagggattcccatacctggccttccatcagaatcacctaaggagccatttcaaaatacccatttcccagcccatcccagagccactgagcgaaaacctccagggacattaggcatttgagaaccactgcttctgtccatgaaaacatggcttcttgatagcatcacctgggacaaagtacttaagtccttaaggtagcacaccaaatcctgctttttgaattttgtgcttccaccaacactagttgtgtttctaaaagacccttggcaccttgttcccagtgcacatctgcagccccaacaggtgttcctgcctgagagcctttggaagctaattagacacgcacaggtgtgcctaatgaattcctgccggaccacacgctgtccagctgggaacagcccgggagcgaggccaaacaaccatataaagcgaggccaaacgacctattctgatgctttttgcatgctgtctgccgtgttttcattccccacggtgaggacggtgtgtcctgtctcctaaggccctgtgagccaagctcagctacaacctggtgccccacatctgacaacagggatttccactcaaagtgcttggcccttttgggcctgggggtgatgagtgggactggagccaagaaaccacaggtaattgggattcttctaggctctgtgattcccaggtgggttttttaatattcagggagtagcaaagatacaaatattgtagagctagtttaggcgtacaattttttttttctagacgtttctatggaacactaatgttggtgattattttgcagggagagggaatggaggtaacagggacttagggttttcatttcgtacttttctgcagtgttttgaaaaattaagattataagccttttttaaaatcacctttttcaagacataactgatatatagtaaaatgaacccattttagtatgatttgacaagtgtatacactcacataactatcacttccacaaatgagatacagaatttttctgtcaccccaaaaagctcctttgtgccttctcccagttcatctccccaccctcagccccaggcaaccaccaacccaatttctatatggaccatttttattttttctgtatattttactgtactaagggaaaaaaaatgtaatggaaatcttaaaatgttcagagggaggcaaggtttggtcactctgaggaatccctcttactagctacaaagttggtaggtaagggctgggtgtgtgtgtgtgtgcgcgcgtgtgcgtgtgtgtgcgtgcgtgcgtgtgcgtgtgtgtgtgtgaaatcggccatgttttccccttgtggggagaggggagaatgagaaaacaatattcaggtgaggctgtttaaaagaaagttaaatgtttagataattttttaaaaaataggaaaatggaagtaaatatgtcatgggagtatgggttattgttttgtttgttttgtcatgtgtttatcgtttttattacagaaagagttaactttttttttgaaaagctgtttaatgcttaccctactataaggagaaactgacaacaaataggagaacaagagttgagagtaagctgtgtgagacttacgttatgactaactccaaaaggtagaaaatttactttcagcaagaggctttagtttcctgtgtggatggcaaaacacctttgatatcactttataaagccttttaatttaaatgttaatttaacatgaactaaattaggtggtgtggtggtactatttttagaaaatgcgcaaagaattagaggcttgctaagtgcttccatccgttttctgacagctaacaggtgatgctgagtggtacagagcaaaccacgggagggtgtaactaaggttagtaacaaagcatcctgtttcccttgcttgcctgatgggaaccacctggagctcttgttaaacctgcagattctcaggcctttccccagaccttttgaatcaagttccaggggcttcttctgatgaggcaagtttagaaaaacactgagcaacactttgctttatagactttgcacacttctaagtaggaaggtcacggtgaatttttctccacccaagcaaaggacaaatctttttaacttctttgggagttgcggcctggcctctctcaataggtatgtgtatatttattaggacctttgcataaggtacttggattttagattgctctggggtttctatgcatatgtaagtaaggtgcaacttctgctctttaaattttatgcagttcttataagattgaggaagtgcaatgcagagcatatgaatggtggcaagtcagagtttttcttgtggtttgtgtgggacctattttctctgtatagtccagatttgaataattttgtaagctttgggtttttgtttacttgtttattcatttcataatttattgtcttacgagcaaatcactgtgctatgagtaaatacaagtaaatacaagtagctcagcctgtgtcttgtcctctaaaagcaagaaagataaaaacatttcttaattatagtattcagactgatcctcaaattcatatggaagtgcaagggacccagaatacccaaaacgatcctggacgtgaagaacaaagttggaggactcatactttccagtttcaaacttagtacaaatctactgtaatcaagatagttaagtactcacatagagatagaaatatagatcaatggaaagaattgagaatccaaaaataaacccttaatggccaaccaatacagttcaattgggaaagaatgccgttttcaacaaatagtatggagacagcagcattccacatgcaaaagaatgaatttagacctttatttcataccatgttaaaaaattaactcaaaatagatcatagtcctaaatgtgagagctaaaactgtaaaattcctagaagaaaatatcataaatctttatgaacttggattagacaatggtttcttatgtaagataccaaaagaccaagcaatgtaagaaaaaatggtaagtaggactgcactaaaataaactgttgtgcttcaagaaagcacaaaaagtccatgtgtggtggctcacgcctgtaatcccagcactttgggagtccgaggcgggcagatcgtgaggtcaggagattgagaccatcctggttaacatggtgaaaccctgtctcgactaaaattcaaaaaattagccaggcgtggtggcgggtgcctgtagtcccagctactcgggaggctgaggcaggagaagggtgtgaacccaggaggcggagcttgcagtgagctgaaatcgctccactacactccagcctgggcaacagagctcaaaaaaaaaaaaaaaaaaaaaaaaaaaaagtctgggcatggtggctcatgcctgaaatcctaatgcttgggaggccaaggtgggaggatcgcttgagccctgagtccaagaccagcatgggcaacacagcgagacctcatctctcttaaaaaaaaaaaaaaaaatcaaaagaattagctgagtgtggtggtgtgttcctgtagtcccagctactggagaggctgaggatcgcttgagcccgggagttcaaggctagagtaagccgagatcacactgctgcactccagtttggagaacagagcaagacactctatcaaaacaaacaaatgaacaaaaaaaccagaatgggagaatatatttgcagatgatatatttgataagaaacctttatccagaatatgtaacaaacttacaatacagcaatttaaaaaatgtttaaaacttggcaaatgatttaaatagacatttctccaaaaaagatagacaagtggtcaagaagcacatggaaagatgcttgacattaccagtcattagagaaatgcaagtcacaaccatagttagataccatttcatactcactaggatggctataatctacaagagacaacaacaggtgttgacaaggacgtgaagaaattggagccctcacactttgctagtgagatttttttttccccttgcccccaagatggagccttgctctgtcatccaagctggagtgcagtggcacgatcgcagctcactgcaacctctgccttccggtttcaagcaattcttctgcctcagcctcccgaggagctgggattacaggcatgtaccacaacacctggctaatttttatatttttactagagatggggtttcaccatgtttgccaggctggtcttgaattcccgaccttgtgatccggccgcctcagcttcccaaagtgctgggattcaggcgtgagccactgcgcctggccaagattttaatatgatgtggtcactttggaaaacaagttggcagttcctcaaaatgttaaacagtcgtcatatgacccagtaattctactcctaggtatatttccaagagaaatgctcatctactgatgaattgctaaataaatgtattatagcaacacaattgaatattatttggcagtaaagaggaatgaaatgctgacatgtgatacaatgtggatgaaaatatgctaagtgaagccagtcatgtgtgatttcatttatagtaaataagcagaataggtaaaacaatagaagcagaaagtagattagtggttgccagtgtctgagagaggggagaatgaggactaattgctgggtttcttttgggggtgatgaaaatgttctgaaattagatagtgatgatggttgcaaaactgttcatatactaaaaaccactgagctgtacagtttaaaagatgaattttatggtatgtgaattatatctcaaacccgttatgaattttaaactccaaaactattcctcaaggtattttgggcataaagatcaaaaggatttcagagggtagagatactatttctagattgggtagtagattgagaatttgtgaatgaggtgtgtttgagctgagtggtttttaaggaaggtgaacacttagatatgtagctgtcaccaaaaggaagagttttgagtcacagaattcagcatgaggcaagctcaggaaatcaagaatatctttgggagggaagttgtagttcagcttagcagttgtacagagtctgtaaaaaaaaattcaatccaaaatttaattggaaaggtgggttgggcccagagcagagggaccttggagtgcaaggaattctctgccttatttattatttatattttatttttattttttgagacggagtcttgctctgtcacccaggctggagtgcagtggcaccatctcggctcactgcaagctccacctcccgggttcacgccattctcctgcctcagcctcccgagtagctgggactacaggtgccgactaccacgcccagctaatttttttgtatttttagtagagacggggtttcaccgtgttagccaggatggtcttgatctcctgacctcatcatccgccctcctcggcctcccaaagtgctgggattacaggcgtgagccaccgcgcccggccttgtctgccgccttttgtcagctatagggagtgggtaaaaaatgacaggcctcagagctgtgtattaggaaaactgacagctgagcctttgcattagctagaagggagggagcccacctgtggaagtacccccttaggagtctcttgcagtcggttgagaagaagggtttcctgtcttgaattatctaaaactggaattattttggttaaattgtgggccttctgatacaaacttggtgaatttgaaagtcctcacacacatattattctacttcattttctgggaaaataaatctgtttcctagtaaagaactgtctgggcctgctgaacggtggtgtgtggaccctcattcaaccaataccgtgcacggcatcttctttttcttctattcctcgccacctgtggtggtgttgttgtttttcttctctatttcctctctccctttctaccccaactggatctactttctccctgtccctcagctttacctgcccacctccaatgataagacagtatcagagaaaattaccagtatttgtgcaacataaagtaagtttgatgaaaaccatattagagaaaacagcatgcagaaacctttccatgaaacatagatggacacatgacttgtaggctgtgttaaaaaactttaatggaaaaatatgctaaatgtgatgaagttcttttctaagtaaacttaatataaaagtaattggggtatagaggagactcactgtgagtattctcaagcctgtaacttccagagctcgtgaagatttcagcattcccatttgtgacttgctattaaactcttttctgctattttgatgtctcctattttgacgtcctgaatagcaaacttatgaccctgattatgcctcaggtcatggattatgaaatggttaccacattcctgagatgttaggaactaaaaggttgtcatattttcatatgtttatgatgaggctatctaacttataccagttaccaattttttttttttttttttgagatggagtcttactctgtcactcaggctggatctcagctcactgcaacctctgcctcccaggatcaagtgattctcctgcctcagcctcccgaggagctgggattacatgggtgcaccaccacacccggctaattattttgtatttttagcagaggtgggggttttgccatgttgtccaggctggtctcaaactcctgacctcaggtgatctgcccgcctcagcctcccaaagtgctaggagtacagacgtgagccactgtgccctgccaaatttttaaaatgtctttatcaatatgctatgtgttttttaatgcaatccgagatcaagtgtttgatagaaatgataaattcgggctgggcgcggtggctcacgcccgtaaccccagcactttgggaggctgaggcaggcaggtcacctgaggccaggagttcaagatcagcctggacaacatggcaaaaccccatctctactaaaaatagaaaaaacttagctgggtgtggtggtgggcgcctgtaattccagctactcgggaggctgaggcaggagaatcacttgaacccaggaggcagaggttgcggtgagctgagatcacaccactgtactccagcctgggcgacagagtgagactccatctccaaaaaaaaaaaaaaaaaaaaaaaattgctgtaggcatgtttttccaggtttgatttttttccagagagaagtatgcacaaacagttaacactgttacagtgtgagcatcaggatggagttatccaaaactcaaaagaagcctttttctttaaatagtttgtcaaattgtttgtttttcggggggtgggggatttgagggagagggcatggtgttaataggatggctaaacggtggtggatcgggtcttctgttctgttcaagtgagagtgttaaagttgtgagaagacctagtgttgaagacaaacgctgtggtattctgagagggagggaagcagagaagctcaggccgggggcaggttcacatcaggaggtccatttttgagtcttggctccattacttactgtttacctgagccaagttgccattcttcctgagcctgaggtttttcaacataaaatggggaatttgaaaggtcaaataaattaattcataatatttgtgttgtctggtttattataaacgttgagtcctatggagagtttagagatgttaccattcatatttttatgatatatagaacagcttaaagctccccctttggtgtaagtatagtatatacaggtataatgttctgaataaattacttcagttatagtttgtgaaacctgattatagctgatactctggaaatgtaactcagttgtagtccagaattttatgctcaaggtggtgctgtttccccataaatctgatgatgttttacattttatctctatctgttccaaatcaagcaaataactggatatatgtctagggccatttcggccttccacagtcccccaagccatctttccttgtgagaccccacccaaaatcatgtcatagaaatgtgtatttaccccatattcactagaacacatgtgggagcttaagagttgagtataccagtggacctgttcaacattttggaagacatttgttaaaaaatactttagatactacagcttgctttttgtattttagagtcagtttgtttttaggtcagaaatatttgaaaagcttgtaagccctggctcctaatggaataaaggacctaatatagttcttctgcaaactgattacgttacaagggaaaatactcatttcgaacttatttttgctcataatctctttccgggccgccatattaatcatttcctacttgttgtcagaaaccagacgtgcatttcatagatgtggtcgttgtgtgtttgatgtgaattgttttgttttgtttgtttttagatccggggatttctttcacggtttgataatgtccttcccgtcagcctggcatttgacaaatgtacagcttgttcttccaaagtaagtcattttgtattggagggacttgtttttaaaagtgagcgggtcagcatttgaccgcagcctcaccagctggagcccttgaaaccaactaagggctttttgtgggggaagggtggggtctaaaccctcagaaaggactttgttttcatggatctgtattcattctcacagtggtttaaaaccagcctgagaaaatgtgtagggagactgagttaaaatatttcaactctgtatcaatacttgcatcatgctaattttgtcttgaatttgaactttactgctctttgttcctccccagagggttccctcctagccaggaccctcatagagcaattttttaaagcgttactctgagggtgaggcggccctggctatgcatcttctgcagatccacataattacaaagaaaaagtaaacagagattaggggcctggatggggagccactaaaagggccccttcagctttgatctttccagaagctctaaaaatagagctggtatgttagccatcgtaatgtgaaacggctgatatatctcaaaactacagtgatggcatctcgtgttttaataggctttcggataccatctgagtgatttttacatgcacactgtatgtgatagctgatttcctttcaagtgttcctttcagccttctgctgcccagcgacttgacctgggcttttaaggctcatgattgctgataagtaaagattttcatgttgaagtgctatacaaaataatgttggtgaccactaatccccaactgtggcttctcagttacaatttggaactatttttcgtgtagccttcgtctgtctgccactgtggaagaaagagaattctagggatgtatttctctattctgagttgacaagcttcctttgaaaactgtacttgggctatattttatgggaagcacaatcctgaccagtttctctaaaaattgaatgtagaattgacaagcaatgttgataaatttggttacgtttagatgctcaaaaattgagactaattattttctttttgcttccgaagtaaactaagcctgttttattatgcatcccaagtgcctatgttgagatttcaagcttagactttgtcagtagttacccatgagcccattctttctgtagtttcctttaagatatatctgctcaagccaggacctcaaggatgtctgcatgcacccccatcttcagaaatgcaagttttaggattgtatactacatctttagtggagcagattttttttttctttgaatggttgagctaactggtctcaaaataacttggcagtattaattttcatactgaaatcatttggcacaggtgccaggttttctatggctttatgttggtctggctagtcaatgaaataaagataattgggttctctaagtgaaatgcaaacactcattcattcttgttctatttctaattaaattagcctttcagatactgtttataaaagaatcacaagcataccatctaactgggcgttccttatactttaaaagagaatagcttagcatttttctttcacacttattgtaagcttttaattaaatataggtatcacttttttgttagcaaaattatttcctcttggtgatcattttgagagtcctgctttacataaacatgttggacgatttaatacaaactgacttggattttaacagctgtgctattcccatagcggtcacttttcatgtggtctgagtattaaatttcttttgtcctggaaaggttgcttcattggtgcacgtatttccttacagtagaaacgcagcatttacttacttggctaccttctttatttgcttaggagattgtcattctctattatctgcaaacccaacattaatactttaaaatgacaaatccaattacattttcatttctgtgtatttgaatttttcttaatgtatatttagtataatacatgttatacagagtcatgtcatagttgttgtttcaaaagattggggctaaaaattacttttaaaaatttatcctttgacattcatgaagtaattttttcctttggtagttttcagtatgtttcctcctccccaccaggatcaaggccatgcttgtgtcttgatttaaccacaaatagagacagactggggaagtagaataagtttctgctgaatagtgaagcacttgttcattatcttatttattaaaaacaaacaaagcaatacattatatacacatatatatagagagagagagtgcgagcacgcacgcacgcgagcgagagctttttatgtagcctgaggtggggaagaatacagtgctttgcttctaaagcaggaaagttggaacatttatccataaatcatttcttatcctatgtgatcttaggttggcacataacgaggtgaattgttccatcttaggggaaaaatattgaaggatggtggggagaggtgggtggtgaggagtcactttcattccagtttctacttattgtcttgcagaactttctaaacagatggtatttgtcaatgaaatttcaaaagaccttatttgacgtttatatgagttgctctttacttctacaaagaaattccaagctaactagagtattgtggtgttactaccagagggaaaagtataatttttaaaatcaatattcctgaaagaatttcctgtagtgcattaaattactttgttattgttagactttcacctaaatattttttggcagagtatttttgggtaactttctattgatataattttaagcttaacagaaacattggaagaatagtacaaggaactccggtatacactttacccacattcatccattgttaacattttgccccacgtatatttgctgtcgtcctccaatccctccttcttcccttcccctaccccatttttttcttgaaattttgagagtaagttggagacattctgatcctttaaaactgaatgcttcaatgtgaattccaaagaacaaagacattctcttacctaaacacaatatccttatcaaattcaggcaatttaatgtttgcacaatactattttctaatccacagtctgtgtattcaatgttgttgtttataccagttaatgttcattataggttttttccttccagaccaggatccagttgaggatcaaacattgcatttagttgtcgtgtctctggctcccttcaatctggaaaagttacttcatctttctttatctttcttaacttcagtgttttgatattttgccagttatttttgtagaatttccctccatgtggatttgtctgatgtttccctatgattcgattcaggttatgaatttttggtggaaataccaaagaagtgatgctgtctcctcatgtcaggagttatataatatattatatacctttcggtgatgctagttttcccttttccatatttctgactaccttctccaacagtgagaaacctgcaatctcggctcactgcaacctccgcctgcctcccaggttcaagcgattctcctgcctcagccccacaaatagctgggactacaggcacttgccaccatgcctggctaattttttgtatttttagtagagacagggtttcactccattggccaggctggtctctaactgctgacctcgtgatccgcccgcctcagcctcccaaagtgctgagattacaggcgtgagccaccgcatccagccgtatcctggatatatttactcacttgctgaagtctagaataatacaggaagtagtttcaaaattgctagcccatactactacagaaaataaacctagaaccttcagttcctatttgtgcatagttctttttttcctaggtaaaatttatatatggtgaaatgtatgaatcttaaaacaactccgtaagttttaacaaatgtatacacccatgtaacccacactcttcctatcaagatattagtgtttttccatcactccagaaagttcccaggtaccctttcccagtcaattctgggggaaggggaagtatgttgtatattatgactagtccttctctaaaaggagtaaagctaggcagcttcaggtgttctttgcaataataaccttgtttctggtacccagaagttgaccaaaaccttttttcagacctgcagagtcaggagcaggactgtgcaggaggagactgcgtgcagagtattcttgctcttgttgcacaattctattactcacaaccttcttgatagtgcaagaacagcctgttgtgaagaatcaggctccaaacttggtttgcataccatctgggacctgcgcagatgcagcaagatgtgcccagaaacctgatcttgagatttcagtgattagcaaccttaataatacactcattctggtgttgactatgcaataggttcttctgttgatgggttatgattaaactcctcaaagtgacttgctattagctttctgtgtgtatctgggcatatatcttgaagagtgatagggtaagggttaggtaggaataataaatgtcagctggtaaatcgtactttgttttggccttggttatagccagcctgtccatttatttttttgatattatataatcctacctaccttctatcatgttttcttgttacttatgaagcatgaaaggctaggcatggtggctcacacctgtaatcccagcactttgtgggggctgaggtgggcagatcacctgagcctaagagtttgagaccagcctgggtaacatggtgaaatcctgcctctacaaagaatacaaaaattggccaggtgtggtggcctatgcctgtagtcccagctacttggggggctgaggtgggaagatccttgagcccagaggttgagatcatgccatggcactatagcctgggcgacagagcaagactctgtcatgcccatgccccaaaacccccgccagaaagaagcatgaaataacaaaaagtcaacttagctgcttaaatagtgtttttgtttgtttgtttgtttgtttgtttgttttgggacggagtcttgctcacttgcgaggctggagtgcagtggcgtgatctcagctcattgcagcctccgcctcctgggttcaagtgattctcctgcctcagcctcctggggagctgggactacaggcgtgcgccaccacacccagctaatttttgtattttcagtagagacggggtttcaccatgttggccaggttggtctcaatctcttgaccttgtaatctgcccacctcgacctcccaaagtgctgggattacaggcgtgagccactgcgctcagccagctacttaaatgtttaagagaaacctctgtcccaaagcaacttgtcacctaaggactttgcaaatgcaccacttagaaaggcaaatcatagatttgaaaggaatggttaaactgttatctgttagcagacattcatttaattcaactgacatttgagtccctgctgtgtgccagagatacaaagatgattacaatagccactgtcttcaaggaacactgcctagagggtgagacagactcataagccaataatgatctgttcagttgtgaaatgccctacagcaaggtctgtcctcttgttacggcatcccaataccaattaattttgtaaatgtggaggactagggaaggccttgcagaggatgacttctgagttgatgttaaagggtcaagtaggagtttctagaaacacctaggggagagaacacaaggaattccaggcagtggagaattgcatgtataatagccagagacaacaaaacatggcagttatgaagttgtttagtagagcagttgtggctgagcctgggacacccaattttctacaaatcgtcctcttgtctttgtgagtgccgttttaattttggccatccttggagttggaatctggtatacgttgtctaatgcttaaagctgctgttttgaattttacaataacatgtaaaactcttgctcacctagcaccgagctttttagggagtttcctagcctaaggaatccagcagctgcagcagggtggtgtggagggcaggaagtcaggggatttccagggtcctggctctgcatcccttgctggactgccaagtgaccacaagcaaggtgctcccccactctgcccgccttcatttattttcttcagtgagtcagttgaatgagataagttctggctctctattgacactttattagcttttatattttatatttcctttatttcacaagcaatggatttttaattgcagaaaaatcagaaaatatatttaagaaagaaaataaccacgatccagccatttagatcactgttaattggtgatgtcaacacttcttgacttaaaatatatatgtatgtatataggtatacatagacatcatttttccctgaacattcctactataagggatttatggtactatattgaggatactccctgcttctcagatttgatagggttttaaatctcaatcatttacaaggactggccagagcccagtcggaagagctctctgcagcctgtgccaggaatctttgcatacagcttctcagtggcaaatattactcaaaactgggctgcagccagattttccttctcctttccaaaagggatataaatctctgatttggaaaatgatgagtaacccccaggttctcttttcctatctcatttacccagcaaggcctcaaatcttctattttaatgtatgatggattccatatgtatgattgtgtggtataaaatatatcccacatcttgtccttagcaactagtgttttctccaatctccagaactgcttggttcccaaaaggagatggaatatacagccagagctggtgaggagtatttagctacaagccttaacctcagaactcttggctcttcactgccttgaaaaaccttggacatttctccctttgcttctatttcctcatccatacagtggggaaaatattttctgtttcccagggaaattgcaatggctgacgtgtatccagttccctgtggccaagtaccaaggcctttgcccactcctgggactggtgttgacatcagaaataagaaaacaaagacccctgtgattgcattaggtctcctgagatacatgcagccttttctgggctcactgtccacacacaggtataatgggagggattgaatcagggatttgaaggccaaggctgccctggctttgaaaggctgcagaaaccttccgttcatgtctcttgacaatgacagccaaaaccttttccatgattccagagaacacggccttgcttgttacttttgacctgtggtttttaagactacctaattagtagttagaacttgtgatgattactcctttccctgtcacctgtggtcacaaacacatctagttttcccagacaaattttttcttacaggatcccttttgccactcagaccagaaagttgagggctgtgttctccttagatggttccattggcagcctggcccaagcatagtcttcagggtattgaaaaattgggttccttttagtttggaattaatctcattcacctctagtcttatccccaagcctattcttaaatttttttgagtcatggattgtgttcagactgatgaaagcagtcaccactgttccccttaaaaatgcaaagccagctgggcgtggtggcgcacacctgtaatcccagcactttgggaggctgaggcaggcggatcacgaggtcaggagattgagaccatcctggctaacacggtgaaacactgtctctactaaaaaggcaaaaaattagccaggcgtggtggcaggtacctgtagtcccagctactcaggaggctgaggcaggagaatggtgtgaacctgggaggcagagtttgcagtgaaccaagatcacgccactgcactccagcctgagtgacagagcaaaagaaaaaatgcaaagccacacagttttacagacaatttcagaggcttcatgaagtccctgaaacatctctgtggatcctagtaaagcaccattgctctatgagtgtttctttggtaccattcccaagctctcctagatgagacactaggatatgagagttgcaaccagtcccaccatggctgcccctatggctttgggaactgaccatctacctctggggactccttttcctcaactgtagtaaagggagatgcaggggctgatttaccactagtttttgtgtctctgagattgtgtagtctcttgatcaactatttcatttctttaggcccagctgtatccaactgggtgatggaggacggtactaactctcctcagagttcagacggttagttctccctctgctagcagggtgcattgacttgactcctgatgggcaaaggtccccaactagccactgctcatgttccttctttttttttttttttttaaggagtcttgctctgttgctcaggctggagtgcagtggcgctatctcagctcactgcaagctccgcctcccaggttcatgccattctcctgcctcagcgtcccaagtagctgggactacaggtgcctgccaccacgcctggctaattctttgtacttttagtagagacagggtttcaccgtgttagctaggatggtctggatctcctgacctcatgatccacccacctcggcctcccaaagtgctgggattacaggtgtgagccactgcgccaggccccttctttcttttttttattcatatagtacattcatcttcatcctcttgcctataccctcaataactttgtaagatagggagggaggaacatggacttgtaactgctacccagctgctgaaacaagggagccatcagctggaactgggaaagcttttatggacatatatggtcttacacacacaggctttatacaatgtatatatcactacttagagtattttaagtacctaaatataggcctggcatggtggttcacacctgtaatatcagcactgtgggaggctgaggggggcagatcacctgaggtcaggagttcaagaccagcctggccaacatggcgaaaccctgtctctactaaaaatacaaaaattagccacacttgtaatcccagctacttgggaggctgaggcagaagaatctttgaacccaggaggtggaggttgcagtgagtcgagatggtgccactgtgctccagcctggggaacagagagagaccctgtctcaaaaaaaaaaaaaaaaaaaaaaaaagatgtgaaagaactgtttgagaatgtcttattcctgaagttacccttatgacttgttcatataacatgttatactgtatttatgatagtgatatggatatgaacttaatcatagttttctagagtgtctgaccttctctagttttatataattctttcattatgaaagttttgttagtgctttttttttttttttttttaacacagaataagctacatggttctcttctctagaatatctaatgactggttaaatcacatagcaaagttagacatcttgaatttacagccatcatactaaaacgggaaaataccgcctgtgtgggccttaagctactgcaagtgtgccaaatgtgaacagtcagtgggagaatacacatgagcaagttttgcaaattagaggagtcttcttgacagtacacaagggtgtattcagcagagtcttgagtaaaggcagcatcattggaatatatgtgcagcctcccacgaggactactgtggagcatgtgttgaatcgtaatctgaactcacctgtcgtcataagtcttggcagctaaggtgtctttgtaattgactctggattcactgaagcatttggatattttaaagaactctattgaccttccaacttgggatagaaatccatgcaaaagcatatttttgtgttatgtgcgaaggcctgggaaaaatttggatttctcttagttctcagttgtactttgcattttcctttctttatatgtcagctcttccacaaaggaccttgaagggagagggtaacgaaagtggggattgaggcaagtggtaattactcattgttgtgttgaaacctcctacgtatcccaaatgtggaatgtgagctcaacatcgctctttcttaaagaagactatttattttgttgcctgagtaaaaccttccataaaattgctaataggcctatgtacaatattttcgttatttcagtttgacttgactgataaggaagattgattttaatcataaggcacacagattttttaaaaagtgagtgcaaaatgacttgctaatagactaatgtctgagtaagaaaacaaaaacatgtgtctcccagctctattggaggagcaagagtttcatttaacaatatctgctgtctttgcctaatcactcactagttgctatttttgataatattccaataggcgctgaaagtatacctggaaaatgagacctatgtcatcctatcccactcagcagaaggactgcagtcccaacaaatggaccctttcacagtgctccctggaggagactgtatgtttctgttgggctgtgctagtttgatctgttcttcttgggaaattgcttttactctcacagtattttcctcataatagcctcagcagtggtaactttttgacctttgtgggtgggtttgatttttttttttttccagaaagtaatttgaagctgtgtgttgtgaataaagagaatgagcaatttgcaggaaatttttaaaaaactgcaagttaaagtactgcaaggcttaaaatggcacatgggtgtgaacaaatgagaacgttagaagggaattcaaaagtatcctatcttttgagctaagagctggcaggacattttgatatgactagtgcagcagcagtgagcactggctttatctgctacccactaaccatgtgaccttgagcaagtatctcaaactttgagcttcagtttcctcaggtatgatgtagttgcagtaccatagccatgaagttggaataagagctcgtgtgatgggtgtcatgtagttggcactgtcagtgttttccgttgatcttttgtctgaacagagatcaggtgccgttcccatttcctttcctgaatatactcatttttgtcatttacagccataaaaaactttccatctttagaagttgacaaaaaaggaggggaacaaaaaagggcctggcctcaagatgtgagcaaatactaatgtgcaagtttttagattctttttctttttctttccttttcccttttcttttcatgacagctgtaaatctaggagcttaattattaacctaaatgaagctgaggtttaatgttccccggagcatgcactgatggggaaggatgaattctcatttcctggaggctgaagatctgtgcaggtgtctgtggccaatgttaagcctacgactttagatgagctggcataaatcttgggagagttttcttgtctgtgttccctctgaatttctctgtgctgttagaggcagggacagaagagaaccagcatggcagtgctgggctcagggtgatgcctgcctgccagcacagcggttcttgtccctgtcccacattgcttcttggaagcctttttacagcctcaatcatcttgctttttctaccgcagctataaatgggttggaagccagtgcaacatgggcagggaggacttggtttaatcttttcaagtgctacagcatttctctgttcctttggcatcgttttatggatgttttcccagtatccctttccagtgtcttatgaattggctagcaagagcgcttcccagtctatcagatggagagagcattaggctcagagaaattacatgaaagtccaggatttccaacttcttgttcacttttctaccatattaatcatctctcagacagtgatgtggtaggattcatatgcatagaattccattgtacttattggggggggggtaatttcactttaaatttttagcagcttcgaggacttaattggttaggctccttcaggctgtctttggaaatcttgtcctttgaaaagggaatgctgatacccagaggaatgtatttcttatggtcatgtttcagactgtagcatcttgaaagtcatgtgggctagagcaacttctaggtgtcctttagcacagatgcaggctgggggttgagagtttaaaagctttttctcaaactgtttatgacaaacatagttcatctcccattttggttaattctcagcttaagtattttaagaaacatttggagggcagggacatgcagctgctaagaatccaagacagtgctgttttgaaaatgcaaatatttctggtttgcatttacttgaagtagggtagctttctcccatatattcccttgaatacagatattctttaaatgacatcattttgagtagaatacagagtccaggtggttttggggaaatcattaaaaaaacaaacaaaaaaaacaaaacaaaacaaaaaaacaaaagcttaggtatcattgcattctaggggccaagaaacagaacgatggtatttttggcaggcacccaggcccagcaaaacccacaccccaaggctgtctctgtagcttcctgtggttttcccactgaagagaaacagcctttctcttggagggcctgggatggcaaatatgtatatcagcttgatcagaatcataatattccggctttgaggttatgtcccaacaggcttcatttaggaaatttgatgcaccacaattgttgcaaactgagctgaactgattttgtggctcctaatggtgcaagttttttgtttgtttggtagaaactggtaacgtcctatattagaagttatgctaccaggtgatctgtaacaataaagtcaagtctcagactaaattttgccacagataagaacattagcaagcaggcacaaaagttagtcattcagcatgttcctgtggactgggaaaagccccaacctgtcctttgggtatgtatctcacgtcaaagtttaggtagaaacagatgcagaaaaattctcaatacaggacacatctaaacttttcattggcgcaggtgatggaatcctctgttaagtgtccagacccaggaccagagtgccactgcagaaagtgttaggctgcctggtttgccagattcttataacccacgtatatatgcaaggttagagatccctgtacagtatttccagccaacacatatatatattgaattctattgttttcatcggaaaaattatttctaccatcctttatacttgtgaggaaatcctctagtatagatttcaaagctgtagctgatgcttttgtaatagccacacctggggtatgcactcctgattagggtacctcagatactaactagctacccataagaggaagggagggagggagggagaaagggtttgtgtgtcttcccacatacttgcatgcattcatactgtgtattcagaaatatttaaaaataaattacagataataggtatctctttatttgaccctggaaatattatgtcttgtataatgttgccagccattcatgagtgacttgaaatgtcaactgacctttggcctgccatggtgttttagtcagagccattgatgaatggctcaccatggggcagagaagagagaagagaatgataatttttgatagttttgtaggttttttttttcttttatctcagtctcattcggttgcccaggctggagtgcagaggtgcgatcttggctcactgcaacctccacctccaaggttcaagggattctcgtgcctcaccctcgcaagtagctgggaatactggtgcatgccaccacaccaggctaattgttgtatattttgtagagatagggattcgccatgttgcctaggctggtctcagactcctgagctcaagcagtcctcctcccttggcctcccaaagtgctgggattacaggcataagccaccatgcccggccagctttgtaggctttttcaagcttttttgcattctttcatttgatattctggtattgtggagatgttgtatcccccactcaattttatacacaaatcgttgtccagggtcatagaatgagtaaattacaggaactataacttgaacgaactctcatcctttatagttcctctgtactataagggcaagttactaccaagaagagctattactattcttcaaagaataccatagaactttttcaccttggggcagttattgccaaggtaagaccatgtactaaggatatattatataacagaatgctgggagatttctgtcttaactagtgataggacaggtgatttaaaccagctctcttactgaagtcaccttaagaaactggatcagttgcttctaaaaatcttcttaaacatcaaatcactattataaggagattctgagttgagctttgagagagaatgtaagcacagaggagcaaagccgtagtattagggcaattttttgttttatggccatttgctgatcaggaaaaggaagttgagagcgtgagccacacctttagtgtcctttcaaggtgaaggagataaaacttgtagtctgggtgctttcaagcctgagaacccttataaatcattcttgactttgggttggaactctatcaagagatacacctaggagtaagggtgaagtgggtgtaaaccatccctcacattggctgtaacaatttcacattatttaagtggcccggaaaccgtaaggcttccttgcattaagataattctatttagctaatgcccatagttgccaggtaaaagcaatgaaatcttagagggaaatatgatcctagtcctaaaattatttatatagataattttgctgttacaatatccagccacagaggtaaccaggcacacaagaagagaaggtaccataagtgagagttggcagaagcaaagacaaaagaaatacagacatacagagattctagatattgtacttattagacatacactatgaaatactattcttacagcattaaaggaagtaaaagcccaaattttagttgtattggggactggaaactctaaaatacggctttccagatttaaaaaactgaaatctagaactgaaaattcaaaaacaaaatgaataggtgtataggcaattatatacatctaaagagcaaattagtgaaatggaaaataggttagaagaaacttcagagtgaagcactgtatacacaaagatggaaaatataaaaaaggtagaagatagagtgagaaagtctaacagtcataattggaaatctagaaaaaaagaaataatggttctatagcaacattgaatgggattatagataaactttttttgaaacaaatgaaaaacctgaagcctcaaatccaagaagcccaacaaatttataacagtacaaataaaactaaatccacaccaagacccatcataatcaaacttcagaaaatggaatataaagacatcttaaaagcagtgggggatggggaaaagacattaacttctgaagaatgatggtcaggcttacagttgacttgcagagtgtgagccacatgacaatggaaataacttctttagtgtgctgaaggaaagaaacgcatcccacaattttaaacccagcagataataccgttcaagaatgaaagggctgggtgcagtggctcacgcctgtaatcccagcactttgggaggccgaagcgggcagatcacgaggtcaggagatcgagaccatcctggctaacacggtgaaaccccgtctctactaaaaatacaaaaaattagccgggcgtggtggtgggcgcctgtagtcccagctactcgggaggctgaggcaggagaatggcgtgaaccgaggaggcggagctcgcagtgagcggaggtcacaccactatactccagcctgggcgacagagcgagactctgtctcaaaaaaaaaaaaaaaaaaaaaaaaaaggtagggggggaagagtaaaagtgaaggtattaaaggtattttgtatagacaagaacagagtccaccactagcatgtttacacaaaaggacttttattgggtcttctccaaataggaggaaggtgatccaaaacgttaaatcagaagtataggaaaaaaaaaaaagtatagaaagtggttaaagatggggataactctaggccaggcacagtggctcatgcctgtaatcccagcacttttggaggctgaggcaagcgcatcacttgaggtcaagaatttgagaccaggcttgccaacacagtgaaaccccatctttactaaaaatacaaaaattagccagacgcatgcctgtagttccagctacttcagggggttgaggtgagaggattgcttgagcccagaagtttgaggctgtagtgagctatgattgtgccctgtaccccagcctgagcaacagagcgagactgtcccaaaagaaaaaaaaatgtgggtaactctaaatgaacatttgaacatttactgtataagaaaatacaatattgagtgggatattttttaaaaatagaaatttaaggccgaggtgggcggatcactcgaagtcaggagtttgagaccagcctggccaacatagtgaaaccccacctctacaaaaaatacaaactaaagtttagccgggcatggtggcagacacctgtaattccagctactcaggaggctgaagcaggagaatcacttgaacctgagaggtgaaagttgcagtgagccgagatggcgccaccgcactccagcctgggctacagagcaagactctgtctccaaaaaaaaaaaaaaagaaaagaaaagaaaagtattaaaacttggaggaggtaggtgattggaattagtctgttctaaggttcttgcattgtcttggaagaggttaaagataggaattaatgcttgactgagataagtcaaggatatatgttataactgatagactaaacagtaaacaaatagaaaaattgtataacttctgattaaaaatgaaaaaattgaaaaagatgatttaaaggaagaaaaaaacaagtacaagatacaaagcacaagaagtcatggtaaactgaaacccacatgtatcagtaattacattaaacataattggttaaatgctggcggtagaaagattatcaaaccagatttttaaatttatatgcattatacaagcaatatatcttaaacttacagaatgactgaaaataagatataagaacataatattttagtattgaattttcaaaaatcagttgaaaataaacttaaataccacaagaaagctgctgtagctatattagtatcagacaaaacagattttaaggcaaaaagcattaatttgtaatacaattactttataataattggttttaattcaccaggtagaatttctaaatttgtatgtatttaataacatgtctataaaatatataaaaaatttacaagaactaccagaaataaatgatttttcccccctaagatggagtcttgctctgtcacccaggctggagtgcagtggtacgatcttgggtcactgtagcctccatctcccaggttcaaatgattctcctgcctcagcctccgagtaactgggactacaggcacatgccatcttgcctggctaatttttgtatttttagtagagatggggtttcaccatgttgcccaggctgatctcgaactcctgacctcaagtgatccgcccacctcggcctcccagagtgctgggattacaggcgtgcacccacgcccagcccggaaataaatgatttataatcacaagtagaaaattttaatgaatcggctgggcgcggtggctcacacctgtaatcccggcactctgggagcctgaggtgggcggatcacctgaggtcaggagtttgagatcagcctggccagcatggtgaaaccacatctctactaaaaaatacaaaaattagctgagcatggtggcacatgcctgtagtcccagctacttgggaggctaaggcaggagaattgctggaacctgggaggtggtggttgaagtgagtcgagatcacaccactgcactccagcctgggggacagagcaagactctgtctccaaaaaaaaaaaaggaaaattttaatgaattattctcagtaattgatgaaaaaaggataccaaaagaaatcgggaagggttattgaacttggttaacatgattaataagcatattctagtgaatacatatagaatactgcacctaactgaaatatagaatactgcacctaatttgaaaagaaatacatattcttttcaagcacacacataatattttacaagaatttgctggcatagacgggataattaaacaagtttcaacgaatttcagagtgaaattgtatagatgtatactgattccactgtaattatgcaagaaatcagtaataaacagataactagaaaatcatccccatgtgtttggaaattcagatacatacttataaaactcattaattaaggatgacataatggaaattaagaactattttaactgaatgattaaaaaaattataccaaaatttgtaggatatggagaaagcagtacttaataaaaatgtggctcatgcctgtaatctcagcactttggggggtcaaggcaggaggatggcttgaagccaagagtttgagaccagcctgtgcaacatagcaagaccccgtctctacagaaaattaaaaaattgccaggtgttatggcacatgcctgtagtcctagctacttggaggctgagataggaggattgcttaagcccgggagtttgagcttatagtgagctctgatcatgccactgcactccagtgtaggtgacagagtgagtttgagcccttgctaagaaaagccttaaaacaggcccgaaattaatgagcaaatatttgtatcaagaagtcagtaaaagcaacacaataaatgcaaacaagtagaaggtagaaattattacagagaagaacagaaagacctgtaaaattgctaaacctatggtgaggctgagcaaaaggaagattaacatgtatcttagcattgaatttttaaaaatcagatgcaggctgggcgcagtggctcacgcctgtaatcccagcacttggggaggctgagataggcggatcacttaaggccaggcattcaagaccagcctggccaacatggtgaaactccatttctactaaaaattaaaaaattagctaggtatggtggcctgtacatatagtcccagctactcaggaggctgaggcaggagaatcgcttgagccccagaggcagaggttgcagtgagctgagatggtgccactctactccagcctgggcaaaagagtgagacactgtctcaaaaaatagaaaaatataaatcggatggaaaagaataaatttatagttcaatgttaaaaaacaaaatgaagtgatattattaaggaggcaggcagatttaggtgaaaaattatgaggaaaagtagagaaattattatataagtcgctggttttaagaggtaagtaaggagttgtaatgtagaagtggcctacctttccttccttcctttcctccctcccttccttccttccttctttccttccttttttgacagtctcactctatcgcccaggctagagtgcagtgacacaatctcggctcactgcaacctccacttcccgggctcagacgattctcctgcctcagcctcccgagtagccgggattataggcataagccaccatgcccagctaattttttatttttagtagagacagagcttcaccatgttggtcaggctggtcttgaactcctgacctcaggtaatctgcccacctcggcctcccaaagtgctgggattacacgtgagccacagtgcctggcgtggaagcgactttgtagggacttcggatgtaatgtgttgatgttcttgactgggttgtagttacacagatggtcactctacactatgtatagagtataatgtagcctatagactatattttacatttctgttacttcacaatgaaaaatgttaagaaaataaataggtgttctgcatgtatgcttctgctggcatgcccatcatttacactgttctttatgccagacaggaaggttcacaacctgacactgtgtctttcagagaatgctcatcccagcttgaaggctcttaacacaagaatttccaattagtagaggtaacctgctggtagatcatataactcatcaaccttaggctgtaagagactgagtccaatgtaagttttcaataatttacccacccacaccatacttaatttaagccagggtatatgaacttcctgaaactgaaactgttccctcttatgctgagtacccagataataggggtaggccaataaatcaatgagcagagaaggactagcttgaagacaacagaaaataaatagggactgtggccaactagagctcaagttctctccgtggagcagctgcaacccaactctggatgattgttacttgcagactactgggaataacgttgccatattttctgattttttttccttcgaagagtagatagaaatgtgaattttaatgtgcaagtacctgatttttaagtgttggttcacaccgcaccccccaccccaaaatactgcttgagtcaaaccaaacctgtacctgggatatgtccagttagtttatgagaataacctcaacagccatgcagattggagagagagaataatgtataaaataatgtactataaccttcttgatggaacttgcctgcgaagcatgttcttatataattctcaacttcaaaattaaaagaaactcaaccaaaattcatacattacaaacgtcactcagggtaataattttcttagtgaaacctggctctctctgcaggggaatgaatttttttaccgtaagtaatttattaaagggattgagtaaaactgctaaatagtgatatcacgcaaagcaatttcttttaggagaaatagctaaagatggactttaaaaatgtgctgcttaatgggttgaatcccaagatgttgtgctcctgtttagatgtagcaggcattttcaaagtggtccgagcaccagcagcatcagtgccatttgggaacttgctagaaataaaaactctcagaccccgccccagacctaattaatcagaaactgtggggttgggcccagctacttctgttttaacaagccttcctggggattctgaagcatgctcaagttttgataaaccactgctatagcttttgtgctttgtgactttttttgtagaatgactttagaaagttaaactttgttattttaaggtttcaagtgaatattttcttcaatgttgacatcttccaagtatccttcaaataatatctttggtttggcttatgtcagtcaagtatgtgttggtttaaaaagatgaccgagaatagaaagttgtatcttctaaaaattcattttaaagtgagattcgtatataacagcagacacaattttatcctctttctgcctttcttatccactacactcatggtatccactcacagcctcactaaggaagtcagtccacttcatgctcagcttttaacttaggggttttttaaatgtatgcatagcatgtatcatgcacagaatgccatagaatccttctctgacccctccttctgttttataagccattctgtgcataaggccacagtgacttcacactggactctggttctgcctcctactaaatggcagagtccaggagggtcccacaacctgtgtactccaggcctacagactataagctctaagtaatggatgctcagcaaatattttttctttgctctagggtctcaactctcagcaggattaatagctgtttaacctacggtgatccttttattagtttgttacagtaagaaatgcatgttttaattggattggaagccttgaaccttttcttaaataataaacatttttatgttgaggtaaaacttaaaaacagtaagtacacagatgttaagtgtacaacttggtgggttttttttcacatgtaaatacccatgcaactgagacaggaataataacagggtggtcgcaggagaatagaaaattccaggcagcagtttcacatgactagcaaaaggaaactgttgaaatagctgcatagactgggcgtggttgctcacacctgtaatctcagcatttgggaggccaaggcaggcagatcacttgaggtcagaagttcgaaaccagcctagccaacatggtgaaacccggtttctactagaaatacaaaaattagctggggtgtagtggcaggcgcctgtaatcccagctactcagaaggctgaggtgggaggattgcttgaatccaggaggcagaggttgcagtgagccaagattgtgccattgcactccagcctgggcaatagagtgagactccgtctcaaaaaataaattaaaaaaagaaatactggataagctaggggctgataagaccctgaaaaaccagggtgtgaaccaagctggctaagaatgactgcacccaacatggctgtggatttgacctaggtttcacctagaacctccttatacattcattaacatatcacacatgcaccagccccgtgaaagtcaaggccagcctgggcaacatagtgaaaccccagctccaaaaatataaaatcacagaatagaaggaaaatcaactgtcagatgctgctgagagactgaatgaggattataaatggcaagatacaggtcttcagtggtctttttatattaatataacacattttttaacaatttttttaatggagtcagggtctcatagccaccacacccagtttatttaacaatcgacgtcaacaattacctggttacatagacttaccagattaatttatcaatttagcagttaatcaaattagatttctcctgttttaaaaatattgaatataaatttcaatgcttttaaagtcttaattaaaaccaggaatctattctcttaaatgcttaaagtacattaagacatatcaaacaaacactttgctgtagtgattacaacgttgaatagtacactaacataccatttataaatatgttgatgctatggatctaaatttgtgtttcttaaagatattcaagagctttattgagatacaatttacataccagaaaatccacccattgtaagactagagtctgataattcgtagtaaatgtaaactgacgtgcacctatcaatctgaggaagtcttgacaagagtcttttggagtgcggagaggaagtcctcattggagtaagttaaagagagaatggagaataatatagatgtttcaagggttttcttttttttttttaatctcttaagggtattgggggaaggtagtaaggagaaggagattaagagggattatgtctaaaatggtaattgtttcatcttgtttgtgttcagagaaaatctggagggatagcttgtctgattccttctgtttagataataaaggatgaaaagacatcatttaagaaatggaaactagcaaatgtaaacttttatgtagtttttaaggttttttcttctggtgagttacttgcatttcattgggagaaaaatcttcctttaaatgttattgataatcaattattaagtaggtgaagcagtctggttcctttttcctcacattgctttagaaattaatacgaatgctaatgaaaaggcaaggaatataaaaaccaacaacatattaatgaccctgaggtcgaagtatgaatatcacaagggcaaaaatagttctacacattgggcatttcagtggatattggttactccttgacaaaagatggcactccttatgcagaaacacgctggatttcccaaagaagcgtataaactagagcaggttctcttaaatctttgaatgaatgcactgagttagttttggctgttactgctcttggaatgtctttttgtttgcatttttccaatttacctccttgttgacatatcaatatttaaaagaaatctcccccccagatttttgacctacaatagtataatctcaaatattggattaattggtcagagcatccatttaaacattttgatttttataatgtcctgcttattaaccagctcaatttttttttttttttttttttttttgcggtagagtcttgctctgtcgcccagaccggagtgcagtggtgcgatcttctcggctcactgcaacctccatctcccgggttcaagtgattgtcctgcctcagcctcccgagtagctgggattacaggtgctcgccaccatgcccgactaatttttttatttttagtagagatggcgtttcaccatattggccaggctggtcatgaactcctgacttcaagtgatctgccctggttggcctcccaaagtgctgggatacgggcatgagccaccatggccggctccagctcaaatttttttaaccagccttcaatgctcagccaagccattaatacctctgccttgccttttatctcctgcttgcattcttaaggtcagctagactgagtttagggccttctcagatcttccctgagcaggtgtgtggttttgggcatgtacctagccttgtgcctgtgccatgttgtattagtctttctcatgctgctcataaagacatacctgagactgggtaatttataagggaaagaggtttaatggacttacagttccacatggctgaggaggcctcacaatcatggtggaaagcaaaagggaagcaaaggcacatcttatgtggcagcagacaagggcttgtggaggggaactccctttataaaaccatcagatctcgtgagacttattcactatcatgagaacggcatgagaaagacccgcccccatgattcagttacctcctattgggtccctcccacaacacatgggaattatgggagctacaattcaagatgagatttgggtggggacacagccaaatcatatcacatattttctagattcttaagaatatgcttcagcttttcaaagcctcctttagtattttccagattttttaaagctttttgttggcttattgttacttcagctgttacataccaagtcaggagatcatgatgttaaacagttgcctctgatagttttcaacagttggccctggaaaaaaggctgggtgaattctgaatcaggtcaaatgaggacattttgtcagtggatcttcctgacaccatacaggtgacattttctaaaaatgaagatttatagaagctctgactctaaactccacccccacccccttgcccccactgactattgggctgccggttttcactgtgattatgtgttactgatgttcaaggctactatggagcttgagggggtgaggcgatgagaataggagaagttgaaatgccaaaaagcttattgttttaccaagattcagtttttcttgaatacacagccccagattttgtcagccttctctttccccttatagaaaggattttcagaggttcttactccactatttttgctgacattgctatgtgtcatcttgtcatgtattttctgtgtttatcaagccctatttggcaataattatattttacaagtagtaagtatgtagcatttctttttttttattatttttatttttgagacaggatctctcactctgtcgtccaggctggagtgcagtgttgtgatcatggctcagtgcagcctcaacttcccaggctcaggtgattctcccacttcagcctcccaagtagctgggactacaaatgcatgtcaccacgcctggataattttttgtagagatggggtttcgctgtgtttcccaggctggtcctaaacttctgggcttaagacatccaccgccttggcctcccaaagtgctaggattataggcatgatgcctgtaatcccactgcacctggccatgtgtagcatttctctttccttcctttccttttcttccttccttccttgcttttttttgtttttgtttttgttttttgtagatggaatctcactctgttacccaggctggagtgtagtggcatgatcccggctcactgcaacctctgcctcccaggctcaagcgatcctctcacctcagtctcccaagtggctgggactataggcgcacatccccacgcctggctaatttttgtatttttggtagaaatggggtttcatcatattgccaaggctggtctctaactcctggactcaagtgatctgcccaccccagcctctcaaagtgctgggatcacaggcatgagccaccatacccagcccatatgtagcatttctattgccatgtttttttgagacagtttcttgccccatcacccaggctggagggcagtggtgcagtcatggctcactgaagcctccaattcctggattaagtgattctcctgcctcagtcccccaccaagttactgagattacaagcacctgctactgtgcccagttaacttaaaaaaaaaatttgtagagatgacatcttgctatattgcccaggctggccttgaactcatggcttcaagcagtcctcttgcctcggcctctgtattagtccattttcatgctgctgataaagatatacccaagactgggcagtttacaaaagaaggaggtttatcagacttacagttccacatggctggggaggcctcacaatcctggtggaaggtaaggaggagcaagtcacatcttacgtggatggcagcaggaaaacagagcttgtgcagagaaactcccattcttaaaaccatcagatctcataagacccattaaccatcaccagagcagcatgggaaagacccacccccatgattcaatcatctcccactgggtccctcccataacatatgggaattatgggagccacaagatgagatttggttggggacacagagccaaaccatatcattctggccccgtccctctcaaatttcgtatcttcacatttcaaaaccaatcatgtcttcccaacagtcccccaaagtctcaactaatttcagcattaacgcagtagtccaaagtctcttctgagacaaggcaagtcccttctgcctatgagcctatataaatcaaaagcaagttagttacttcctagatataatgggggtacaggcattgggtacatacagccattccaaattggagaaattgaccaaaacaaaggagctcaggctccatacaagtctgaaatccagtgaggcagtcaaatcttaaagctccaaaatgatctcctttgactccgtgtctcacatccaggtcatgctgatgcaagaggtgggaaggcatgattggttcccatggtcttgggcagctctgcccctgtggctttgcagggtgcagcctccctcctggctgctttcacagactggcgttgagtgtctggctcttccaggcacacagcacagttgtcagtggatctatcattctgaggtctagaggacagtggccctcttctcacagcttcactaggcagtgccccagtaggaactctgtgtgggggctctcaccccacattttccttccacactgccctagcagaggttctccatgaggaccccacccctacagcaaacttcagcctgggcatccaggtgtttccatacatcttctgaaatctaggcataggttcccaaacctcaattcttgacttctgtgtacttgcaggctcaaaaccacgtggaagctgtcaagtcttggggcttgcattctctgaagccatggcatgaactctgtgttggcccctttcagccacagctggagtgtctgggatgcagggcaccaagtccttaggctgtacacagcacagggaccctgggctcagcccttgaaaccattttttcctcctaggcttcagggcctgtagtgggaggggctgccacaaagttctctgacatgccctggaggcattttccccattgtcttggtgattaacattttggctcctagttacttaagcaaacttctgcagctggcttgaatttctcctcagaaaatgggattttcttttctattgcattgtcaggctgcaaactttctaaacttttatgctctgtttcccttttgaaactgaatgcctttgacagaacccaagttacctcttgaatgctttgctgcttagaaatttcttctgccagatactctaaatcatctctcaagttcaaagttccacaaatctctagggcaggacaaaatgacaccagtctctttgctaaaacatagcaaaagccacctttgttccagttcccaacaagttcctcatctccatttgagaccaccttagcctggaccttgtttatatcactatcagcatttttgtcaaagccattcagcaagtctctaggaagttccaaactttcccacattttgctgtcttcttctgagccctccaaactgttccaacctctgcctgttacccagttccatatttgcttccacattttgggtatcttttcagcaacaccccattcctggtaccagattactggattagtacatttttatgctgttgataaagacatacccgagactgggcaatttacaaaattaagaggtttattggacttacagttccacatggttggggaggccttacaatcctggtggaaggtaaggaggagcaagtcacatcttacatggatggcagcgggcaaagagagagcttgtacaggggaacgcctcgttaaaactgccatatcttgtgtgacccattaactatcatgagaacagcatgggaaagacccacccccatgattcagtagtctcccactgggtccttcccataacacattggaattatgggagctgcaagatgagatttgggtggggacacagcaaatccatattagtctcccaaaatgctgggattacaggtgtgagccatcttgctggccagagcatcttttcatatgcttacttgtatatcttctttggtgaggtatctgttaagatctttggctcattttttaattgggttgtttgtatttttattgttgtgttctaagagttcttcatgtattttggataatagtcctttattaaatgtgtcttttgtaaatagtttctcgtggcctgcagctggtcttttcatccttctgatagtttctttttcagagcagaaatgtttaattttaataaagtctagcctaccagttacagatggtccttgacttataatagtttgacttacaatttttcaatttaccatggtgtgagagtaataggcattcattagaaacatatttcaaattgtgaattttgatattttcccaggctagtgatgtagtatgatattctcttgagatgccatgcagtggcagcaagctgcagctccactcaaccacacgatcgtgagggtaaacaactattgactagtactctatgttgcactgtgttgccagacgatcttgcccaactgcaggctgacataaatgttctgaacacgtttaagggaggctagggtaggctcagctatgatgttcagtagttaggtgtaataaatgcattttatatttagggtgttttcaacttatagttggtgtatacccccatcataagttgatgagcatctgtttttctttcatagatcatgcctttggtgttgtatctaaaaagacattgccaaacccagagtcatctagattttctcccatgttatcccataggaggtttatagttttgtgttttatatgtaggtaggtctgtgatacattttgagttattttttgtgatggggtgtaaggtgtgtgtctagattcttttttttttttttccatgtggttgtccagttgctacagcacgatttgttgaacagattatcttttctgcattgtgttgcctttgccccattgtcaaagatcagttgactaaggtgggtctaattctgggctttctattctgttctgtgatatatttttttattctttcaccaaccacactgtcttgctgactgtagctgtacagttggtctagaagttaggtagtgtcaatcctccaactttgtcctttaatattatgttggcttatctgggtcttttgcctccctacaaaaactttacaatcagcttgttttatatctacacaatacattgctgtgattttgatgtgattgcattgactctataggtcaaattgggaaaaacttgacatctcgacatattaagtcctcctatccatgaacaagaaatatcactttatttttagattgtctccaacttctctcagcagtagttctccatatgtacatcttgtacacattttgttagatttgtacctaggtatttttgggtgttgctaatgtgaatgatattgtatttttttttaaattaaaatttgatagtatttgaacatcaattcagaaatttgtcttgttgacaaatgtactttattcatagatttttctttcaattttttatgtgatagaatacatataaaatttgccattctgtttttaaatgtacagctcagtggtattaaattccttcataatattggcagttatcaccaccacttaccttcacaattcttttcttttatagaactgaaactctataaccatcaaacaataactccccattttcttctctctccagccctgccagccacttttctaagtccctcataagtagagtcatacattatttgtctttttgtgattggcttattccatttagtataatgctctcaaagttactccatggtgtagcatgtgtcagaatttccttcctctttaaggttgaataatatttcattgtatgtagcatatactacattttgtttatccattcatccatggatggacacttggattgcatccacattttagctattgtgaataatgctgttatgtacatgagtgtacaactatttcttcagttccctgcttttaattcttttgggtgtatagccagaattgaattgctggattcttttgggtatatatccagaattgaattgctggatctaataattctcttttaatttttttaagtaactgccatgctattttttatggtggctgcagcatgttacattccaatcagcaatgtagaagtctttttttatcgtcacatgctcatcaacacttgttatttttctttttcgttgtaaaatagtagccattctaatgtatgtgaggtggggtctcactgttttacttgcagttctctaattatcagtgatgttgagcatcttttcgtgtgcttattggccatttgtatatctttagagaaatgtctgttcacatcatctgcccatttttaaacttggttgtttgttgttgagttttagaattacctgtatgttctgtatattaatttcttatcagggctgggcacggtggctcatgcctgtaatcccagcactttgggagcccaaggtgggcggatcatgaggtcaagagatggagaccatcctggccaacatggtgaaaccccgtctctaaaaatacaaaaattagccaggcatggtggtgtgtgcctgagtctcagctactcaggagcctgaggcaggagactcacttgaacctgggaggtggaggttgcagtgagccgagatcacgccactgcactccagcctggtgacacagcaagactctgtctccaaaaaaaaaaaaaaaaaaaaaaaaaaaaattcttatcagatatgattttcagattattttgtcccattccagaagttgcctttttactctgttgatgttgtccatctatgaaattcagtctattttttttgtttcctgtgcctttgatgtcatatttaagaaatcattgctaaatccattgttgtgcagcttttgccctgtgttttcttctaaaagttttatagttttaggtcttccatttaggtctttgatctattttgagttaattttttaatatggtgttaggtgagagtccaatttccttcttttgcctgtggatatccagttttcccagtatcattcattcaaaagactgtcctttttttttttactgaaacaccagggtattctgtctaggtcctgctgctgcttggtgcacagaaagccaatcactgagacaagtgtggccaagaaacaaggctttaaatctggtgctgcagccaaggagataggagctcagtctcaaatccatctccctgactgactaaaactagggctttatatagcagggaggaaacataacaatatgtaagaaaataaaaactagagaggggtaaggaagcatctggtgctgtgatctgatgagttccagttatttgattctttttttttttttttttagtaggcctgaaggtcctttcctgagggaaggaactcagataaaacaaatatgagtttcaagctttaacagcagaagggtcaatttccatgtttatccaaaaacaactatctgtgggactcttgggttggtttcacttttttttgttggatgatcttggcactcttgtcaaaaattgagactgtatctgtgaggattgtttctgcgctctctattctgtttcgttggtctatgaatatgtcttgtctttatgcggtactatgctgaactttgtagctttgtactatagtaaatttgattactgtagctttgtagtaagtttggaaatcaggaagtgtgagtcctccagctttgctcctcttcttcaagattgttttggcaattaagtgtctcttaagattacatatgaattttaggatggctttttttttatttctgcaaaaaacaccgttggatttgtatagagatcacaatgaatctgtagatttccttgggtaggatcttaacaatactaattcttccaattcatgaatatggggtgtgtttccatttatttatgatggggtgtatttccatttatttatgatgtctttaatttcagcattgttttataatttttattgtataagtctttcacctgaagttaattcctaagtattatattctttttgatgctattgtaaataaacttatagtttctttttttagattgttcattattagtgcatagaaacgtaactggtttttatgttaactttgtatcctgctgctttgctgaattcagtttttgtagactgtagggttttgtacatgtaaaatcatatcatttgcaagcagaaatcgttttacttcttccttttcaatttggatgccttttatttattttccttgactgatttctctggctagaacttctagtactgtgttgaatagaagtggtgaaattaggcatccttgcctttttcctgatcttagagagaaagcgttccttctttcatcactgtgtatatttgctgtgggttttgttgcatatggcttttattatgttgaggcagtttccttctattcctagtttaagtgtttttatcatgaaaggggttgaattttgtcaaatgctttttctgcatcaatcgagatgattgtgtggcttcccccccgccccactttcttcagtttatatggtgtgttacattggtttttcgtccttgcattccaggaataaatctcacttggtcatgttgtataatccttttaatataagatataatctaatatgtagaaaactgtaaagatgtcacacaaaaaactgacttaataaatgaattcagcaaagtagcagaatgcaaagtcaacacagtttactgttatttcattgaggatttttgcattaatttataagtggtattagtccatggttttctcatagtgcctttgtctagctttggtgtcaggctactgctggcctcatagaatgacttaggaagtgttccatctttaattctttagaaaagtttgaaaagcagtggtactagttctttaaatgtttgatagaactcaccagtggaaccatcaggtgcagggcttttgtttgccaggagatttctgattactgattcaatctccttattggttataggtctattcagattttccatttccttgtgatttcattctgatgggttttgtgtttctaggaatttgtctgtttcatctaggttatggtattaggtttgtaatttcaaattccacttgttcattgctggtatactggaaaataatggagttttttgttttgttttgttttgtttttgacatggagtcttgctcttgttgcccaggctggagtgccatcttggctcactgtaacctccacctcctcccaggttcaagtgattttcctgcttcagcttcctgagtagctgggattccaggtgcacaccaccacacctagctaatttttaaatttttagtagagatggagtttcatcttgttggccaggctggtctcaaagtcctgacttcaggtcatccacccacctcggcctcccacagtactgggattacaggcatgagccaccgtgcccagcctagtcttatttattgactatgtatcctgcaccctatgtatcctgcagtgttgctgtgattgcgtgttagttccaacagtgtttttatttatttggattttctacgtgggcaggcatgtcatctatgaacagacagttttatttcttccttcccaatcagaataccctttatttctttttcttgtcttatttcattagctaggccttctattatgatgttgaaaaggagtggtaaggggattttcttgccttgttcctgttttcttgccttcttgccttcatggagaaacttctggtttttcatccaccattagttaaattcttagatgtagagattttgtggatgttctttatcaagttgaagtttccctctgttcctagtttactgagagtttttgtcataaatgactgttcaattttgtaaaatgttctttctgcacctattgatatgatgtgattttcttcttttgcctatggatgtgatggtttatattgattttcaaatgttgaaccaggcttgtgcacctgggataaatcctacatgatcgtggcatataattctttttatatacagtcatgtgttgctaaacgatggggataccttctgagaaatgtgtttggtgatttcattgttgtatgaatatcgtaaagtgtccttatacaaaccgtgacagcataagcctactgcacacctaggctatatggcatagcttgttgctcctaggctgcaagcctgtacagtatgtaactgtaatgaacactgtagacaactataacacaacggtaagtacttgtgtatctcaatgtatctcaatatagaaaaagtacagtaaaagtatggtataaaagatttttttaaaatggtacacctgtgcagaatacttaccataaatggagtttgtagggctggaagttgctctgggtgagtcagtagtgagtgactgtgaaggtctaggacattttgtacaccactgtagccttgaaaaacaacactaaacttaaaaaatatttttctgtcttcagtaataaattacctttagcttactgtaacctttttcactttataaatgttttgattaaaaactttttttactcttttgtaacaacacctagcttaaaacacaaattgtacagccatacaaaaacattttttctttatacccttatcctatacattttttcctttaaaaatttttattttattatttaaacatttttgttaaaaactaagacacaacatacacattagcctacgcctactcagggtcaggatcatcagtatcactgccttccacctctacatcgtgacccactggaaggtcttcaggggcaataacatgcatagagctgtcatctcttatgatagcaatgccttcttctggaatgcagttaacttttttttttttttttaaataagtagagggattacactttgctaaaataatgctaacatgtatagtatagtaaatatataaacataacatagttgattatcaagtattatgtactatatataattgtacgtggtacacttttatgctacgggcagcacagtagtttatttacaccagcatcaccacaaacatggaagtaatgttgttgcactatgacattgtgatggctacagcttcactagggattaggaatttttcggctccattataatctgtgggaccacccattgtatatgcagttcctccttgactgaaatgtcatgtggtgcattactgtatcattggattcgatttgctaatattttaagattcttacatctatgttcatgagatatattggtctgtagttttctagtaatgtctttatctggctttggtattagggtgatgctggccttatagaatgaattaggaagtattccctttgcttctgtcttctgaaagagattgtagatgattggtataatctctttcttaaatgtttggcagaattcccccagtgagcccatctgggcctggtgctttctatttgggaaggttattaattattgattcaatttattttatagaaataggcctgtttagaatttccatttttttcttatttgagttttggtggattctgtctttaaataattggttcaattcatttagtttatcaaatttctagatacggagttgttgatagtattcttttattatccttttcatcaatacagatctcatagacatgaaaaggataataaaggaatactatcactaaaaagtgattctctctttttatcttagtctaattggaggcttatcaatttaccttgtcaaagaactagcttttggttttattgattgtttgtttctccattgattttctgttttcagtgtcattgatttctcctctagtttttattctcttttcttctgcttactgtggatttaatttgctgctcttgttacctaaggtgtaagatcagatgattgattttaggtctttcttcttttctaatatattatttcagtgatacagatttctgtctctaagcatttctttccctgcatctcatgaattttgatacattgtgttttcatttctatttagtttaaatattttaaatttatcttgagattttttattcatgtgttattgttcaaccttacatatattgagatattccaattatctttctgttgtgaatttctgggttccattgtggtctgagagcagactctttatgatttcttttcttttaaatttgttaaagtatgttttatggcccagaatgttctaccttggtgaatattccatgtgaatgtgagaagaatgtgtattctgtggttgttggatgaaagagagaggtgaattctatccagttgattaataaatagtgttttgagttcaagtgcgtcctttttaaccttctgtctgctggatctttctacttctgatagagcagtattgaagtctacagctacaaaagtagattcgtctatttcttcttgccgtactgttagtttttacctcatgtattttgatgcactgttgttaagtacatacgcattaagaactgtgtcttactggagaattgagccctttattattatgtaatgcccttctttatctaataacattatttgctttgaagtctgttctatctgaaattaattcagatacttctacttacttttcattagtgttagcatggcgtatttttttccatctacgtttaatgaataaatgtctttatttaaattgattttcttttagataccatataattgggttttatttcttgttccattataataatctgccttttaattggtacattcagatcactgattattgatataattggattaatatctgccatatttgtaactattttccatttgtcacctttgttcttttttgctatatttgtcttctagtcctttttcttgccttttgtggtttaccagcatttaaaaaattattattattattattttattttattttattttttttttttttgagacagagtcttgctctatcacccaggctggagtgcagtggtgcatcttggctcactgaaagctctgccttctgggttcacgccattctgcctcagcctcccgagtagctgggactacaggcacccaccaccattcttggctgattttttgtattttttttagtagagacgggggtttcactgtgttagccaggatggtctcgatctcctaacctcgttatccacccgcctcggcctcccaaagtgctgggattacaggcatgagccacagcgcctggcctgtatattttttaaggtagggtctcactctgttgtccaggctggagtgcaatcgtgcgatctcagctcactgcagcctcaacctcccgggtttaagccatcctcccaccatagtctcccaagtagctgggactacaggcatatgtcaccatacctggctatttttttttttttttatattttgtagagacctggtctacaaaatgttgcccaggctggccttgaactcctggactcaagtgatcctcctatctcagctcccccaaagtgctggggttacaggtgtgagccactgtccccaaccaacatatttcaatatggcttcttttatctccctttgctggaagcaaaagagatttttctcgagtatttactgagagaacctggtttagctcctgtaagtaaaactcacaaaagcatgggggcctccctataactaggtccccctggagtttttatcactggggcttgtccacacctagcaatttttgtcagctacagtttgtttttctgcccctctcccagtttctgtggaggtttctgctccagcctgttgtgattctctgtatccacctgactgtctctccagttctgggagcagtggtgtcttagcctgttttcacactactatcaagaactacctgaaactgggtaatttataaagaaaagaggtttaattgactcacagttccacattgctggggaggcctcaggaaacttacaattatggtggaaggggaagcaaggcacttcttacatggcggcaggagaaagagagcaaagggggaagtgccacttttaaatcatcagatctcatgagaactcgctatcgcaagaacagcatgggaaactgcccctcccccccgatccagtcaccgcccaccaggtccctcccctgacatgggattacaattttagatgagatttagtggggacacagagccaaagcatatcaagtggtttctcctgtgacctcactgaagtttttgagaaatacatgcacgtgtattttttaagtcatcaagagcaagtaagtataatgctaaacaagaagttaataaaaacttcatgtttcctcccctctttgaaaatacattagcaattgtttttagatagagtgtacatttcctggagtcattgtttaagaataatagacaaacaagctgggcatggtggctaacacctgtaatcccagcactttgggaggccgaggtgggtggatcgcttgaggccaggagttctgagacgagcctgggcaacatggcaaaaccccatctctactaacaatacaaaaattagccaggaatggtggtgtgcgcctgtaatcccagctactggggtggctaaggcaggagaattgcttgaacccaggaggcagaggctgcagtgagccaagatcacgtcactgtactccagcctgggcaacagagtgagactcttgtctcaaaacaaacaaaaaaaaacacactacaaacccattttgcttctcatgaattgaaaatcattatatggtgttgtcaggagatcttagactctgtgaaaggcattttccagagagttgccgaaaattagaagggtgtgggggcgctgaaatgcctaggcagagaagataggtttgatatagtaaagagtaaggagtcaccaaagtgtcttagcaaggcaatactctaaaaatcatgttttaagaagagattctaccatctttgtccaaggtgtgtgtgttcatagagaaaacctagcctcccaaaacaagcaaggaaaatcatggattatgaaaggatctttctactaaaagagtcattattacttctctattttgcaaactctctcagtaccttcagaatatttacagccttccaaaatgtaatgtatacccttctcaggactatgcataatgcagttcacttaagaattgtgctatgttttacatagactgacaggttcttgttcaaattctttgtgataacatcttttcattttcttttcttttttgggtagttttaaatacattttcctttttaagaaggctaggatgtttggggggaaaaatccttgtactttttgtaagccacttataacacagattaacttcacagcacataaaaagaatactggagaacccttacatgattaaatatgcccctagaggattaagtttttccacatatttttaagccagtgctattaataatgttccagcattaaactttctgtacatcctcattatggaggaggcctttttttgtttttttcattctgcccttgctgttagtttttccgtggtcagatatgtagcactataaaattatctgtggaaacatacaatctgaatgtttaactggagtctaacaaagtatcatgtctggggctcttccaatttttattcaaagatgttgtcaatttttcaaacttaattgttcttttgtcttactggaaacctggcagaagatggctatttacaggcatatcttagattatggggcagaccaccacaatgcagctaatattgcagtaaatcaagtctcacaattcctttggtttctcagtgcatataaaagttacatttttactatactgtagtctattaagtgtgcaatagcattatgtctaaaaatacatgcataccttaagtaatacaaaatactttttttttttttttttttttgagacagagtctcacttgttgcccaggctggagtgcaatggcgcgatctcggctcactgcaagctctgcttcctgggttcatgccattctcctgcctcagcctcctgagtagctgggactacaggtgtatgccaccttgtccggctaattttttgtatttttagtagagatggggtttcaccgtgttagccaggatggtctcaatctcctgacctcgtgatccgcctgcctcagcctcccaaagtgctgggattacaggcgtgagccaccacgcctggccacaaaatactttttttttgctaaaaaatgctaacaatattgagctttcagcaagttgtaatctttttgctggtggaggttcttgcattgatattgatggtggccacctgatcagggtggtagttgccaaaggttggggtggctgtggcattttcttagaaaaagacaagtttgttgcagcagttggcttttcctttcagaagatattcctctgtagcatgcagtgctgtttgatagcattttacccacagcagaacgtctttaaaaattggagttgtcctctcaaatgctgctgccactttatcaacatgatgttctaaatctttagttgtcatttcaacaatgttcacagcatcttcatcaggaatagattccatctagaaaccactctctttgcttacctgtaagaagcaactcctcatctgttcaagtttgatcctgagattgcagcaattcagtcacatcttcaggctccacttttagttcccttgattttttcaccacacctacagtgacttcctcttgaacccctcaaagtcatccatgagggttggaatcaacttctttcaaactccttttgatgttgatattttgacctccttccatgaatcacgaatactcgtatctagaatggtgaatcctttccagaaggtttttaatttgctttgatcagatccatcagagaaatcaccctgtatggcagctattgccttattaaatgtattttttaaataataagacttggaagtcaaaattactccttggcacaagggctgcagaaatggatattgtcttagcatgcatgaaaacaacatttatctctttgtacatctccatcagacctcctgggtgaccaggtgcattgtcagtgagcagtaatattttgaaaggaacctttttttctgagcagtaggtctcaacagtgggcttaagatattcagtaaactgtgccgtaaacagatgtgctgttacccagattttgttgtttcggttatagagcacaggcagagaagatttagcataatttttaagggccctaggatttttagaatggtcagtaagcattggcttcaacttaaaagtcaccagctgttttggtcttgaccaagggagtcagcctattttttgaagctttaaagccaggcattgacttctcctctgtagctacgaaagtcctaggtggcatcttcttccactagaagacggtttcatctatgttaaaaatctgttgtttagccacatttctcaattttctgagctagatctcataataacatgttgcagcttctacatcagtacttgctgcttcgcctctcacttttatgttatggagacagcttctttccttaaacctcattagccaacctctgctagcttccagctgtgcctctgtagcctccttacctctctcagccttcatagaagtaaagggacttttagctttgctctggattgggctttgccttaaggggatattgtggctggtttgatcttccagatcactaaaactttctctgtagctcttttactttatttttgtgtgttcattggagtagcacttataatttccttctagaactttcccttggcattaacaacttggctgtttggtgcaagaggtttagcttttttttagcatgtctcagcttttgacatgccttcctcactatgcttaatcatttctagctttttttttttttttttttttttttttttggagacagagtctcactccgttgcccaggctggagtgcagtgtggcgcaatctcagctcactgcaacgtccgcctcctgggtttaagtgattctcttgcctcagcttcccaggtagctgggattacaggcgtgcgccactatgcccagctaatgtttgtatttttaatagagacggggtttcaccatgttggccaggctggtcttgaacttctgacctcaagtgatccacccaccttggcctctcaaagtgctgggattacaaataggcatgagccaccgggcttggcctatttctagctctcgatttaaagtgagaaatgtgtgactcttcctttcacttggacactttgaggccgttgtaattggcctacattcagtattgttttgttgcaggaaataggcccaaagagagggagagagatggaggaatggccagttggtgaatcggtcagaacacatactacatttatctattaaggtcgccatcttatataggtacagtttgtggtgccccaaaacaattacaatagtaacatcaaagaccactgatcacagatcaccacaacagatataataataatgaaaaagtttgaaatattgtgagaattaccaaaatgtgacagagacacgaagtgagcacatggtgttggaaaaatggtattgattcctttgctcaatgcggggttgccacaactttcaatttttttttcttttgtaatcactaaacacatagtactcaacatttcaaaaaagatcacttaatttcagtggacattttttcctgacgtaacattctggtttataaggaatcttgttattactgaggaattgagttatttattaaatgccttttttttttccagggggttaggctgtcaaattaatttcccatggctaatcagcctgggcttgactctacgcacgtaatggtcctacactcccccagctctctaggacttgcagtctctctgatcctaacagcctgcaggtcttttcttaccagccaggactctttcccagtcccttcagtggtgctcaccagcccctcagtttctctgaccttaaccttttgatccttattctgccagtcccttggcttagatgggttcttaatttcttttctccccaaatttgtatttttctgtcctgaccagaggcgtcagattgttccacactgtttaaatgtgccagtcaacctctcttctccgactctctgcacagctgggcctcagggtcaccactcttctcaagccccatagtctaacccttctcgggtcacagaggacttcctgccagctatctagaccctagagctcccctgcctcccgtcgcctggtcctttcgcttttcactgctgcagctttgctcaaccttccctcctcattcctgcccctgggggagagctgcccctcctttccagtgccaacctcttcatcagtgctttagagttctgcctcagcactaaacaaaaacaaaaaccaactaaagattttagtatttttatattaatatttaaaattgtctaattttaataaatgttaaataacatttggttttaagaaatattaaatattcaatgttaaataatattgtttattaacattaaataaaggtgggaggatcacctgaacccaggaggttgaggctgcagtaagctgtaattgtgccattgcactccagcctaggtgacagagcgagactgtcaccaacaacaacaaaaaaaacactgattgcagcaacaaaagttagaaagcactaccctttaacagagagctgattaaattatggtgtatttattatcggtggcaattaaataattttaattttaataaatattaatttttaatattaaatatttaaaaatcttattttaataaatattgaataattattaagtaacacatgcacatggatttaaaagttaaagtagtataaaataatctacagaggctactatttgatgtcagtttgtgtgtatttgcattctgccagagatattcttccatagatgatacatgcataaacaagtatgtacatccatgcatttcttcttcttcctgtctcctccttccactctttttgaacacaaatactatctatacacagtctagatattgctttttaaatatattgctatgttttggaaaacaatttgtgtcagtactatagacctgcctcattcttttaatggatgcaaaatatcccttttttttgtttttgaagactctgtcacccaggttggagtgcagtggtgtgatcataactagttgcagcctcaacctcctgagttcaggtgatcctcccactttagcttcccaagtagctggaattacaggtgcactccaccatgcctggctaatttttaagtttttttgtggagacaaggtctcactatgttgcccaggttggtcctgaactcctaagctcaagcagtcctcctgccttggccacccaaaatgctaggattacaggcatgagccatcgtgcctggcccaaacagtgtttcagtaagcatccttacaacataagtctttgtgcccatgtacagctttatcattatgaagtcttaaaagtggaattgctagattaaagggtgcctgcattttcatcttctgaaaagaaaaaaaatctatttcttgtataattactgttctggtctgtttatgcattgttgatttcttagatatgtcttcaatgtctgctatctttttaaagcattcatctctttatttcttgtgagttcccagagaatttctgaggcattctggttcagcgttctacgtttcacagtccctgtgatcactgaattcctaaatgtgatactcattgtttctaagaactctttactgttctcctagtctcctctcaagtgtataggccttttatttcttaactttctatgtaaggataacatatatccaaaaaaaacacataagtcttctgttcaacttaatgaattctcaagaagtacaccttatgtaaccaatgcttagataaataaattattgccagcaccttggaatgtcccttgtgccccttacagtctctctgtgggtagccactatcttttctcctaacaccacagattcatgttgcctatttcattttaattttatataaatgtaattgtacagtacatactgcttctttcttttgtgtaacattatgtttgaaggtagtttgttctcactgatatatagtattccattgcatgactataccacaatccatttgttcattctactgttgatggtcacctcaatggtttctagttttgggctatcatgaatagcgctgctgtggacacttttgtttgtgtcttctggtgcacatatgtacacatttttgttgggtgtatatacacatagagtagaattgctgcatcatagggcatagagtcctggttgttccacatccttgccagcacttggtattttctttgtcattttagtctttttgataggtgcaaagtagtgtttcattgtggtttcagttttcatatcaactactcatgccatggagcccattttcatgtttattggctctttggatatcctcttttgtgaagtacctattgaaatttatttttccattttaaaattatttttaaaaatatatttggctagctcgtatgtcacacttttttgacaaaatcctttttctcctcccttctcatttatccttttaaatttattttcttggcttttctctcacctgttcttttctaaccactgaactttagagccactaactactcctaacttttctagaatttttagtgaatttgcatgaaacttactttgagaaaacattggtactcaaactggaagataatgttattgttattctaagaagggaaaagatgataaatactaagccgtactagttttttggccactagattgcattattatccccatgtttaattctcattttaattttatttttgacaagagcttgttagaagtgaaagtcttttaatttgcattttaagtctggagactcctttttaaaaaatgtaaatgttttacaggttcttgatcaatatgaacgagaaggatttaacttcctagccaaggtgtttaattcttcacattccttcttagaagacttgactggtcttacattgctgcatcaagaaacccaagctgctgaggtaagaacaaaacaagctttctgtagtgaagactgacatgcttaaaactatttgatattcgccatatggaaaaggaagaaagcaattaattttaatttttgtaacttagagcaaatatcactaaataagtctgctagttaccagagaacgaataaccctcagcaagtgctggatactgatgtgtgtaggttgctgtccagtaggtgcctaatacacaaaatcagtgtgataaaggaagtataggttgtagatttccaggcacctcttgtccttactgaagatctgcatgtgtatgaccattggagagagttggctttaatgtccatatatcaaaatgtaagttggtaaagacattggactccagctatgttctttagaaagaaggtattggactctggccatgttcttcagaaagaacatgcctggctttttcacgatttgatcagtcttcttagaccctgaaccccaccatgaaatggcttccccagacacaacccgagagagttatgctttgtttctcagctaaaatattttgcagatcttaatttcctgggtcattgcatcattttttttttttttttaaagactgagtttaagaaataaattatcggccgggcgaggtggctcatgcctataatccaagcactttgagaggccaaggtgggtgggtcacaaggtcaggagtttgagaccagcctggccaacatagtgaaaccgtgtcttcactaaaataaaaaaattaggtgggcatggtggcaggcacgtgtaatcccagccactcgggaggctgaggcaggagaattgcttgaatcctggaggcagaggttgcaatgagccgagattgtgccactgcactccagtccgggcgacggtgcgagactccgtctcaaaaaaaaaaaaaaaaattattgtgtttttccaaatgctcgctgttcttagaaaagggaatgctgtgtatggtggtagagctatttggatcacttggcaaaatgtgcaattcctcagaattgatgagtgagattaaatcaatcttttccccttagttacctggataaagaagccatgaggagaaatgtagcttatgttgtgtttccacaaactatataaggaaaaccttgacttcctgtgtcctgcaggggtagtgcacttgccattagtccttttaagttgcaattcttcccaccagctaaagagaaatatataaattatttctagctaggtggcaaaactcccccagccatcttgtcaaatgattgcatgggtgcaaagatctataaattcctccataggttgcatatcctcaccattcagggaggccccaagttgtcaatgaatagatggccaggcccaatactggaccagccagtggtgaaagggctgctgtttggagaggtggagctagtgctgagtataggaagaccatgtagaaataccaaagtcagacccattggaggtttgagcagattgtgagatttttcaggtacaccagggaggcaagatagtacatctctagtgctggacttaaactgaaggcagtccttctttaaattgttttggtgccctctgggcattaaacagatgcagtcttccacttatggccaatagttagagccacaaagagtctatttcaagtttcaggagatgaatggcatctctgctgctctttgagagactttaaggtatttttcccctgaattgtgattgggttcccaggcagggttcagaacattgtgtttattgtctgccgtattatcttttaagcaatgctgtactgcctgatggtatggaagaggtaacatagatgtttgtaaacatacagtcatttgatggctaaggaagttttgccacccagctagaagtaacttatgtattgttagctagaagaatttcaacctgaaattgacccaatttttcactctttaaaacagagcagttgctagaatagtgggtaggtttctagatttaacctggtttatcttacattttagttggtcaaaccttaatggctttttcaaagacttagagaaagtttaaaagcaatagtgactaaatagatggtggagcagaagggagcatggtttcatccacgagcctgagttttctttttgaattttcctctactaaattatatctttagttttggaatcatacgtcacatcaaattttagattagagatggtaaactgtttggcctgtgagccagatacggcttgcaggtatgtattttttggcctgcccagtttgttaaattctgaataaagccatcatttaaaaaccacaagttttaggcggggcgtggtggctcacagctgtaatcctagcactttgggaggccgaggggggcagatcacctgaggtcaggagtttgagaccagcctggccaacatggtgaaaccccgtctctactaaaaatgcaaaaattagtcgggcatggtggcacatgcctgtaatcccagttactcgggaggctgaggcaggagagtgacttgaacccgggaagcaaaggttgcagtgaaccaagatggcgccactgcactccagcctgggcgacagagcgagactccatctcaaaaaaaaaatcacaagagggtctgaattttcccatttccaactttgaaaaatcagatctgggaactccagacatgcatctcttaatagtgatggttagctagagccaagaagcaaagtttatagataatgcacttgatataaaatttaaaggtattacgaaatactctgggctgggcatggtggctcatgcctctaatcctagcactttgggaggccaaggctggtggagtgcctgagctcaggagtttgagaccagcctgggcaacacggcgaaacctcatctctactaaaaatacaaaatctagcccggtgtggcaatgtgcgcctgtagtcccagctactctgggatgaggcaggaaaattgcttgaaccagggaggcagaggttgcagtgagctgaaatcgcgcgactgaattccagcctgggcgacagagcgagactctgtctcaggaaaaaaaaaaaaaaaaaaaattctgtgaaaaggatatcttccttctatacaggtcccttagctcctcagttcctttcctggagacaaacactgttgttactttcctgcccagagatattctttaggttatattctttatttagatgatgccctttagtaggtgacccttaataggtatttgagcttataacccgtcttcaaaaaggatcattatttttcttaactctgaataggactgtgttttaagataaggtttgaaatatagtacttagtagaggacctcctagcaacaaaaattactgttctaactacatcattttctattactttgaaaaatgtgtgtatgcgcatataagcaaaatatataaatatatgttaaaatatatatatacctttacgtatatctgtgtaaaagtagtgttttgatttacatacttgattctcaatgcgtttacaggtggtcagtaataaaaacacagaattctgcattctacgtagaaaggtctccacttatttattttagcaacacaatcaagatgctaaattaattctcattttgggttaactatttacatcaatcaacattggaattgcaaacgattcaactagataattatatgtgacattaccattatatactttgtttataaaatacgtgtttaaaaaatatactgaacatcttttgaaaatctgataccaagcactgtgctagtaactgaatacagaagttaatgagacactgaccctcaagggctcatagtctagtgtgagaagctgacatggaaatagtgagctctaatgcaataaaaaatgttttagtcatttgtatattaagtgctgagagagcagttacttctgcctaggggaataggatgtcaagaaaagcttcacaggaagagaacaaatatttcacttagttttaaaggatgagtagactatttttaaaaataaaagttggattttggcagagaaagagtagagaagggaagggcaagaagcctagggcgttctagactgaataaaggtctccgaggccaagtctttagtatattactcaaaatcatgagtagtgtgatgtacttggagccacagttacctgaagtcaacataatgttttttaataatagctttattgagttataattcacataccataaaacacaccattttggctgggcgcagtggctcacgcctgtaatcccagcacttttgggaggccgaggtgggtggatcacttgaggtcaggagtttgagaccagcctagccaacatggcgaaaccttgtctctactaaaaatacaaaattagctgggtgtggtggcatgtgcctgtaatcccagctactcgggaggctgaggcaggagaatcacttgaacccgggaggtggaggctgcagtgagctgagattgtgctgttgcactccagcctgcaagggcggggggaaaaaaacaaccacacacaacacacacacacctttttaaagtgtgcagttcagtggtttttagtatattcacagagttgtgcaaccattaccactctctgtttagaaaattttcatcccccacacccaaaacaaactctgaacctattaaaaggtcactccctgttccctcctccttccagcccctggcaaccactaatcttctttctgtctgtaaggatttttctattctggacacatcacataaatgatcctttgtgtctggcatcttctatttagcacaatgtttttaaggtttattcatgttgtagcaaggtacgcaattgtttttcatttaaagaaaaagtctcaatgctattacaattttccatattctttgcacctgtggtctgtctccctaaatatagcccctttatgaaggaggaatgcaaagctgatccaactagagactacaaattcctttatatttatatagaaaggggcacatagtaatgaattggaagccatatccaagctagaatcatctagatttagtgagattgactagtgcaacccaattttttgcactcatcccctgtccatcaggtacctggaaatgattgcaatgattttgaactaggttactggtataatcatactgctgttgagattagcaggcaaattaccaagttagttttttattggagggggagaggtcaatgtgtgagggtgcatagtggagactggggaccaggctgacaaagatgaattgttttaggtagtgatgactttgaggtaatgggataagtgagtgaaaatgactggttggcgttggagatgggatggagatggagcttggagaaaaagaatagcactagtaaatggatttagctagacaaaggagatttaccctattccatttagcacagtgaggagaggctagacagctaggatgcaataaaaaaaattttaatgagaaatgtgtgtggtagattaattttattaatctcaagttatagattaaaaaatttaagtaccacataaatgccatttgcctttgctaatgttacatttttatgaagaaggagccttgcataagaatgatataatggacttttgggacttgagggagaagcttgggagggggggtaaaggataaaagacatattgggtgctgtgtgtacactgcttgggtgacaagtggactaaaatctcagaaatcaccactaaagaacttatctacataaccaaaaatcacctgtaccccagaaactattgaaataaaaaaaaagaaggggacttggacagatagccgtattctttgccaaattatagttacattctgctcatgggggattaggaggttcaatggaagaaaggccccactcagctttcttccctcttaaaatgttgccttgtaaattagggaattttgcataaagctctgacctttacttccaaggcctttactgagaatgggtttggatacttggagatagatcctgactccctatccctcctagatctttatttatcctatttggaacccagggaaatggccttaaagctgatgaaccacagggtgtccaagtcatggagctattgaggttctccccaagtatcttttaaattgctgcatttgggatgggtacagtggcttacacctgaaatcccagcactttgggaggctaagttgggaggattgcttgggtctgggagtttaaggccagcctgggctagatggtgagcctctgtctctatttaagaaaattagaaattagccaggcatggtgacacaccagctacttataatgctgaggcaggaggatcacttgagcccaggagtttgcggcagacagtgagctatgattgtgccactgtactccagcctgggtgacagagcaagaccctgtctcttatttaaaaaaaaaaaaaaaaaaaaaaaaaagctgcgtttgttgaagaaatgctcagtctaaatcaaacatatgaacaccttagccatgttccacaaaaatttgctgtgacttaccttcttagagttatttctcatcctatgagtagaataagtatcagttcacatgtatttatttgttccaactgtgggttcaacatcatactatgagaaatgccaaaatattttctaactgaatgtaactagagataagactaatttataagagagttaatagaacaagctatattggtatatccctgagaaattcaaattcctaagtccctttacccaatttccctgaaatacttcattcctattcatgaaagtttgcacgttccatgattccaggattaattttaggctgttttacttccttgccttgaccatattgtcagtatttgatgttgtaccatgcagttatgatttcagggttgcaattacagtgcaccattaatataatttgcattttgtcaaggttgtgctaaatagaacttcctttctgcagatttggggattaatgaatgatcatctaaaaagaaagcaacaaccataacataggctataaaatcataaacagaccagcagaaatgaacagggctgagctgattaattggttatgaattaaaatgtagattgtgattcattcactatagaactcagaattctagaaaatgcccatttctctcatagccaaaaagtcatatgaaaaacattacggtcatgtgatatgacttcattggcacagcaatttactattcagcaaagtaaataacacaattaacaagtgtttctgctgggccttttgcacttacactgagattttggcctctcccccacacagctggttttgatttggttcctgtggaatatttttgttttgttttgttttgcatttaacaacagtcagatatttatgtacagcttcatcaagagcctctgatgacaaatatgcctttggaggccagcagaagctgtgggaaacccccgtgtcagcactcagacctgtttccaatggagagaaatcgctctggggactgaactagcctgctcatgaatccagttcccttttcccagagccttctgctagctcacttccaacccatgctggccatcctgggactgtgccctgccttgatttttccttatgaagcaatccctcaagacacagccttggccctctctcctgagtgagggaggaaaggcagaaacaggcagaaagccatttacttcttagattggaaactagagcctggtttttgaaataaagcttggcagtatctcacttataacttactttataaaatgtgtaccttttatttgctgtcagagttatctacatgaatttgagatgtttggataaatcgttattggggaaagttgcaattggaaaatagacaatgaagtctgggcagagttccccacccttcggaaaagagtctcggatggtataatccgcttggagaagtctaagcgagaaagaaggggggaaatcataaatgctgaaagcaaagcaaagacagctaatattaggaaacagaacatgggaatccagtccttcttacattgtactcctggttccgccagtgttctcatgagtgaccttggatgaatccttcagtgtcctgtgcatgcttccccacttaaaatgagaggattgaatcatgtgaaattctttttttaagcctcctttctagaaaaaaatgaaatgcttttcaactctaatttagtgattttgattcaaatataccatgtataaccaaaaaggaaaaagatggataatttttacataaaagtgtttaaaaatatatcaaagtacttactttttatacattttataaatattctttggtatctattatatctagctaccattgccagaaacaactttttgcagattttgagatttacatctactttgagccttaatagaacattgcttatactttgtattgatgtgtgtcactgtacgtataaatctaaaatggtgtaattcagcctaataacttacctccttcaccagactcggtgccacttttgacttctttataaactcaaatccaccctggccataactgggtatgttcatgaaacatgctactcactacccctcagtacagcttccgaagatgagttccaaagccctcttactttaatagcagcatccttagaatgctgaatgtgtaataacaggagagttactttaataatcagccatattacattagaatactcataaagtgtatgagtaacccgaatcctggcctggtcagaaggtctgagttcatacctcagctcccacacatagccaagactgccatgttcctctgtgtgggccgtgtcaggcaggaccgtgtgcagcagtcatgtgagaccttgggttatttacttcattgaccttcgtttccatcattttgtaggatgtgattaataattcctactcctcacaattaccatattaagtaagaaggcaccttacaaaagaaaaatactggactccatcaaaattttaaattttgtgcttcaaaggacataagaatacgaaaaagtgggccacagtataagagagaacagcattttgcaaatcatacctgataagggtgtggtatctagaatatagagggaactctaagctgggtgtggtggcatgtgcctacagtcccagctgcttgggaggctggggtgagtgtatcgtttgagcccaggagctggagaccagcctgggcagcacagtgagaacccatctctaaaaacaacaacaaaacccagaatatatagggaactcttacaacttaataatataaagatacagaactcaattaaaaatgggcattagatttaaaacaacatttctccaaagaagatatacagataatcacatgatagcataatcaaataagatgcccaacatcaatagccattgggacaatacaaattgaaactactgtgagatggcattcatacccagtaagatggctataatcaaaatgacaacatccaatgtttatgaagatgtagggaaattagaagcctcctacctactagtgggagtgtcaaattctgcagccactttggaaaactgtttaacagttccttgaaaaattaaacatagaattaccatgtgacccagggattgtacccctagatatatacccaaggctactctggacaccctgcctatagggtagccctgttccacaaggaacagtaccaaaaattgtatatgtgtgtgtgtgtataaatatagcccagagaaatgaaaatgtgcacacaaaaaatgtacacagtgttcctaacactattatttattcataattgtcaaaaagtggaaacaatgcagatgttcattagctgatgaatggatggataaaatgtcagctattacgctggaataatggagtattcagcaataataaggaagtactaatacatgttatagtatggatgaacattgaaaatgttacactaattgaagaagccagtcacaaaaggacacatattgtaggatctcatttatgtgaaatgtccagagttttaaagtccatatagtcaagaaagtagattaatggttgtcagcaggtggggatgggggattaagggaaaatcagtggctacttaaaatgtttcctttcgaggtgatgaaatgttctaatcttagatagtgatgatggttgcacaacggtgattatactaaaaccattgaattctatactctgaatggatgaatcatatggtgtgtgaattatcaatacagatgtttaaaaagcaagacaaaaagtgcccatagttggggcattttgtttctccttccctctctcctttctctggttctctctgcatgcaatgttgattttctctctgtgacaggctgtcgtaggatgttagctcattgtttttaggaatgcgttttctgtagattatgacaaggatctcttccatttttattgtgcctcagttttcaaagccttagtctctgtgcacctcctttagccttttcttatgctatggatagcctgtaaacactgagggaagagatggaggggcctaccaaccaaatgcctcccctctgtgcttgctgtggggagagaaagccacagttggctccatccatagaagacatcgcagataaaggggttaggggaagatgagagcacgttgctatctgtttgtgtaagtttaagcaggtgtttagaggatctaaatcccaacctggatctgaatttttaaaatttccctgtttaccacaggatttttcccccaagattttttagcttgaaaattcccaaatataccagaaagttgaatgaaaagtacagtgaatacccacatactcctacctggatccaacaattaacattttgccacatgtggtttatctctctgtgtacgtgcatgcactcccccgacgtcttatcacagttcgcatatatacttgctcgttttctcttttaaaccatttgaaagcaagttttatatacagcggcacctcacccctaaattttagcatgaatctgctaagaatatagacattctctgatgtaaacagagtaccatcatcacagaacaacaaagaataattccataataccacctaaaatccagtacatgtccgaattttcccagaaatgtacaggattttaaactattgtttgctttttcctcaagctggtaatattatacttagagttttttccaataatacttaagcactggtcatacataccaagtgatatccacttaagcatatctttttaattcccttgacaccctcacgctcctctctaaatggggagacacaattaccctattaggcaacatgcccctgaggtcctgctgctccagcaggcctcttctaggtgagcgtcttctctgggtgtcaccagggcatcctggtctgattgaagcagccctgagagccaaccagccctgagcagtggttcccacccatcctccatccagggtccccaatggtggaggcttttaaggaggtaggaatgggactatgaaggctattttcaatattttgaaaagtcaaacaggagtaaaacatttaggacttgaaaagattacattgaccaactgaactatcaagattttagccaggcgtggtggcttgtacctgtagtcctagctacttgggaggctgaggtgggaggatcgcttgaacccgggaggtggaggttgcagtgagccaagattgtaccactgtactccagcctgggagacagagggagaccttgtcttaactaaaacaaaacaaaaataaagattttttttctttttaacctaaattctgttgtctcagaatggaatggcatactgttatctgacctggccagaagctctgattggtagttatgaatccctttgaattattaaaaaaattaggcaaattagtgcatttgctgggtaggagaggtttttcaagatctaatatgtgagagagaaagtgaaaactaaaggaattcttggagatcaggaagtggagaatctctggcctgtggcgctgctgagcctaacttcctggcttcacatcagcagtggaggcttccctgggaggtgttcttgcagtttgccctgtgaccgctattctaggggctgtatttttacagctgacccttctcacttgcaaacataacagctgctatgtgttgaatttggggagtttccatattttgagactgtaaaattaaattgatttttagttctgagctcttagtcttattttctttttcttttctttctttctttttttttttttttttgagacagagtctcaccctgttgcacaggctggaatgcagtggcgtgatcttggctcactgcaacctccgtctcccaggttcaagcgattctcctgcctcagcctcccgagtagcagggactacaggcgcccaccaccacgcccggctattttttgtagttttagtagggatggggtttcgccatgttggccaggctggtctcgaactccttacctcaaatgatctgcccgtctcagcctcagaaagtgctgggattacaggtgtgagccactgcaccgggcctgagctcttagtcttgatccatcttgcttctcagctgtaggggagcagggagggaagggaatgtgaaatatcctaaggtgtgtgttttttaaaattaaatattgttgatcttttatcatggcttctatcagtcaacagatatttattgaccctttgctgagttcatggtgtgggagtcaaagaggtacaagccaggcttttaggaggcagacgcagtatagttggggagataggacaggaaagtcactaggactgcaaggcagtgggtgtgcacgtggtgcagtaagttctgcagggtttcaggaacatcaggagcaagagagagctccagggaagagttaggttttgaggtgcgtcttgaaggttggagctccaagtgcaggagagaaaaagctttccagaagggcctgtggcatgaccacatccaagtctctgatgaagagtaccaagagaggtatagcaactaatgttaattgcgttatctgtgattttcagggcgcttttgtacctgcccttttgatgcccataacaatcttaggaggtgactattatcccattttatggatgaagttgtcaagactgtagctatgctcaggatttatctacatcttgaggtttacagtacacttcataaggctggaatcagagaggaagaagtgcatagggtgatgcagaggcattctgctttatagaacatatctctactttcatattgagcagtttccaaaagcggttttgctttttgtctgtgtccttacaactacttctcagatagcatagtttctttcactgtaccatcctggggccttactgtactttcttactcttaaactggcttctaataaaatccgtgggaatgagattttacttgtagatgaacttgcgactccaatcccaacttaccattgggaaaagagcaggtaagagataagtcctttctttctggcctttactctttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctttactcttaatttccctttacaatttagggaagagttggtccccatttgcttttttttttttttttttttttttttgagacggactttcgctcttgtcgcccaggctggagtgcaatggtgcaatcttggctcactgcaacctttgcctcccgggtttaagctattctcctgcctcagcctcccaagcagctgggattacaggcatctgctaccatgcctggctagtttttgtatttttagtagagatggggttttgccatgctggttaggctggtctcaaactcctgacctcaggtgatccacctgcctcggcctcccaaagtgctgagatataggcatgagccactgtgcctggcccccatttgcttttattcagctatctggtgaaaaaaattcagtattaaactagaaatatttatatcttattgttgcaggacaaagttgttgagtttctaataacaaatatgtaaactgctgtgggatatttttgttttgttataatttgctgctagctttcaagcatctgtgtttatcctaccttaatcctctttgaaagaggccatacttaattttacccaatgctttattaaaaggaaagaaagttggatttttaaattttttatttattaattttttgagatggagtctcactctgttgcccaggctggagcgcagtgacatgatctcagcttactgaaacctctgcctccaggtctaagaaattctctacctcaacctcccgaatagctgggattacaggtgcatgccaccacacccagttaatttttttgtatttttagtagagacaaggtttcagcatcttggccaggctggtcttgcactcgtgacctcatgatccacccacctcggcctccgaaagtgctgggattacaggcgtgagtcaccgcaaccagcctgcattatgttttaaagcaccagtttggaaccaatcttttagaggtaactgttacaagtttctgtacccaaatattggtttatctgtactctgtttcttccttcccctttctcctttttttttttttaattttttttttttttgagacagagtcttgctctgttgcccaggctggagtgcaatggcgtgatctcagctcactgcaacctctgcctcccgggttcaagcaattctcctgcctcagcctcccaagaatctgggactacaggcgcctgccaccacacctggctaattttcatatttttagtagacacaggtttcaccatgttggccaagctggtcttgaactcttgacctcaggtgatccacccaccttggcctcccaaagtgctgggattacaggcgtgagccaccgcgcctggcccaatttttgtatttttttataaagatgaggtttcactatgttgcccaggctggtcttgaactcctggcctcaagccattcacctgcttcgacttcacaaagttctgagattacaggtgtgggccatcacacccagactcttctctttctttcaacggtaacctgtggaaatacaatgttatcatccagtaccatgatcgctaggctgaagtaatagtaagccaagctctcttcagcccttagcagtgtgggcccagaaacagggtggtcttatggaagggagcataggatgtgggtcctgaagagaaggtgttcactcctggccccatcgctagttgcatcacttcatcttgcctggatttcatctgtaaaatgggataatgcctactccacaaagttgatgtgctttgaaatctttaatacaaacatttgttattggaaactaaatacaaacgaaccaaatggaaaactagatttttttcataaaaatgtttcgggatatatatcataggcctttgaacgtaaatatcttgaactttaaacaatcattagccattaaaattttaatgtgtattaaatggatattattagactgtcaaagtgattagcaataggtggtttcattgtagaataacctattttaaagtattttagggccaggtgcgtgggattacatgcctgtaatctcagcactttgggagtctgaggtgggaggattgtgtgagactagaagttgaagaccagcttgggcagcatagtgagactccatctctacaaaaaaaaaaaaaaaaaaaaaaaaaaaaaaaattagccaggtttggtggcacatgcctgtagtcccagctacttgggaggctgagatgggaagattgctagagcccaggagttcgaggctgcattgagctaagattgtgccacttcactccagcctgggccacaaagcaagaccttggctgtacaacaaacaaaacaaaaggaaaaacaactatttgattttagtcagggtgtaagaatatgtattattgttcccaaaaaaatctgtgtaaaaacttcatagtgtgaaacagtggcaactgcttgattaaaacatcatttagaaaagacactcttccctgttttgaaattgactcctcaaaaggacagctgaacatggcctcttctccaggtgtcgccatgcactccctctgggccaccatacacacttctgtgtggggcgtgctcccacctccagcctgctcagctgatcttttgttcagcaatgcctgtctacttccccatgagatccacctggcactcctactagtcttaaaccattatctcccttgaaaaatgagttctggctcactccttactactaaggctgaggggcaaaggagattatataaatgaaagcaccatgcatgtttgaggtggtttccttttcttcgttgttgttttttgagacagggtctcaccttgtcacccaggctggagtgcagtggcacaatcttggctcactgcagcctcaaccttccaagctcaagtgatcctcccaacctcatcctcctgagtagctggggccacaggcatgtgtcactatgtctggctaattttttgtatcttagtagagacagggttttgccatgttgcccaggctggtcttgaactcctgggctcaaatgatccacctgcctcagcctcccaaagtgttgggattacaggcctgagtgggattacaggtctgagtcactgcacctggccgaggaggtttgtattattacttgtgaatggaggaataacttgagctttagaaaagttaaagtgacaaagatcaagaaaatttccccccctgcttttttctcttatattttaatatttccaaatgagctataacatatgcagaaaaaagcttaaaacattttatatagagaacaagtatgaattaaacacccaggtcaaaaaatactctcgttgcccttcacccatctcatattttactttctgaccacaggcctagaagtaactagtaactagaaacagtaaacttttcctgtacaacttcagtctggtatatgggtcttaaacaatataattctatttgcctgactttgaatttttcaaacagaattatgctataatatgtagattctttcgtgtcttgttttgcccaatattgtaaaggttacccatttgctgtgcggctaaagttcattttcgttgctatgtagtgtttcataattggatatattgaaatttctcctctacggtagcatttctagtctcagattataatgaagtgtgctgtttggagcattctggtatatatctcctggggttcatgtgcagcatttctctgggtgtttctcaaccttcttttcattatcactcctcctagggggataatttaatgccaacagtttagaatttaattaatactaaagaatagggtttgtcagatagggctgagctttggagagccactaaacactgtcatatctaagatttcttttgcctgccaaagaccaatttttgctcctttgggggtgatatcaccctctttgtgaaggcatactgtaagttatttatctcatactagaattgttgggtcgtagaaaatatgcctcttctggaccatggacttaaatgtaaaacccaaaactattaaaaccctggaagacatccagacatcctggcccttacttctggacataggaacaggcaaaaatttcatgatgatgccaaaaacaattgcaacaaaagcaaaaattgacaaatgggatctaattaaactaaagagcttctgcacagcaaaagaaactatcagtaaatagataatctacagaatgggagaaaattttctcaaactatgcatctgacaaaggtctaatatccagcactacaaggaatttagacaaatttacaaggaaaaaaccccattaaaaagtgggcaaaggacataaacacacacttctaaaagaagacatacatgtggcgaaaaagcatatgttaaaaagctcatcatcactagtcattagagaaatacaaatcaaaaccacagtgaaatacatctcacaccagtcagaacggctattatgaaaaagtcaaacaatagatgctggcgaggttgtggtgaaaaaggaacgcttatacactattggtggaagtgtaaattagttaaatcgttgtagaaagcagtgtggagattcttcaaagacctataaacagaaataccatttgacccagcaatcccattactgggtatatacccaaaggaatataaatcattctgccataaagacacgtgcacacagatgttcactgcagcactattcacaatagcgaagacatagaatcaacttaaatgcccatcagtggtagactggataaagaaaatgtagtacatatacaccatggaatactatgcagccataaaaaagaagatcatggatggagctggaggcctttatccttacaaactcatcgaggagcagaaaacctaataccatatgttatcacttataagtgggagctgaatcatgagaacacatggacacatgggaacaacacacactagggtctggtggaggatggagggtgggaggaggaagaggatcaggaaaaataactaatgggcaccaggcctaatacctgggtgatgaaataatctgtacgacaagtccccatgtcatgggtttacctatataataagcctgcacatatacccctgaacttacaagtttcaaaaaaagaaaatatgcatcttcaattttattaaatcatgactgttttccaaagcagttcactgacttacatgaataccagtagtatatggtagtttctgtggtcccttatccttgccagaatcttggtactgtcacattttaaaatttttgccaatctgtataacagtatcatattaggcttttactttgcattttcctgatcactgatgatgttaaacgtcttatgtatattacttatttggattcttcttttctgatagtttctctacttcaactccaaaaattttcatatgttatgcttgtgtagcccctgtgaaaagaaagcacagtaggatgacctagttattcacttgaaaagtatgatggagcccagcgacctttgttctaatcccagatgtttgacttggtcagagtcccacacctctggccctcagcatcctcatttgctaaataaaagtattggctgggttagagcagcagttctgaaccttggctgcccatcagaattatctaggatgctttaaaaaaatgtttagaccacatctgcaccagaaagcctgattaaattggattaaaggttactatatccatttcaacattctgtgataacgatagaataagtctttaacacctagatttcatggtttcaatcatcttccttgtctgcaccctgaattaagtatgccagagactctttatttgtaagactataatctacttttgtaaatgcgttatataaaggaggagactccttaatttagtccgtaggggaaacttggcgtcatcattcaaaatactttattgtatctggtttacttttagcactaagaagattttcttacattgatacctactgtgacaaaacacacatccaatgacagtgttaaaatgtcataaatgagcctttaaaagaatgaggcacatgatacatcatggtacttgagcagactgcaagcctgaccagactgaattcatgaattcctgacttttgacttcttcctgtaagatgctaccccactgccagggactcaacctctaaatccagtcaaggggctacttgggcctggaaccaaggcacagtcaaggtgaaccagctatgctccagggggaggtggttgaaatcactggtctcctggactgggccatgagtgatggttattggggctggggaggtatgagagacatcgtgttgtccatctacctctgtgtatcttcaaaggtctctgtaataaaaagttttctgaaatttactgcctgacatcaagtcagtggtgttttttagtgtccgtctgtcacatgtaaccatatcacatgtgatcagtatctgacacttgggtggcaccttgtctttttcagagggcatttacttgcatttactcacttgatcatcatagcagtcattttcagtgaaaaaccttttgtagccatccataccctggttacaagtgatagaaaccaaaagcttgaactctttttagcataaaagagtaatttattggctggacacagtggcttacgcctgtaatcccagcactttgggaggctgaggcgggtggatcatgaggtcaggaattcgagaccagcctggccaacatggtgaaaccccatctctactaaaaatatagaaaaaattagcctggtgtggtggcaggcatctgtaatcccaactactcaggaggctgcaacaggagaatcacttgaacctgggaggtggaggttgcagtgagccgagatcacaccattgcactccagcccgggcaacagtgcaagactccgtctcagggaaaaaaaaaaaaaaagtaatttattgcttaatgaaaccaggtcatgaaatctgggcttcaaggactctagatgggggcatttagtgtcaagaccatcttagtgttcatcagctctgttctttgttggctttattctctctcactaccaacaagttcttttcttccccatatagcaagaaacatggactcgggcagttccaaaatctcattcttacattaagaaatctttcctagtggctccaaaaagaaaatcccagataaggactgtgattggccaggcctgggtcacatgccatctctggacagctggcagtagaaagggaagggctgccatgattggccagcctgggccaggggcaggtcatactgattggcagcctccctcagaactacacggttggagtgatgggggatggtcctcctcaacaaactgatgcagatggatgggtgttgggcatatatgatagaagtccattgtaagttcagtctcctcttagttctattcctgtgtctgttcctgtcccttccaaacaatgctgcttttctatcagcaattcattattaaggagttgagtgaaagtcatgaaattccagtccccagatttgtccccaagcttgactcactctgctttctggatttacccccatcttctcacctaaccacagataccagaaaagaagtctttattcactgaggctttgaaaaaattagctgcacagtcttccttaccaccacctccaaacaaagaactttctctgagattggagcacagtgcctcctcctttctccttgctacacagaagcctcattctaggcttttcctccttccaggctcctccatgctctcctgaggccacctcttggggcggggaaggggagtgctctctctggctgcttctgctcacccagggtggactcaggagctggagcccctgaggtcagcatgaggcttcatctctcagcccagatggccaggctcagtgacagcatctctgcttcaggacatgtgcctttagtctcctccatagtctaaaaacttacttgccgtgctgaaacttgttgataaaaccaaatctgtaatcaggaacataaaccaacacaatacaggccttgcacaaatgagcagttgtggggtatcatgggcccctgtggattatttgactgaagagaatgatggaggcaaagctggttgttgttgaacaaattgctgccagatgtagatttcaataaacaccacactgttgttcccctgcccgaaggtgctatgaatttcttgaggcaacagaggcatcagtaaacggggcagtggggtgggtaagggggtcgctgttccaatatgaatggagcctcctagtgttttctgtccctggatgtttgtccacagaatccaaggcaggccctgggggtctctctcccctgcctgacattttacaccagagtaatatacttaaactgtagcaaccagactctgtggaacctaaaagaaacctggaattagggtaaaaatgtcacacaaagtctgtattgagggttaactgtaagacatgatgaacaaagcacatcatccttcccttcattgaacttacaaatgggagggagatgagtgctaaagcagtaattacaaataaataacagacaagccttcaaacatcctgtgaaggaatgcagcgtgagcttgtaatgcagaggccactgtctctgccttcaccatctgctaactaataagctaggtgggccaaaatatgagcctattagctgggcatgatggctcatgcctgtagtcccagctattcaggaggctggggtgggaggattgcttgagtccagaagtttgaggctgcagtgagctatgattgccactgcactccagcctgggtgatggaacaagaccccatctcttaaaccaacaacaacaaaaaaccctgagatttggggcctgtaaggccccagagtcttcactacccttggtggctgtacttttaagggaatgaaaaggagagagagattgagattgagactgagagggtgagagagagtatgattggttttagttagtatacaaagaagcttctcatgttccatacaatggagtgattctagagagaatgattttcccgacccttcccttgggttatggctcgctaaatcaagcatcagatgaacgcttggcataaatctaacgtgtgtatttggatcaccagagaactatgtggttttctaatcccgttgtcccagttagatgcaaagcttctggaggacaagggccacacctttccccctttgtgccctcaaacactaacaggcgctttgccatagtacttggaaaaatatatattagttgaatgataggacaaaaaagcggttgtagatggaaaacgcattaactgctgagaacacgttttcattttgagttgtctataagagtttaaggggcagggaagccctggagttgaagtaaattcaacagcatcaagttttgtgtttggccctcaataaactagtctctctgtacccctggcagggggtgggaggagtcctgggggagctcccttccaaatcttacagggtggtctgtttcttctttggataataatgatgtaatggctagtctcttgagaacttgctgtgttccatacattgtactaagcatttatttggattatctcattaaatcttcacaatcactttatttaacagatggagaaattaaggcacatggaacctaagtgttcaaggtcatggagccagtaagtgttagagccaagtcgtttggctccagagcctgtgttcttaactactactttgtagtgtctttcttacatattagttgggcctgtgtattgctagttgaattcctcttcccagtggcaggccttcacgtgtttgaccatggttttcatgttctccaaacctcagttctctagatttgtactttggtaggtcatcattttccacagatcctacctctttaggtcagaaaatcttgccagtttataaagattctctgggactaactcccacaaagcaaggtcacaagagatcaatgtacaaatgaagcagttcagtgagttttgtctaccattctccataagtacatgggagacaactgatgattggaaggtttggtgttcacctcatggagctgtgatatctcactcaccacacagatctgctcttctgagggaccatcttgccaatttccagagagttgcagggatattaaatttttgcacattaagcttcctctttccaagctgcacatgggccctgctaccgtttgtgaacagtcttctagagtgatataggttctagctttcttagttaagatcgtattttctgataccactcccttgtcactttgcctgaaatgagaaactcccaacctcaactgcttttctagtctcttccaatgaatgccttccaaagggctggtgtcctccagggtgtattagttgttactaatttcatcctccaaggctgatctgattttcaagatctgtagagagaccttagtatattgccttgcctgtaccaaatacagtcattatggcacaggaaaatctcaaataccttattggaaacccaggacaaatatttatttgaccttaatgaaatgaaaaagacattggatgcatacatttaaagaaaacccaaaactttggaatctttaccaaggagggtatcttttgaaaaggacaggctggaacaagaacttgataaaatagaagtaaaggttgacacttttttttttttttttttgagatctatatcactctgtcacccaggctggagtgtagtggcatgatcttggctcactgaaacctcggcctcctgggtacaagtgattctcatgcctcagcctcctgagtagctggcactataggcatatgccaccatgcccagctaatttttgtatttttagtagagacagggttttaccatgttggctagctggtcctgacctcctggcctcaagtgatccacccgacttggcctcccaaagtgaaagtcggcattactagccctgttcagcacatgagacagggcactggatggtgtctacctaatgattttcaacccaggggcccttggcccaagcgtatcactggtataaagggcctctgccagctaatgtgagggtgagtgtggctgttgtgtccatgagagaactcctgggagttctacactcagcaaacgtttgttgttggactatgaaggcggacacagattttatacgaatttgtaatgctaacatctagcataagaattggcaaccatagaaaatattacgtgtatatatatgtttatagtctcaaaaaaaaaaaaaacaaattaaaaaaaccccaggctgccctgtctctctctatctctctctctatatatatatacgcctttacatacacacacacacacagacacacacacacacagacacacacacacacacatatacatatctcttaaatgagattctatttttgtgaagtgttcagaatagacaatccatagaaacataaaaacagattcatggtcaccagggacttggggggttggggggttgtgggagggaaatagggagagactactaatgggtactgggcttctttttgggataatgagaatgttctggagccaggtgtggtgcctcacatctgtaatcccagtactttgagaggctgaggcaggcagattaccctgaggtcaggcattcaagaccagcctggccaacacagtgaaaccctgtctgtactaaaaatacaaaaactagctgggcatggtggcacatgcctgtaatcccagctacttgggaggctgaggcaggagaatcacttgaacccaggaggtggaggttgcagtgagccatgatcacgccactacaccccagtctgggcgacagagcgagaacctgtctcaaaaaaaaaaaaaaaaaaaaaaaaggaaatgttctggaattagatagtggtgatggtttacacagctgtgaacatattaaaagccattgaactgttaaattggtgaattcatgctacgtgaattatatctcaataaagctgttactttaaaaatgaacaagaaagtaaaacccataaaaaggtcctctaggcacttcagcaaacagcgtggtagggaaaagaccaaggagttcttagccctggaggaatggaaaaccagttaacatggtttattcacccaggcctgagatccataatgaaggccatttttaaagttgagtcaccacaggcttgaagactggttaggattggggaactgagggttagagagtaaagtagaagggatggcacttttcttgataggagataattattgcagatattagtgttaagacctattctttttagtatttttttaaacacaaagtaacacctccatgttaccagcaatatttcacatttcaccagtgttcactaagcacctattgtgtgccagttcctatctgctggaagtgcacgattccgtgggctgtagcgagcacagtagcagtccattgggcccaattactgctgacctgagcaatctgttaaaacccggaaagggtattggaagcagacagtccttcctttcttaccaagcctggagaatctacagctctgtccaccacgcctttagagaggcacacccaaattggaagattgtacagtaaaaagagggaatgtccagttcaatgttgagggggctgagagttctctgggttccccaggtggagaacagacggggggcgtgggccttgccatgtggtctgagcactgaatgtcctgaaagtgtggaaaggcctgtccccaagctttagtaactttttttccacctagaagcaagccaagtagtttcagagtaattctcagggtaatccagagccatcttcatgaaagataatactagaaaactcagagggataaaaggatatgcttgctaagaagattatttcccgccgtggctgtccctgcaagccaacaatagcacacccttcgtcaggatgtaacgagtgagagagaacagctagaaaagggtggagaagtaggcgggaggaagctatttaaaagaccctaaagtgctgcagctgttttggctaatttttctcatctcagtgatgttccaagctctttgtcttctatgtggggcgacatcatttagctctcttatgagtcatccttcccacaaataatctctcttggagtagcccttatgaaaacagacaattcacattgcattgtgtgaattggcaattgtgtgtcccttccctgggtgggccatcctgcgtctgcctgcatccacacatgtaggacttctaaggcctgagcaaaccctcagtgatgggggagtgcaaggggtgggggggacatctggagcctgaagcaggcatggaaagccaccaacagtgtgccctggtcagctgactgctccatcttaaaggtttctggataccgtagttgttacctttcctcacaagggttttatgagaattatctaggaaaaagcagacatcagaggaaattccgtgtaaataaatgtgactgccacttcaaacctcaatcttgctaaactgagcttttctttttagatagtcttttcttctgtctggctagcaggtctgaccagcattttaattaaggcttccctagagagacactgagctctttaagatagaaactagactgggtatctgctggtttttctgcctaggaaaatgtactctaatgggtaccttgatttttacccagagaagcccagggtctcactctcatcccatgtttttctggtggagttgactccgcccttggcccatggttggggcaaggtagttgggaccccaggcaatcagcacatcgtgtttccctggccaaaatgcttgggtcagaaatgggcacatgacccaatcttaaccaatgaggtatgatgaaactttggctaagaggctgcgattagaatttggaatttgacggcatgagtctgggctggggcagccttctagtgattgtgagtggagagccagtttgagtatggagaccacacatggaagagagctgagcctggctgggctgagagagcaagaggatggtcatggtattgttctctaagcccagaaccaggcttccctgaaggtaccattatcccggtctttctgggcatatgaggccacatttcccttttagcttgagtaaataaaggttgagatttctgtcccttgcaaccacaagttctgacttgttcaggggcagcgtttcaatctacctaacatctagcagaatgcctggcaggtagaaggaagctcagtgtgtgtttactgaatagattctcattgagttaaacagatgttcatcaaatgctaatgaggttaatggctaccatattggatgatacagatatagaacacttccatcattacagaaaggtctataggatagcactactatagagaggacaaactcaaaccctgcctcccagaagctctatttttgagggtttttaaaatattatcaaaactagatagcataacatatggaaagatagcctgacttactgatttataaaagttcagctttatttctctcgagtacagttatttacatataaattctaatgaaggagtttaacaacaattactatacagatagagtcacacattatacaaagtaaggtatgcctaaatattcttttacatatgaggaactggaatttactgggcctagaaactaaagcagtgtagaatgccttgttgattttttgcagccttttcatgaagcaagttattgattttaagtagaacttaactacagtagtaaagtcctaaaatttctcacagaacctattccatgtccttacccagtaagactagcacttgccacccagaatgatgacaattctagaataatgtggtttagagtagtcagtttctgcaggtgattcctggacatcccagtgcacctgttctgcttttgctggtccacatttggtggtccactcatacctccttcagagtagggcatctgagcctattctggcctccagcatactcattttgtataaaagccatccctgtgtacaattccttcttccggtgacatccatttttcctaaaagtgatgtgagaacaactgatcgtgagcttgtccatgtattgttccttgttggcctgaaaaccaggagcacttgtaaggctgaatggattctgcccagaccggggctgtcttaacccctcagagttagcccgagctggccacaactacatcttcagcctaatatctttagttctacagttatggatcccaccttaatcaagctgatttactcactgtcccagagcacctctgaccttgggctcacacccttccctactcatcaaccccacagatggttaattacttctcaaaacttacctcaaatacctaacctgtcttatgttctttcaaaccatctaagccagaaattctgtatcccttctttgaaccccgatggcattgtctatattcttgttttgttgtagtagctttatttagatgtaattcatatgccctacaactcactcttcaaaaatatacagttcaataattttttttaatattcagagttgtgtaaccgtcattgtctgtttagaatatttcatcacccccaaaggaaaccctgctaaagagcagtcatctctcagttcccctcacaccaccctctggccccctaaccctgagcgatgactaatctttcgtctcttcggatttgcgtgttctgaacatctcatataaatggaatcctgtaatatatgggctcttgtgactggcatcttccacttaacatgctttcatggttcatgcatgttgtagcattatcagaacttcattcctttttaaggccaagtcatattccattgtaggatctgccacatattgtttatggattcatcagttggtaggcatctggattgtttccacttttttgctgttatgaattatgctgctgtgaacattcgtgtacaagttgttgtatgaagtacacgtttttgttgttttgggtatatgcctaggagtggaattgctgtattgtgtcgtaacttttttgttctattcttttggcaatatgatatattctgatacttaaacccatggtgtttcgcttaacactaatacaccttgcctcccctaggaaatataaacccttgagagctgaaaagaagccttatttctttctactccccccactaccgaccactgtgtctaacaaaagccacaattactgtttggactcaaaaatgtgacggaaagaagtagacacttgtgaagtttttttcctctctttctactttaaccctaaactgtgtcacattttttcgcgttcacactgtatgtgtacccttttctgaaagtgcttgtcctctctgaggccccagtattggaggctactggatgtgtaagtagttggtatacagcacctctcaggtgtgaccattccaagggaggagatcagcttccagcatgtctcctccagacaacaatacacactgtcctcctgctgaacagtcagttgtggagtaataatgcacctctgcaaggctttgcagggtttttactcatgtatcaccaaggatgaaaatggggcaggacacagtagaagccgttaaaaggaaattatgtcttcttgccttttctcccttgatcagaccctaagaaaacagcttacccaaatgagcggaaagatgccaggtttataaaatggagtctagcagctgtctttggttctaccttgggatgaggttagaagtattgtttcccaaactcttgcggcgggaagatctgtactaggtgggactgccggtaaatcactggggaggagaagcagctgctgtgaactgagtggtgtggcaactctggcttttgattccccagcagcagatggcaactttgagtaatgacacacacaagatagaggctgtgcttccttatctgaaatgggaatttcaagtgaaagataactggagtctcttcttggggcataattgatctttcatgagccattatccagggtttttacagtacctacaaaaattgttctgtacccaggagttcaataaacactaaatgtgtgaaagaatttgcattctttgcctccggatcagggggaaacatttccggaacatacattaagaacttcaaattgcatagcatttagtaggcacaaagtgactatactagttaaggggtgacagatcaatttcaatttgtgtgcccctcgcttatgggtgtttggagggttgtgttgggaaggattgctgaggccagttaataaataaattaatacattggttatgtctgtcatgaacacctaagagactgtgcagtggtagcgcttgtgttgaatattttccctagaccttgagctccttgaagggcaaggactgtgtcttagataatataccctcaggaccggacctagtgcattgcctggtatggaggaagtaaccggtaagtatatattggttgaatgaatgatttgatttcctagtttttggaattggcccatgattctaagtgaatgagctcacctcagatgccttaatagtaaatgaaattttgcagcagaaatattttctaaaatacattgatttttatggaactagtgtcttgttttcaaaacagccctctgttttgctacaacaaaacatttcaagagtttcaaatttaaattggctactcaaagccaatttcttcatttttttcctatctcagtggtctagaggggcatcttggtgttttaagtggaacacaggcttagaagtcagacttgggtttttttgttttgttttgttttgatggggtcttgctgtgttgcccaggatggagtgcagcggcaccatctccgctcactgcaagctccgcctcctgggttcacgccattctcctgcctcagcctcctgagtagctgggactacaggcgcccaccaccacgcccggctaattttttgtatttttagtagagactgggtttcaccgtgttagccaggatggtctcaatctcctgacctcgtgatccgcccgcctcggcatcccaaagtgccgggattacaggcatgagccactgcgcctggcctagatttgggttttacttacagccagctcagctattaacacattgtgtgaccatagctagttacttctccatgctggaactcagttccctctaaaaaattggagaactgaagcaaatgagctctgtaattctatgaaaataaacgcacaggataaaaaaagagaacttgtttcaacaagataattctctgtctttggcctagttgaggggtccccaacccccaggccatggaccagtactggtccgaggcctgttaggaacccgatcgcgcagctgtaggtgagcggggcaagcgagcattaacgcctgtgctctgcctcctgtcagatcagcggagcattagattctcataggggcgggaacacaattgtgaactgttcatgcgagggatctgggttgcccgcagcttatgagattctaacacctgatgatctgaggtaggacagtttcattcatcacccccccatctatggaaaaattgtcttcctcaagactggtccctggtgtcagaaaagtttgggactgctggcctaggcgatcacttctctcatttcagcttcactttctgacacaggagcaataatcctaaagtgaggagggggagtcactttaaaaaaaaaaaaaaaacagcaaaaacatcagtcattatggtgaaatgtcaacacagtaagtcttttctaatatctctgcagaatgctacatgagatttgccctgattcatagatggctatggtatgtgtaatacataaaaatataatgtatcatctcagacatatgtcttggctgacattcagcaccaagaatctgacaaatgtttttatatttatgtacattctgcctgatttcaaaaacagatttaagatagctatactcaacatcatagaaataattaattctggacgtctttagaatgagaataaaaacaggagccaagtgtttttttttttttaagtgattatgttaggaaacttaaactctgagagcttccaaaattcaacatgaattgtaacttcatggttcctggaagccagagccaacagggaagtaatgggctgcctagctcttcttgtctgataacagccagagtaatgggctttgtggggaaaaggaaatatactggcacaattctacctcaggcctgttctgatagccttttgtcgaggcaatagccattcgttcataatgaaaccattgaattacaaacaagagtggcaacatagaccaagccttatttgtttgtggggattttactagttgtttggtagactttagccaggccacgtatagtaacagtagatgatgcttaatgtgccagatgctattctaaccgtattaacatattaaaaatccttacaagagccctgtgtgttaggaacagtgctttggggtctgtgctcttatccactgcaccatactgcctcttacatgtctcaaatcgtacagagatttatcttactgcagtcacacagctcagcatcccaactctgggtgatctcaggaaagaacatctcatttaaagcaataataaccagtttaaatgtaggcagcctcagtgctacatgaccaaccagatggatcagctgtttacttattgagtccactggttcttttggcgttgttttaaggtggcttcttgaatgttaaaggaacaatctaggctctatctgaacctccttttgcatctttcattggtgacatgaggagcatacataggccatgtgtcctcttgtccttcggtatcttatctacctttgggctgctaaatatgccaaatcagcttctcttgtgtgccagctcactcagcaggggtggctgcctagaagactgtgttgagaagggctctcaggcctggctcagatgtcgtgagagaaggggtcatgactgagcaacaatgcctgatgtgggcaagggagagggtagcaccagagcgttgcctttgccagccatggcctagttcaagatgagggcttgcctctatgctgcatggcttctgaggttattttccctcagagtacttcccattcaagaggagaacagaatgtagcaattcacagaattcattccataaaaatgaattccctccctgtacaagacacacaataggaagattaataagtcaaaatccctgccccctcccaaatttcatcccagtcaaggacatataaattttgacaaataatatctatacagtgagataatgattattcttataaagtactgagggaacacaaacaaaagagtcactgtctatgcctggtaagggcagacaggtcaggctgcatggagaaggtgccagttgaccctaaccctgattccatccatgtgtatggagcccagagggtgtgtgttttgagaaccacctggtatgaccaacatcctcaatatgtctttgcaaccttccttttcagaatatatacagtaccaccagtagtaagtcatctttttggagtcttgatataatgacacacatgagagaatggatgaatccaatctaccacaatgggtcaatattttagaattttagctgtggcaaagacctttagggaaggcaaagggtggggcagggtttgtggaagccatggatatagggtgtcagtgctgggcaggttgaatagacttttctaaaatgaagtggaaaaataagaaatgcagagacagcctgcactggcattttacccaaggccattctgtgtcccttaggaaatgtgttctttacagggatttgaaaactatagggaatagtgattggggtcagaaatggcatcactggggctaagaaaccaaagataaagtcactttggagctaacctttgtattcagagagctttgtcctaatcctgcttagaatttccacggcgtcttttcttcccttaagagaaatcaaaaggctttcacttttcccctctctgccctgtgaagacaggcattcaaaacctcgttttgcaggttaaggaaattgagttcatggtctaagatcacagtgaattgaacagactcaaaagcaagcatttaatctctctcactctctctcttaaatgtagttcttagaatgagaattcttagtggttttaagaaaatggtaatgtttgtactataattaacccccagaaacagaacatcaaaaccaagacactttggcaatcgtcttatccaatgttctcattttaaagatgtggactctgggccgggcgcagtggctcacacctgtaatcccagcactttgggaggccgaagcgggcggatcacgaggtcaggagattgagaccatcctggctaagacagtgaaaccctatctttactaaaaatacaaaaaaaaaattagctgggcgtggtggcgggcgcctgtagtcccagctactcaggaggctgaggcaggagaatggttatgaacccgggaggcagagcttgcagtgagccgagatcatgccgctgcactccagcctgggtgacagagtgagactctgtctccaaaaaaaaagaaagaaagatgtggactctgaatctaagggacaactccaaataactcgaggatatctggtcattaaaacctactcggctctcaaggtttccatttctaactggaagccattgccttcaagagctgtttaagagcgtctgccacccttctagaactcagtttaaggacttctgctggagccttggaaggttcagggccctctcgtcaccattgctaagggctgttttatgttcttttatgagatagtctgttaggtgcagccacaagaaggagacacaggagaggctcaggaagacaaagtttatcgtggtcacaagtcctagaggcaggagacatggcacaccatgcaggtccacaggggaaagacaccagggcagtcaggaggcagaagacaggagcaaggggaaagcattaaggtaaagccatgatgggggtttccttggaaaagtcaaggcagggcagcgtgaacactttagggttggctagtttgaataatctcaggggccctaagctataggaatggtccctagttgactgtacctggccctgggatgatgaaagcagaggaattttgcctcttcgggtgttgggccagatagaggaggtgtggctctgaattggttagttcgcatgtcagaagtgtactcctggctgggccctttgctggctctaagaattaactatcctctcgccacccccccaggggcagtcttcccagctagaaaggttttttaaaagatgttcaaacatcgtaacatacataaatatgtaacacaagggccctggctcctctcagatatttttatttatttatttatttatttatttatttatttatttatttatttatttatttatttttgagacagagttttgctcttgttgcccaggctggagtgtaatggtgcgatctctgctcactgcaacctctgcctcctgggttcaagcgattcttccacctcagcctcccaaggagctgggatgacaggcatgtgcaatcatgcccagctaattttgaatttttagtagagatggggttttgccatgttgatcaggctggtctcaaactcctgatctcaggtgatctgccctcctccgcctcccaaagtgctgggattacaggcgtgagccaccatgcccggcccctctcagatatttctatccattgtcatactcccactctttccctaactactactgacttcagcttgcagcagaaaattcagcctttgtaagcttgagaggactcaggttgctgaccaaaagcagaagaggcctcccttcaaaatgtatggaatgttgcaaaaagtagacagtgatcctcaataatcagatacttccctcagaatggtctgctaaaccttcagtcttgttgaaccaattggttcagtactttgtaacagaacttgggaatttctccaccctggatgggatatttcttatggcctcccatcccaattcatgtcagcccttcccgcatttagacttggttactttcaactctttactcctggcatcatttttaaatgattcaggactcttggtttcaagtgacataaacccaccttgaattatcataggtggagagtgttggagcattgaacataatggaaagaaaagttagcttttttctacagttctgataggaacaggttctctccctgcagactggcgtcttctgctagacaggaagtgtgactactggcagctccagagcctcataatccatagcttcagttgcctggcatgcactggccctggacttctcacaccccaaactctcatatgtgggcccagctggctctcttgctcattttgggaccagtcaagttagactagagaggcagagtctgtaaaggaacgtggttggtgtgggggaaaaagcagtttccataagaaggtggtggtcccaggaagacaggatggtggcaaaaccaaaggtgtttgtgacaaacctgagagcatatcaggaagaggaatgattaaatcatttaagtgacaagagcaggttgaaaaacaacaggtgtagtatgcttttgtaaaaaaattggccaggcatagtggctcatgcctataatcccagcactttgggaggccaaggcaggcggatcacttgagcccaggagtttgagactagcctgggcaacatggtgaaaccccatctctacaaaaaatacaaaaattggccaggcatggtgttatgcacctgaagtcccagctacttgggagtctgaggtgggaggattgcttgaacccaagaggtcgagactgcagtgagccatgacttgcactactgcgttccagcctgggtgaacgagcaagaccctgtctcaaaattaaaaattaaaaaattatgtattcagtaaatcttttctaattgactttccattaatggaatgtcccagttggttaactccgcaccccctcggtaaagtacggggggaggctgaacattcttagctggcagcctggttcctaggacaccagcacacttctgctcccaccagctgaggcctgggctttccaagagtcattcttgtttcttgccaaacctgggaatgccagatggacttgttgttttaattataccatttaattaaatatcccccaaacgaaagacaaatacagaaagttatttctgtgaaagtcattgcgagtagctagaagcagtggctttttgcagaggggacagggcttttaccttttattgccgaataggttctggagtctgaccccctattttcaaattatagctctactgcttctttgctgtgtgacaccttgggcaagttgcagagtcatcctaggacttggcccctttactataaaatggaaatagcaaccttgtttgggtactgttaggattaagtaatataatgtatttgaagcactttgcacagttcttgggcacatagtaaacactcaacagatgccacatctatcatcatcgtcatcaacaatcacagccttattaaagatgtagagagaagtcattggctgtaaaggaaaaattttttttcttatcaaatcaatctctaaaaacctaaagtgtgtgtgtgtgtgtgtgtgtgtgtaaggacacctccagagagttctagagctgagtgaaaacctggtttattaaaatgagcctgggccgggcacagtggctcacacctgtaatcccagcactttgggaggccgaggcgtgtggatccagatcgagaccatcctggctaacacggtgaaaccccatctctactaaaaattcaaaaattagctgtgcatggtggtgggcacctgtagtcccagctactcgggaggctgaggcaggagaatggcgtgaatccaggaggcaaagcttgcagtgagccaagatcacgccactgcactccagcctgggtgacagagagagactctgtctcaaaaaaaaaaaaaaatgagcctgtaagtctgggtgcacatctgtaatctcaacactttgggaggccgaagtgggatgattgcttgaggctaggagtgtgagaccagcctgggcgtgagtgaaaccccatgtctacaaaaagttagtaaaaaataataataaaaaataaaaattagctgggcgtggtggcacacacctgtagtcctagctacttggagaactgagggggaaggattgcttgaacccaggaggtcgtggctgcagtgagcagtgattgcaccactgcacaccaacctgggcgacagcgagaccctgcttcaaaaaaataaaaataaaaaagcctgtagcccctcttccttccctaatatatttggcttctataaaaattaaaaacccagggataagaagaaggggagagaattggaaagcccctggttagctttaagggcctctcagtgcagcagaacccatgctggctctattcataactttgctctctggatcaatattctgaaagttggtacattcttttcatttgtgtctttcacagagggcagtaaaatttagctctaattatatttagggcatctggattctagtcagcattttctggctccgttttagaacctaaagtctgcggcttattcctaatgtggaaaatggaataatcccccaggcatgagaagaactccagcattgaggctgctgttcctctagcgagaagctgctgcagacatcacaagacttgttatacaaggaaacatgattacagtggattaaagaaacttgccaggggcttgaaggatttattgctttttgaattctgaatgagacataaatatgtttttcccctcttaattttggaccccatacgggtaaggtgagaaaattcttcagcaaattctagaatgcttagctgctaaagatcagttggttttgtgtccacgtcatattgcaaagggcatgaatacttgcttggcagagacacaaaacagtcactcatttctttctgttctgccaagttagttactgccttgtctcccagtgggagaaaaatgtaactccttggggactcttctggaaggcagcatggtgtaatggaaaaagcactgtagtcacaggcacgaggcctagactacagcgtcggtgcttataagttccattatttacaacaggtttcttaaactctgtaagcctttgtgctcttactgctcttttcggaaaaagcagttctcagagggttgtatgaaggattatagcacctttatgttcaatatcatctatagaaactcaactgttggatgcattagcatcagaatgacagcttgtagtacactcatttgtgttcacagatctcagaaatttttatgtcctaaatggagggacttttaaaaataatgatggagctgggcatggtggcacacacctgtaatcccagcactttgggaggccgaggcgggcagatcacctgaggtcaggagtttgagatcagcctgactaacatggtgaaaccccatctctacaaatacaaaaaattaggtgtggtggcgggcgcctgtaatctcagctgctttggaggctgaggcaggagaatcacttgaacccgagaggcagaggttgcagtgagctgacatcatgccattgcacttcagcctgggcaacaagagtgaaaccccatctcagaaaaaaacaaaaacaaacaaaaaaaactgatggcttcttaaccctatcacttctgcagattctttggtttctcaggaagccaaagagatagcatggggcagtggttagtaacaactctggagtcagaccaacctgagtttaaattcactacttattagctgggaagtctttgaacaactcacctaacctgttgttctcattttcctaatccgtaaaatggacataaaatattacctcaaccgtaatttgttttgtttcgttttgttttgagatggagtctccctgtgtcgcccaggctgcagtgcaatggtgcgatctcggcttactgcaacctccgccccccagcttcaagcgattcttctgcctcagcctcccgagtagctggattataggcatccaccatcgtgcctgactaatttttgtatttttagtagaggcggggtttcaccatgttcgccaggctggtcttgaactcctgacctcaggtaatccacctgccttggcctcccagagtgctgggattacaggcgtgagccaatgcgcctggccctatttttttattcctttgtcctgtttcctatgtgggacttatcaccgtttggcattattatttatttgtgttctgtctaccaccccagccccactcaaatataatccccataaaggcaaagacattatatgtcttatttactgctttatatgtcttgcctaacaaagtaactggtacattattgttacttaatatttttacctttgaatttttttgccaaaataatacagaattagaaagaattcctcccccagtgtcatggctaaatttatatacagtagctgacttggaaactgggcagagttgttttgcgtttggaaatactggtgttcttacagttgagtttctatttccaaaagatgcttactcagcctttgatggcacagtttgacttgtgacatcagaaggttgacaggcagaagtctgagtcagaaattcagctatagaagagcgtgactttcatccctgctcgccctttgaggtatggctggacacagctcagaaaggtcttggatttcaatttgtctaggaaggtatttagcaaattatttttaccatttggattttggtaccaatcacccgaggaatctgcagtctctgcgtaagtgaagaatgagaatggaaggggtaagtggagctagtgggagagcacaggccagcccgccacttccctggaagaactgatggctttttccaaggcctggatcatgcctcgcctatcctcctccccactccatgtccccagtccatcctctgacttttatttacttaccaccttggaagtcataagattctgaagttttccacagctgctgggacttaggcactgggccactgaggacaagctgacaggtcagtgtttgggctctggatttcacatcattcattagccctctcgatccccacagagagggacgttcatgctatgaactgtgtcatggagaaaacacagccctagaaagaggaactcttgatcccccactacttcattctttcaagccctgtgacctgttcctctaaatgcctgtgggaccacaggtgggcttgggatggggatgcttcctgaatgcccagggactgtacgcaaaatgttacgtgtgtgtattatgggcagccagggaggctcggtttcatcagactctcaacagataccatctttggtctaaaatagatttggaaccatgaccctgagtggacctaatgtatttttgtaatgtttgtagactgcacatttgcccctctggccctccaggctgtgtgtgggcagattgaggatggaaaagctgaagcggtgcacagctgcccaatcttgttgggttgttgcatgatggctctctcatctcttcttgagtttgcttatttacacaattaagctaggcccattgtgaatcaagtcctgacctgtcaacagaagatgagatggttgaagagggtagcaggcaattctgtgaacaaaatatagctatagatctggctttaagagtaaaataaggccgggtgcagtggctcatgcctgtaatcccagcactttgggaggccgaggcaggtggatcacctaaggtcgggagttcaagaccagcctgaccaacatggagaaaccccatctctactaagaatacaaaattagccaggcgtagtggcgcatgcctgtgatcccagctacttggggggctgaggcaggataattgcttgaacccgggaggtggaggttgcggtgagctgagatcgtgccactgcactccggcctgggcaacaagagcaaaactccacctcaaaaaaaaaaaagtaaaataaaatcatgccaccaacaaacctacctattagtccactgattttctttcctctgtgacaaaatgttcatctccatactcttaaaggagtgatgatacacttggcctttcacctgaggaagtataggatgggagctgcatgtcccagctcaggagtattgacgttcctcttctcagttagccctgtccactgcagcccagctaatgtcttacaggctattagagatggtgtactggggccaagcatggtggctcctgtctgtaatcctagcactttgggaggctgaggcggggtagatcatttgagttcaggagtttgagaacagcctgaacaacatggtgaaatcccatctccactaaaaataccaaaaaaagtagccaggcatggtggcatgtacctgtaatcccagctacttggaaggctgaggcaggagaatctcttgaacctgggaggcggaggttgcagtgagtgagattgtgccattgctctccagcctgggtgacggaacgagactccatctcaaaaaaaaaaaaaaaaaaaaagagagagagagatggtgtactgggctgtgcgtgcttcagctacccaacaaagcacctctaccttgtgcttacaacgaaattcagttaactgtaagatctggaaatccctggcaagtgaaaagctgctgcctggtgtgagtatgtctttgttttctagcagtgcaaattacttcatcttcagcaggagtgtggcacctctgtagtcacacatcacttaacgatggggatgcattgttaggcgattacatcagttgtcatagaatgtccttacacacccttaggtggcatagcctgctacatacttaggctatatggtccagcctattgctgctatggtggaaacctggatggcttgtgagtgtactgaacactgtgggcaactggaaaacaatagtaaggatttgagtatggaaacatagaaaaggtaccacacaaatgtggattttgtaatcttatggggccaccctcatatgtgcagtccattgttgaccgaaacgtcattatgtggtgtgtcactgcttactgagtgctgataacatgccaggctatgtgcagggtgctctacaaaatctatcatgtttcatcctgtccttttcctgaagtaaatgtcagcattcccattttacagatggggaagttgaggctcagaggtgtgtcagtgaacaggtctaagaaaatgtgtgggctgacataatgtgagggccacaggggccaccagaggacatggagtagaggccttccctgaagggcctcgggaactgagccgagccaggagaggagatgggatttaggctgaggagagaacacttgggaggagctcggactccaagtctgaggaaggcaccggcatttattactttcttgccgtattactctcgttcagtctttctcctttgaggtgcagatagtccccttctccagaattattctccagtcatctgcatgggatttgttttcagtgttttttgaattagaactgtagacacttccctcctagcctggcttttctccatcaaactccccatagccatttctcattgactagagcaggccctagcgagcccagcccttagtctctgtcccctccaggctaccctccatggtagcaaccaggcggcccttttggaaacacacatatgaatatgttactcagggacttccaaaggctggctagcctttgcttcagaatgagatcagctcttcagcatggcagcggcagacagctcctaccgctggccccagcttcctctcaagctggccctggcgctctggactcctcacacttctgcctggcaaacacctacttggtcttcaagccttcattcttcatagaggctacttgggttctgccccacacctgtcacctgaattgtcattatgtgtgagctccttgagaaaaaatatatgacttggtcatctttataccctcagtacctagcataacacctggcatgtagtcagcacttagtaaaaacatttaaaaaatttttactgtctccattttgcagatgaaaataagaaactttaaatgaataaaatgtttgactcttggggtcaaggccataataattagaaagtctcctttcactgtgtgttgtctcatttatattccccaggtgatggtcaaatggtataagaaatgcaggtggctccccagtctcggtgtctcacatattccaactctttttttttttagaactcagaaaagtacttcatagattggctttttagatttcttttttttttttttttgaaatgtagtctctatcgcccaggctggagtgcagtggtacagtctcagctcactgcaacctctgcctcaggttcaagcgattctcctgcctcagcctcctgagtagctgggattataggcgtgtgtcaccatgcacagctagtttttgtatttttagtagagatggggtttcaccatgctggccaggctggtcttgaactcctgacttcaagtgacctgtccacttggcctcccaaagtgctgggattacaggcgtgagccaccacacctagcctttttcagataatttcttcaagattaaactctacaaaattattatattagtctcttttgtttggaggttagactctcacacagatttaagcaaacatgagaatgtatttgttcttaaacctgaaaaattcatggagagttctaatgtaacctccactagatccaagtttttaaaaatgtcaatagcaaactttccatctccccctcttgcctgggttttccctgtatcgcttcatttttaggcaggctcttgcctcctgctagcaagatggcaattggtagctccaggcttacgtccccaagcttagtgactcctgtggaaggagagcgttgttcccaatggcactagctaatgtcctgcttgactcatccaccagtgaccctgtcactatggtagaggaagggggaactgtaactctttttggtcggatctgggatatattcttatctctagggttaggggtggaatagtcccacctaagtcacataatctgagagccagggagaaattggtgaaaaattagaaaaccggtgagtttatcaaagggctgagcaagcagagcaacagatgtccactgtggttatcttacctttcttttttgttgctaatacgtctgttatttcctagaatggtatgatagaccccaagcaggtggcttgtgtcgtccttttttggtaaatgcctacctcccaggacttttgaaaatggttcaactgctgtctttgacttttttaccccagcctttgtgattggtctgatagctccagtgtttgtgctggagacttggaatgccaaatgcgctgatttgcacaccgtttttcatgaaatcttatttttcttgataagatcagggaatccttaaaattcccagtggttttgagctagaatcctattgtgagttctctgatattacatagatttaaagcaaatgcatttttcaggagcatactttcctttcactttttttttgtaactaatcaatgatttctgacattcagtgactgcttgcttctgctattaggtgactttctgatattcagccctgactgccacttgtccctctgacctagccataaaatactaatatttgcagctccctcttatatggtgaggaataataaaacattatagcactttgggctttgtttcatttcttcccattgatagcttttttcctgccactgtcagcatagctatttcccagcatgtttttccctccagttctgcagccacatagtattttctgactgctatcacctacccaggaagaaaattgtcacttactgagtacctgttttctgttaagtataccaacaggactttcctgcaaatcatcccatttatttttcatagcatccctttgtgggatggatatcattatccccacttaaaaagatgtggaaagtaaggctaaagggaggataaataatttgccaaatgttttagaacggatggaaaaactcgggattcagttctgagtctactaaccctgaaaggccgttctccaagaataaggctagaagctttaagatactggaaaagtatgagaccccatttctgacctaaaggcaaggatcaagactaacacatttgaaacaatgagagtgaatttaagatagagtcacttctgagtgctgtgtgatatcatctatttgcagtgctgttgaaattcagaaaacagttctgcctccagattctatttatctttgaacctgactgggaatatatattaatattaaatcaagactttatttttaaatgtaaccctagtgccagtttcataatataccaattcactatttggttactgtgctgtgctcagacttctgttgaaccccaaaacatcagcgagccctcaatttctgtgcatacgttcaaacctcaggtcccctgctttgtagatcccgtgaactccctgataagcacaggtcacatttaccaactcttcattatacatctgatttggcaagacagtggccaggggaaggtgttaatctgtgcccaggttatatgccacttagttgagttcagttcagacttaccaagtgtgtagtaagccaagtgccaccacctggcaggtgatttgcagggctcactgggggatacgacatattcatccagtgtcttctgaatgctcagcactcttctaagcactggggacagtggcaagacagacaaggcagggcctctgttttcatggagcctacttttctagttctataaataaatgaaaaaagtcactttcagctagtgatgagcacagtgattaaaataaaacagaggctggtgcggtgtttcacacctgtaatcccagcaccttgagaggcccgaggtaggtggaccacttgaagtcaggagttcgagaccagcctgggcaacatggtgagactctggctctacaaaaaatacaaaaattagctgggcatggtggtgtgcgcctgtggtcccagctactctggaggctgaagtagaaggctcatctgagcacaggacttggaggttgcagtgagccaagatcataccactatactccaacctgggtgacagagtaagcccctatctccccatctcaaaaaaagaaagaaagaaaacagagtgtttggatgaattggtgtggagggtgggagtcgagaatagatgtcaggagttaatataaactggcaggttgtcagtaaaggtccctcagagtaagtggcttctgagctgagcccggaatgcaaagaaaggagccagacatgtgaggagctgagatgaccctcgtctaggcggagggaacatcccatgtgaaggcctaagcagggaataagcatgctcagtctaaggatggggtgggagtggggggccggagccagtatggcagcagtgcagtgaattagtggggagtggtaggaagtgaggttggcaatagagggagcacgtgacacgggctcttgcaggctgtgagacctagcttatgttgtgtttgaagcaggagagtaacaggagtgacttaacttttttttttttttaaatcctggccactgtgtggggaatggattgggttatagaggagtagaaataagaaggtttggggtgaatgctgggcaaggtagattatattgttattgttattgacatcatagaccaggccagggaatttggatttgctcctaaagctaatgatgtgtaacaataatagctcccatctcttgaatacctactgtgttccagtcatgcgggtttatgtgcattccctcctcaagtccttatacacacccacaaagcccctatccactgggcttattattaatgtcacttcttataaaggaggaatctgaggtggacagagcctaggttctgagcattccttagtgaggaaagggaaccagagctgcatgatgggcagggggctggcgagatgcgtcaggattcacatggcaggacctggagtttggcagggactttgaggtgcaaaagagaagacccctgttgggagcacacatcccagggcggcctgcatgtaaactgctgggaaaagggctgcgggggaggcttagataaaacagacgcggatgctaccctctgcagtctgcagatcagcaggtgatcaggtagacctctcacccaaagcagaacatggcaagctcctgaaggagaatttgttgatactgttaacttagcatgtcagaaaaatgtcccagtgtcagaattgaattcctatacctgctaggtcagttttaagctaaaatgatcttgcaaaacctgttgacccattgataccctgtaccctaagtaggcagttggtattatttcttaactttggttcgtctatgtccatctctctgtctctgagacacacacacacacacacacacacacacacacacacacaccccctcccagagtccgagcattctagagtttcctaacagtgcagttgtcctgtctgaaatgtttacattggggaaaaaatgaacccctgctgtgattttatttccccacaggctctaggggtcttttcatagccgcaaggcatcatcacagcttcccaaggactagggtgtttatgtgtgcacagaaaccacactgcaaagggtcaggtcctctcctttgtaccctaaggtgtagagaaagctggacctcaaaactgatgtcacctgtaagaacagtttttgctttggttctggctttttcttttccttcttccttgagagggcttactatgttgctgttagttttctcccagcattcattcactctagcaaaatctggctacatatcagtttgtagaaaatgggcacaattctaggaatagctgtcctaatgtgttagctcaatgccgtggatgcgtcaacaatggctggtagctgccaccagttgacctgaactttatgtggtttttctttttttttttttttggtttttccttagatgagaactactgtttgctagagctgagataaaaccatttcaattagaaccttgtatcagaatataattactcctcccagagatagagtcctggcctgaaaagtgagtacaaaaaataaatagggacaaatagaaggagaatgattactggtacaaggtagatggaatggtaactcactttattctcaatgatgttatacaaatcaaataaaactctattcccatttattttattttagccgagtattcttgtccaaaatgaaaatcagatgtttttcttctttttcatttttttccaaagcaaatggttacaaacacttacttaatataatttactggagcttttttctgaaagaacatttatgttaactttcttttatgcatgtagtaacttttgatcaaaacatgactccactcccttgtttaatgttgagcatctggattaaaggcttcttttaatcttaaatacagattatggccctctttccctttaagcaaactgccataaaaccctggcacctttccagttttccttattaaagccctctttattacagtgttttccgatggcagtcattaaatgattgttatgcacaatgggcacttgattataattatttaactggcaatcagttattgcagcaatttggtggtgtaattaaaagggagcatgtttgtacctgccagcatctttgagatcttcggctctggatgaagcaggagaggcagaacataaacaaatggacggaagaatcaagcacttctgtgaatggaatcttttattcctcgcccatctgattcttggctgctttgttccataaggtagatgaacaatgatgataaaataaaatgtaaataagaatttttgtgctacaaactcctgaatcgataaatacgttcagtaatgaatgtaagtttctccatgtgctgtgaaatgctaaatggatagaagtgtatttatataattctatttcttttaaacacaagcatcagcatgttttctccctctaatttataaatgtcagcacttatttcttgatatataaattgatacaggatgccacaaacaaaaagttgccgcaaaagataagggcgtttgttagacacagctggaaagctttttagtcactatagaagttagcaggaatgtgattccaaagttaagatggccctcctgagttattcagaactctttcagttgtaagttgcaaattttaaccaacctgaacaagggggaatttttttgcttatgtagttggaatgttactggaactactcataggattacaggaagaactgcaggaaccaggactcagggctaggaactgggaatcagtacagcctagacgcattctctgtccatgtctcagctgagcttgcctgtgtttggcttcattctgagaatagtcttacagcttatttctccctgtggcaggaaacaggcctgatatcagtagccccagactcccatcttcttagcttaactccagtggaaagcagtctctatcttctacctttcataagtcagtctcgggaaaggattctgattgcccctacttggctcatatacccatccctggactaattcctgttgccgagtaaatagcacagtatgattatcctgcctggatcccatgtaatacctgtgggtagggcaaggaagttggagtcctgtgaccgacagtcttgttagagacattattagtatgaccccatcggtggtagctaatgactgagaaaaacatggtgattattttcaaaaatgagtatgaaaatctaaagtatccaaacttaaaaaaaattatttaaatgttttcccagaatgaatctctatctctcttttagaaacatcccattttgtaagaccaaggtatgaaagtattcatctgagtttcaaatgattgcctaatcttacctgtaatcattattgagaaccaaacacccattaatggtgtggtctaaggacaaggtcctgaagagatgagactggcgcatattaaagatgcctgctatgatgatgtggctgtcatggctacattatcatgagggatttggaatctggggttccagagagcacgtttttagccactatctctgactattaaatcacttacaacagctttggataataaaattctctgtttctctcttggtttggttccatattagaatctgcaagtgcaaaggcaaaacagtcagcaaaacagcagacttaaatagaaaaaagccccaaaaggaaaggaaaacaattgaaaatttaaaagaaaaacacccccacccccaaacatgatctaatcagtcttccttatggagaagttatgaatcatcctacttagcaaataagacaattgaatgtgcaagcccaaacttgaattaaagttattctcaacttcctgtttctcttattaacatgcatttattatttaataagtatttatgtatataattgagatatttaagctctgggtaacttaagtggctgtagagtactacctgaacacacaaggagaaataaactttgaatatgtgcctgtatatttacaacacacacacacacacacacacacacacacacacacacacacacacacacaattttttactttgtggatactggccaccacttgaagagtttcttgggaatctaatcttctcaatggcaggctccagcattgcctttgccagtagtttagttcatatggacttgatgccaattttcttttcacatatatgaaataacagtttggcacatagtaaataaaacagtgattccacagagaagactggcacctttcaaaaagtgaattgggcaggttcagagctaattttttctttaggtgaactgagtttaaattaaatgttgcaagagattaccatatttgtgtgaatttcaagaagtcaaaggccgtggcaataaagtattttcattttatagagtttttcttggaaaggccacacaccatatgacagcagagtgcttaaaacccagagcctggtgccagcacaaaatccaaacatcgtaaagttacttccaaagcccagatattgaccgatcccctctcttggagcagtgcatctttcaactagtccaagtccaccagcccagaatcaccctcccagcctcagatttcaagttggaagcccaaagtaaggcatgttttctaaaaaggaaaggaaaagctattggatagcaattgtcaagagtcaaaaaataaataaataaaaataagaataaaataaaatcatccccaatggaggagctttagcaaaagaaaagggagacatgccattggtcactgctgcatgtatgcattgtccctcggttggtttttaataaacccagctaacctccctccaccaaattgcctgtatctctccttctccacttagggctgtgtaccattactagaatatgaaatagtgatttgaaggggtcatttgttcaggttttccaggcttctgcactgcctgccctggaatcaattttttttttttttttgagatggagtctccctctgtcgcccaggctggagtgcagtggcacaatctcggcttactgcaagtcccgtctctggggttcacgacattctcctgcctcagcctcccaagtagctgggactacaggtgcccgccaccatgctcagctaattttttttttgtatttttagtagagacggggtttcactgtgttagccagcatggtctcgatctcctgacctcgagatccacctgccttggcctcccaaagtgctgggattacaggcatgagccaccgcacccggcctggaatcaatttttaaaacctgtctgggtgtgggtggcttatgcctgtaatgccagcactttgggaggctgaggtgggaagatcgcttgaggccagaaggagttcaagaccagctgggcaacacagcaagaccctgtctctacaaaaacatttaagattggctgggcgtggttgtgcatgcctatagtcccaggtatttgggaggctgaggtgggaggattgcttgagagcattattgggagggggtgcgatggtttgcggcagggggccgaggctgtagtgagccatgatcacatgactgccctccagcctgggcaacaaagtatgagaccctgtttcaagaaacagacaaaaaaaccttacaatctgtgctcactggtttcctcgacttcacctaaagggtatctgggaaggttctgcctcccctctgggctgggaatgtatgcagaagacttctttgaaagctttgctcacaaggacttgaaacccaggcttctcagtgaatttccataacaattcactgccaagtcacacaaatctgtcaaggaaggctttcctgggagagcgaggagggcctatccactgggtgacagctcggcaagtagcctccagtcctggccggctgggcctctcttcttcccagtccagcattagacttcactaccacctgctaatacatctgaggagagcaagaggtcctggtcacagcagatgatcagagttggtgccaggagtgtaaacaagtcataaattactcttaattcttctaggcaagggatactattagtcttcagttgtggaaaaaatgtactccctttaatgtcttatttatgtaatagttgatcctcttgtatgactataaatttgttttcttcggcaagcatttcccaagcatgtgctttgtgcagagcactgtgtaagcacctactgttgagaacaaatataggagttagggtttaaccggtacaaggtttcagctgggggcagataagaagttctgagatggatggtggtgacggttgcacaacagtgtgaatgcacttaacgctactgaactgtgcagttaaaaatggttataattgtaggttttgttagatatattttacgatgataaaaaaatttagggttcttacacttttttaaagtcaaggtgaactatgtatttgctgtaagttttaagtttcacatatttcccctagcaaaatgtaagtgtatgtgacttaccacaaagacctagaatttcacatttcttatattttacgtgcaggtgctgaggtcattatttctcagatttgtcctgttatgagaatattacctaagatcttatctaagttaacaaattattatcctttgcatcagaaataagagcaggatctcctctaatgaattgtataacctttcctgggttgggccttggacttaatgtcagcaccaccacagtgccaagaatgacgagagctttgttgagcttggagcacagggcttcagctcctatcttgagacttggtgaagtggataaagccctgagctttaggctctggttcctgcctctgcctttgagtaggggtgtggctgtgcaccagtcatttaatctttgtggaccgcagtttatttatctgtaagatgggagtgaaggccaaaggcctttggcctggcaagagttgtcaggcccaaacacgggaatgtttgtgagagcacttagtgctatgctggggacctagcaggtggtaagtcagtgtcatgccccttgcccttgaggctcctcctgtgacaaagggctgtaatgaaatggggcttcaaggagcccttaattctccacgtgtgggagctcatgagcggtcctaagaatcctcttctctctctcctgatgccccggttccttctctcatcactgctttctgtgctccgctctgtcccgcttccttccaactggaaagttcatgagagaagtatattgatgttctgtgagaaggggaatggctctccctgagcccttggctgggcgccacagcagctgtggaaacacaacagcgctcagcatctcctggtgtttgggctccgagctctttcaagaaacaccccatgtcctcaccatcttactcttcagacccaccacctttcccttaggttggaatctcttcccttggcttcttctgacctcttgtccctcagtctgtagccagcagcaaagaaagatgcttattactaccgtatctttttggtgggtactttggcctgctgactccttcagtagaatggaaagttgtatctgggggctgtcacccttcccttcctccttgtaggtccccctgctccacctgggtctagggtacagttgggccttactgagagctagaattccatttgttgaaagactagagtactttgataggtggtgtaattgatcagcctccccgaatttatagtatccttgtatatcttataaacatctgagtgatagagagctgacctcttccatactagcaccatgatttataggggatatctagtgccaggctactaatccagtgcttttcaacccttttattatcatttttgtacctttttttttttgaggtttatatcatttgtatacaattaagtgcatatatcttaagtatacatctcactgaatttttgttatctatatacctatgtaaataccacccagattgggagatagaacatttccaggacttgagaagcccccccttgagccccttacagtcagtacccctaatgataactacaattctgacctctatcaccctagttacttgggattctcaacgtttttccacctatacccacctctaagtcccacctctcctatttaatatgtaagaatgcaaaattatcagctattgtggcaaaaagaaaccaaagtagtggtaaatttagaaatcccttttctgctctccttgcccctcacattttaataagcattctccccgtccccctgcccctaacccaggtcatggagaggtaaagtgatatccccatcctctctggtcagtcttggcatcacagaagcttgacgagaagagaaacagacaccagggcagcttcatcctattttccagctgcccaaaatcaccatatagtctttctaagaagaatcagactgtggttcttagaattgtcagatatccactgagctcccaacacgcacagatcttgctttcctttttctgtcaaagtaggattatctttcccttgattatgtttgagttttcttgggggtagggaatacatttgaagaggagtaaccactgcactccccttccgatgtgcgaatgtcaagcatgttgaattgtcagtggcaaggaatgtgatgagcaggttattttacaggaggtacacagaaagcccccattttggcttcttctgccatattcaaatccttgtatatagaagtggagcttaatctgtttatcctagagtaaaaatatctacaagacactattattatattgacactggagccaaataggaaatcggaggactcacagatgttatctgctttaatgcagtgggttttgtacacaatgaccctgcagccaatcaggatggactctacggtagaatttaaagaacatcttattggcacaatgtttattccttgggcttcgtaggctacattgtgttcccagcattctgagggcaagaaagatggagagagagaaaatgaacctagcaagaaagtattgggataaattccatcattaccctaaaaatataattatagcactctttgatatagggtagaatttggtataatttgacaattacttatgggcatgtattatatgggtagtattgcacaaaggatagtttgcagcctaagaggaaggtgataggccaaaacggttaagtcttcaggctgggcacagtggctcacacctgtaatcccagcaatttgggaggccgaggcaggtgaatcactggaggccaggaattcgagaccagcctggccaatacagtagaaccccgtgtctaccaaaaacacaaaaatcagccaggtatggtggcgtgcacctgtaatcccagctcctcaggaggctgaggcaggagaattacttgaacccaggaggcggaggctgcagtgagccaaaatcatgccactgtactctagcccggatgacaggagactccgtctcaaaaaatgaaaaaacaaacaaacaaaaaaaccacaaaaacgacaaacccaaaagggttaagtcttcaaagctgtctttttcagcattttaatccataatttaggacaaaattggcacatctagcagattcttggtgatccaggatattttctttttcttttattttattattattatactttaagttttagggtacatgtgcacaatgtgcaggttagttacatatgtatacatgtgccatgctggtgtgctgcacccattaactcatcattcagcattaggtatatctcctaaagctatccctcccctgaccccacgacagtccccagagtgtgatgttccccttcctgtgtccatgtgttgtcattgttcaattcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcgttgttggacagttgggttggttccaagtctttgctgttgtgaatagtgccgcaataaacatacgtgtgcatgtgtctttatagcagcatgatttatagtcctttgggtatatacccagtaatgggatggctgggtcaaatggtatttctagttctaggtccctgaggaatcaccacactgacttccacaagggttgaactagtttgcagccccaccaccagtgtaaaagtgttcctatttctccacatcctctccagcacctgttgtttcctgactttttaatgattgccattctaactggtgtgagatatctcattgtggttttgatttgcatttctctgatagccagtgatgttgagcattttttcatgtgttttttggctgcataaatgtcgtcttttgagaagtgtctgttcatattcttcgcccacttttcgatggggttgtttgtttttttcttgtaaatttgtttgagttcattgtagattctggacattagcccttcgtcagatgagtaggttgtgaaaattttctcccattttgtgggttgcctgttcactctgatggtagtttcttttgctgtgcagaagctctttagtttaattagatcccatttgtctattttggcttttgttgacattgcttttggtgttttagacatgaagttcttgcacatgcctatgtcctgaatggtaatgcctaggttttcttctagggtttttatggttttaggtctaacatttaagtctttaatccatcttgaattaatttttgtataaggtgtaagcaagggatccagtttcagctttctacgtatggctagccagttttcccagcaccatttattaaatagggaatcctttccccattgcttgcttttctcagtttcgtcaaagatcagatagttgtagatatgcgacgttatttctgagggctctgttctgttccattgatctatatctctgttttggtaccagtaccatgctgttttggttactgtagccttgtagtatagtttgaagtcaggtagcgtgatgcctccagctttgctcttttggcttaggattgacttggtgatgcgggctcttttttggttccatatgaacttttaagtagttttttccaattctgtgaagaaggtccttggtagcttgatggggatggcattgaatctataaattaccttgggcagtatggccattttcatgatattgattcttcctacccatgaggatggaatgttcttccatttgtttgtgtcctcttttatttcatgagcagtggtttgtatttctccttgaagaggtccttcacttcccttgtaagttggattcctaggtattttattctctttgaagcaattgtgaatgggagttcactcatgatttggctgtttgtctgttattgctgtataagaatgcttgtgatttttgcacattgattttgtatactgagactttgctgaagttgcttatcagcataaggagattttgggctgagacaatggggatttctagatatacaaccatgtcatctgcaaacagggacaatttgacttcctcttttcctaattgaataccctttatttccttctcctgcctaattaccctggccagaacttccaacactatgttgaataggagtggtgagagagggcatccctgtcttgtgccagttttcaaagggaatgcttccagtttttgcccattcagtatgatattggctgtgggtctgtcatagatagctcttattattttgagatatgtcccatcagtacctaatttattgagagtttttagtatgaagggttgttgaattttgtcaaaggccttttttgcatctattgagataatcatgtggtttttgtctttggttctgttttttttttttttttttttaatttatttttttattgataattcttgggtgtttctcacagagggggatttggcagggtcatgggacaatagtggagggaaggtcagcagataaacaagtgaacaaaggtctttggttttcctaggcagaggaccctgcggccttccgcagtgtttgtgtccctgattacttgagatgagggattggtgatgactcttaacgagcatgctgccttcaagcatctgtttaacaaagcacatcttgcaccgcccttaatccatttaaccctgagtgggcacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcatacctcccagacggggtggtggccgggcagaggggctcctcacttcccagtaggggcggccgggcagaggcgcccctcacctcccggacggggcggctggccgggcggggggctgaccccccaacctccctcccggacagggcggctggccgggcagaggggctcctcacttcccagtaggggcggccgggcagaggcgcccctcacctcccagacggggcggctggccgggcggggggctgacccccccacctccctcccggacggcacggctggccaggcgggggtctgacccccccacctccctcccggatggcacggctggccaggcggggggctgacccccccacctccctcccgggatggggcggctggccgggcggggggctgacccccccccagctccctcccggacggggtggctgccgggcggagacgctccttacttcccagatggggtggctgccgggtggagaggctcctcacttctcagacggggcagcctgccgggcggaggggcatcctcacttctcagacggggtggttgccaggcagagggtctcctcacttctcaagacggggcagccgggcagagacgctcctcacctcccagacggggtctcggccgggcagaggcgctcctcacatcccagatggggcggcggggcagaggtgctccccacatctcagacgatgggcggccgggcagagacgctcctcacttcctagatgtgatggcggctgggaagaggcgctcctcacttcctagatgggatggcggccgggcggagacgctcctcactttccagactgggcagccaggcagaggggctcctcacatcccagacgatgggcggccaggcagagacactcctcacttcccagacggggtggcggccgggcagaggctgcaatctcggcactttgggaggccaaggcaggcggctgctccttgccctcgggccccgcggggtccgtccgctcctccagccgctgcctcccgggcggcactcgccggcgcggcggcaaagactgagacagctccgctgcccgctgaactccatcctcccggcggtcgggcagcggcggctgcggtcggtcgcggcagcggctccgcttcatatctgcagctggggcccgcgggtgtcagcgccgcgactgtcccggctccgcactgccccgggccgcagcgcagcggcgccaaccaccacccgcggccaccatggccggacgggctccctaagccaccgaccccagcccgcgggccttcgagccttctggggcctccggcgccgtgacctcctctcaagatgtgaatgattcttctggttctgtttatatgctaggttacatttattgatttgcatatattgaaccagccttgcatcccagggatgaagcccacttgatcatggtggataggctttttgatgtgctgctggattcggtttgccagtattttattgaggatttttgcatcaatgttcatcaaggatattggtctaaaattctcttttttggttgtgtctctgccaggctttggtatcaggatgatgctggcctcataaaatgaattagggaggattccctctttttctattgattggaatagtttcagaaggaatggtaccagttcctccttgtacctctggtagaattcggctgtgaatccatctggtcctggactctttttggttggtaagctattgattattgccacaatttcagagcctgttattggtctattcagaaattcaacttcttcctggtttagtcttgggagggtgtatgtgtcgaggaatttatccatttcttctagattttcccagctgtatgctgggagaaccactgctctcttcaaagctgtcagacagggacatttaagtctgcagaggttactgctgtctttttgcgtagaggtgtttgtagtattctctgatggtattttgtatttctgtgggattggtggtgatatcccctttatcattttttattgcgtctatttgattcttctctcttttcttctttattagtcttgctagtggtctatcaattttattgatcctttcaaaaaaaccagctcctggattcattaattttttgaagggttttttgtgtctctatttccttcagttctgctctttagttatttcttgccttctgctggcttttgaatgtgtttgttcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagtttcttaatcctgagttctagtttgattgcactgtgatctgagagacagtttgttataatttctgatcttttacatttgctgaggagtgctttacttccaagtatgtggtcaatgttggaataggtgtggtgtggtgctgaaaaaaatgtatattctattgatttggggtggagagttctgtagatgtctattaggtccgcttggtgcagagctgagttcaattcctgggtatccttgttaactttctgtctctttgatctgtctaatgttgacagtggggtgttaaagtctcccattattattgtgtgggagtctaagtctctttgtaggtcactcaggacttgctttatgaatctaggtgctcctgtattgggtgcatatatatttacgatagttagctcttgttgttgaattgatccctttacaattatgtaatggccttgtctcttttgatctttgttggtttaaagtcttctatcagagactaggattgcaacccctgcctttttttgttttccatttgcttggtagatcttcctccatgcttttattttgagcctatgtgtgtctctgcacgtgacatgggtttcctgaatacagcacactgatgagtcttgactctttatccagtttgccagtctgtgtcttttaattggagcatttagtccatttatatttaaagttaatattgttatgtgtgaatttgatcctgtcattatgatgttagctggttattttgctcgttagttgatgcagtttcttcctagcctccatggtctttacaatttggcatgattttgcagtggctggtaccggttgttcctttccatgtttagtggttccttcaggagctcttttagggcaggcctggtggtgacaaaatctctcagcatttgcttgtctgtaaagtattttatttctccttcacttatgaagcttagtttgcctggatatgaaattctgggttgaaaattcttttctttaagaatgttgaatattggcccccactctcttctggcttgtagagtttctgctgagacatcagctgttagcctgatgggcttccctttgtgggtaacctgacctttctctctggctgcccttaacattttttccttcatttcaactttggtgaatctgacaattatgtgtcttggagttgctcttcttgaggagtatctttgtggtgttctctgtatttcctgaatctgaatgttggcctaccttgctagattggggaatttctcctgaataatatcctgcagagtgttttccagcttggttccattttccccgtcactttcaggtacagcaatcaaacgtagatttggtcttttcacatagtcccatatttcttggaggctttgttcgtttctttttattcttttttctctaaacttcccttcttgcttcatttcattcatttcatcttccatcactgataccctttcttccacttgattgcattggctcctgaggcttctgcattcttcacgtagttctcaagccttggctttcagctccatcagctcctttaagcacttctctgtattggttattctagttatacattcgtctaaatttttttcaaagttttcaacttctttgcctttggtttgaatttcctcctgtagctcagagtagtttgatcgtcagaagccttcttctctcaactcgtcaaagtcattctccgtccagctttgttccattgctggtgaggagctgcgttcctttggaggaggagaggcgctctgctttttagagtttccagtttttctgctctgttttttccccgtctttgtggttttatctacttttggtctttgatgttggtgatgtacagttgggtttttggtgtggatgtcctttctgtttgttagttttccttctaacagacaggaccctcagctgcaggtctgttggagtttgctagaggtccagtccagaccctgtttgcctgggtactagcagcggtgtctgcagaatagcgaatttttgtgaaccgtgaatgctgctgtctgatcgttcctctggaagttttgtctcagaggagtacccggccgtgtgaggtatcaggacagggacatttaagtttgcagaggttactgctgtctttttgtttgtctgtgccctgcccccagaggtggagcctacagaggcaggtaggcctccttgagctgtggtgggctacaccaagtttgagcttcccggctgctttgtttacctaagcaagccttggcaatggtgggcgcccctcccccagcctcgctgccaccttgcagtttgatctcagactgctgtgctagcaatcagtgagactccgtggtcataggaccctccgagccaggtgtggaatacaatctcctggtgcgccgtttttaaagcccatcggaaaggcgcagtattagggtgggagtgacccgattttccagttgccgtctgtcacccctttctttgactaggcaagggaactccctgaccccttgcacttcccgagtgaggcaatgcctcgccctgcttcggctcgcacacggtgctctgcatacactgtcctgcgcccactgtctggcactccctagtgagatgaacccagtacctcagatggaaatgcagaaatcacccgtcttctgtgtcactcacgctgggagctgtagaccagagctgttcctattcagccatcttggctccagcccctccaggatattttcttgacaccctttgctgagggactcgtgacaggggttccctgtttactcagtccgttgtgctcaactcctcgcgggagggagcacgtgaatgaataagttcaggaaccagctgctgcttcgggcactggcaggagcaaactcccttaacttgggtccactcactccaccctcactggagggaatgcataggtgagcaagtgcaggaactagccggtcactttagcactggcaggaccaaactcttgtttgctcaggcccatcgcactccaccccttgcgggagggagcatgtaggccagcaagtgcaggaactgactggccactttggtgctggaaggaacaaactttgtgcagaccccacggcagtgtccaggtgggggtgcctgaaactccaaggccccagagggcatgttacaatgctctcttagctccgccgtccatggacagcagcgtgttatcagcttagtgggccctttgccttgtcacatggggcagatgccctccaccagcaagggcaaagggccagtgtgacagcctttttgggtacccacacttggtggatcccaaattgttgtccaatgccaaaaaagaatgaggtcacgtagacgaattgaagttatggtgaatgcagacaattttattgagtgatgagatcagctctcagtggagaggggagctggaaagggggtgggaaggccaggtcactctcccctgaagtcaatttgcctctctgcccctcttctccaaagtcaagttgcccctctctttgccatccagccaccatctctgaaggcaagtcgcctctccccaacatccagctgcttctcctctctgccagctgagcctggagtctttatagacacaggatggggggacagggctggccataggtagttttgcaaaaggcaacattcaattggtaaaaagacattattcagaaagaatgactcaggagagagcaggcaaacaggagaatagaagttctcaccctgggccaagggtttcaggctacttctggcttgaaggtggggtttccactggggacctgcccctgtctgcctagagtttctctgccttctgcctccctcaatgggtgatgctaaaccaggatgagtagtaaaatcaggatcagagagatcaggacagataagagtctaagcctaaccaggtaaaacacagcaggcacaaggtaggtaaatacttagatacaaaaaacaaaagtttccgtgatacagcctaggggaaacatgactaagtagtcctgtgaagaagaggtttttgatgcttgcaagcacaatctggggcatcacaaagagattcggtaccaagttaaacttctagaagttgaatggagagaacccatgcctagaggactgacttcactgcagattactacacttaaaactactgaggggtattgagaaccatgactggaaactgtgttataagaagcattcttaaatgtaaggagtagtagttaggtgaaagagaaaaccaaagagacaccaatatcccatcctcaaatgcaagaaggtgttaccaaaatgccagggattcagtctgggtcctgctgcttgccacacagaaagccaatcactgagacaatgactgttgccagggaagaaggctttaatcaggcgctgcagcaggcaagatgggagatcagtctcaaatccatctccctgactaaaatcaggggtttatatgccagagaagaaatgaaactacatgcaggaaaacaggaattagggaggggtaaggaagaggagttggtcaacaggaagcaggtggtcacttaggcaatcatgatgggtgaggggtctggtgtctcattgtccagctgtaattatcagctccttgataccatctgggtaggcctgatggttggttttctgagaagggaactcagattaagacaaatgtaactttaagtttgaaaactgggagagtccatttctgtgttaattcaaaagaaatcataaacatcggttctatgggacagctgggccggtttcaatgggctgttctgtatgtgaggcaggtgccctagaaggcaaagctaggattaggaagaagttataggaaatagtctttggttccatttggcaaagtcctttttcatcactttaagctgttgagcagagcagaatagatcatctcttgatggaacacagatatggaggactcacatttatggaggttgtgtcagatactagtcatagggctttggcagccatttgtcagaggtgttgaggaggggactcatgcactctgtaaaggcttgaacaggccaggcatggtggctcacaccagtaatcccagcactttgagaggccaaggtgagtggatcacgaggtcaggagttcgagaccagcctgaccaacatggtgaaaccccgtctgtactaaaaatacaaaaattagctgggcatggtggtgcacacctgtaatcccagctactcgggaggctgaggcaggagaatcgcttgaacctgggaggtggaggttgcagtgagccgagattgcaccactgcactccagcctgggtgacagagcaagagcaaggctccgtctcagaaaaaaaaaaggcttgaacagatgttctctaaggccctgtccaaacctgacagtctatgactgcttatgtgctcatgtaatcaaagcagacagggcaggctcagttgggtacgtggcttagactccccagggaaggaggcagggattgtcatggaccttgaagtatggacagaattaaggatcatgggatgaatgatgaataaaagctggacagtaggaaatggagattggggcttcctgctacaggtagtagtgtactgctaaagctttaccgggtgagggataaagtgtctcatcctgaggagagatgaggcactgaaatccatggacacccttgctctcaagtggtctcatacaaggagacaggctggcagagacccccagacatcttgataatgccagcaactccctgcgctgttggtcaatagagagagggtgcccagaccaagccactgactagttgtgctccagaagggtgcaggcagtttcctaacgactggaaaaagacaaactgtttaggagatgaggaattagacttaatgatccacctatggccgtatttgaggtttcacatttctcctaatgctgtctttaaaactcctgaagctgtaagtcagtcatgactgatggccatcattctaacagccgtggatatcaccaagtttctattttgccgtgtttcataaatgtggttctagagaactctagctttgttctagccactagcacacattttcaagttttatttaacttcccacattctccctttattttctcttaatggaatggccaacagcaagatgcaaaatatatataatggatgttaacgcagttcatgtgcaccgtaaggacttatactatattgtgtcattttcataggcgcgtcacgctagcatttccaggcactttccacatggtagccctatgacgtaagtaaatttgggcatgctccctgcatcacagatgaggaggctaaagcaggagagtttaagtgacacagtgagagtgggtacacaagtacagagaatagcccattccgtgagaggaaaggccattaaaaggaggacgttatcgctctttaactaaaaaaaacatccacagagaaagggtttggcattggcaaggccaagttaaacaggatgcagcattctctccaagcgtttccactgctatgcagcctctcctcacaccggtgcttttgggtcacttcctaatccctgaatgggttcgctgacctgtaaggagcagtgggaggtggagattgcttgcataaactcattgagggaagtgatcctgcaagtttcccaaggataagagaatgttttccctccctcccttcctttctactctccctcctcccctactcttgaaacaaccctatcccacctaccatagcacaagctgtaataccaagttgctcttctctgagggctgctgaggctgggactttgtgtcctcgctggaccagtgcattagggactatcaaagagattacaatagccaagggccatttaaagaaaccagagaatgcctgcatgactcttcatgaaaccttgacatttaataatcccatcacaggaggggtcccaaatactgtctcatttgatcttgttgtaccctgtttgagtaaagaattgagagtgttttatgggctaattctgtgggatgtattatcatactttctgaagctggaaaagaaaaataaagctgttaatacttggatctaaaataaacaaaaatccataggcctttccttatgtcatgtctttttattattttttattttattttattttttgagatggagtctcgctctgtcacccaggctggagtgcagtggtgtgatctcggctcactgcaacctctgtttcaagtgattctcctgcctcagcctcctgaggagctgggattacaggcgtgcaccaccatgcccagctaatttttgtattttagtagagacggggtttcaccgtgttggccaggctggtctcaaactcatcaactcaagtgatccgcttgcctcggcctcccaaagtgctgggattacaggagtgagcccccacgcccagcccctaatgtcatttctgatgaaacctttattgtatatttctcatgtttgtaattatttcagtttcaaaatatgttattctggccaggcacagtggctcatgcctgtaatcccagtgctttgggaggccaaggtgggtggatcacttgaggtcaggagtttgaggccagcctggtcaacatagtgaaaccccgtctgtactaaaaatactatatatatatatatatatatatatatatatatatttagccaggcatggtggtgggtgcctgtaataccagctactcaggaggcaggagaattgcttgaacctgggaggtggagtttgcagtgaaccaagatcacaccactgcactccagcctgggtgacagagcgagactccaccaaaaaaaaaaaaaaaaaaaaaattctgtccccctatttcccctgattttccgtagtctttaccctatctcacttggatgttattctatcttaatgcaactcgtacagtgcttgtctagtccctcgagatacaaagcagatcagttacttaattttcattttaaatgttgtttgtgagccgttgttgaagggcaactttggtacacgaggctggttttagtttcccatgtctctgccaatattcccatctgctgtatacattcactgctattataataataatagtttacaggagcccagattatgatattttaataatatagagccctttgttgacataaatggttcacgaaagttgaaatgaaatattaaagccacaattttggttctacttatcattgcatggaaaagactggacctgactcgtcgggtagacgtgagccttctttggagatttaatatttctttgcatcacaagtcattgagtcctcattttaagagtgatgttgagggctaggaccctctttggtggtcaaattagaattcaaccccagttaaatcctgactctcaatccagtattcttcctcctattccatgaaatccctgcatatatacacacatatacatacatacatacatatgtacataacccacctctttctctagaattgaggctgtagtctccaaacagaatttccaaaaatttgattccagtgtgcccctattagaattccaaaacagcaatcttcccagcacaatcaagggacacaattcctgctatctgggatgatatttttggcagctttgcagtgcagtcccctgtatggcactgctgctgaagaagcgggcaggcagctactctgtattgtcataggcttttgctgtgttggtgaatggcttttttcaggtgctataatttccttcacttgctatatgggccacctgcctctaccttctcattcctccaatccatccaccacctccactaggattaatcttccaaaaacattggttttcaccgtgtcactcctgtgaccaaacccctccccactgctaccagattaaagcttctaacgcctcagctggtgctccaagacctgctggccagactggtgaggccaggtgtcctcactgactccagaagaggctgtgttaattcccaatcctctttttcctctttccccttctaattgctctttctcctttctgtaggtcagcccttcataccacacaggggccaggcccaacccacttgtttgactctgtcctaggctgggctccaggccaactgtgctccttctctctgaactcctgaaatggctgccgatcctaggagagtgtatgagccaaactgttcacatcctcattgatcactgccatgacttctggtctctgagttcagctatgagctcttgcagaacaagttctcaaacctgcttggtccctggtgctcctagagtctcaggaattactccacagagccctaaaaagaaaaaacagtccatagcagttccatttattaagtagttaggaccaaacaatttcataggtaattatgtcctaacaatttagtagccacttgaaaaactgcacataaattgaaagaaaatataatcattttattctgaaataaccacagttatttactaatgggctgtgtgctcctgttggggactacacagcttcccaaaccttgaagtcagatgagacattgccacattcctctatcctttcctgttctacatgggttttcacacatacttgctcttatgaaacgactgccaaaaacccagttttccaaagatatgagatcatcagaaggaatgcagattgaactaatgttgaagctgtgacccaccttgatctagtggtttgtgcagtgcctgacagatgttagtatcatgttgctttccttgaaaatctaaaatacggccaggcgcagtggctcacgcctgcaatcccagcactttgggaggccgaggagggcggatcacctgaggtcaggagttcgagaccagcctggctaatgtggtgaaaccctgtttctactaaaaatacaaaaaattagacaggtgtggtggtgcacacctgtagtcccacctactcgggaggctgaggcaggagaatcgcttgaaccgggaaggcagaggttgcagtgagccaagatcatgccattgcactccagactggacaacaagagcgaaactccatctcaaaaaaaaaaaaaaaagaaacaaaaaatctaaaatatcccatggtgcagattcactgcagtgcccagggcacctccacacgcagtttgggagccacagtgctagctgttacacaggtgtagtatcataccagtcttgtgcatcccccaagatgcattgggcaatgcagtcctcatagtaggtggccaacaaatattttatgagcatcttaatccttatttcctgatgggccacaaacgccacaagttcaggagtgttctgagttccctggtccagcaataattcaaataaaatccattttaacatcttctggggatgctgtaaaggatatatctgtactgagtggaggttggcttagatgaccttttaattcccttccagggctaatgctctttaattcaatagcagcaacgcgcaacataaagaacaatatgaacacagttgtatggcagtggtgaggatgtaatgtctcaaacccccatgccaaaatattaaaaatttgaattctaacatgtagaatttggttggagtaaggaggtggagacataaaactgctgtttagttaatatgatattaatgtattaattgatgaaccttcttagttgccacaaaaattgatcatatcgagtaggacaccaagaaaaccacagtaaatgccaaaaaaatagaagtaacaataacatatctgatcactatgcaatacaactaaaaaatacaaattaaaagactaaaaactagaaaataaaactccaccattgggaaattttaaaactccccttaggtcaacaagaaaatcaaaaccaaaattctaggccatgtagaaaatgatgtgaaagttctacacgtaaaatttttgagtatagataatacagtgcttaggaaaattcttcaacttaaggtttttttgtttgtttgtctgagacggagttttgctcttgttacccaggccggacgtctcactgcaacctccacctcccaggttcaagcaattctcctgcctcagcctccagagtagctgggactacaggcgtgcgccaccacacccagctaatttttgtatttttactagagacggggtttcaccatgttggccaagatgttctcgatctcctgaccttgtgatctgcccatcttggcctcccaaagtgctgggattacaggcgtgagccactgcaccgcccaacctaagtttttgtataaataacagaaatgaatgaaaataatagggccgggcatggtagctcaccctggtaatttcagcactttgggaagccaaggtgcgaggatcacttgaggccaggagttcaagaccaacctgggcaacatagcaaaatgctgtctctactaaaaataaaaaattggccaggtatggtgatacgcacctgtagtcccagctacctgggatgctgaggtgggaggatcacttgatcctgggaagttgaggctgcagtgagccatgattgtgctactgcactcagcctgggcaacagagtaagaccctgtctgaaaagaaaagaaaatcatagaaattttgtatcatgcttagggagttataagaggaacaagaaaattaacccagggatatcagaaaacctgagaaaagtgcctaatatatagaaagcagttagtagatactagctgttattatttgtcagaaggactgagaagtttctatttcagtgttatttttgagtggtacagaaaaatctacagtgttacatttagaaagtaaagttcatttttgaaacagttgaggaaatttaagtacggactccatattattaatagataatgatattaatagataggtgtgataatgttattatggttgtataggaaaatggttacatagtaaattatgtattatggttgtataagaaattccctttattctcagggaatatatgctgatatattctgaggttaagtatcatgatgtctgcaatatactttttattttttagacagagtctccctctgttgcccaggctggagtgcagtggtgcgattgtggctcactgcagccttcgcctcccgggttcaagtgattctcctgcctcagcctcctgagtagctgggattacaggtgtgcgccaccacatccggctaatttttgcatttttagcagagacggggtttcaccatgttggccaggctggtctagaactcctgacctcagttgatcccctgcctcggcctcccaaagtgctgggattacaggcgtgatcctgggtttacttttgatccctcttgaagcttcctaaaatggtagtaaacatatatacacacatacacacatatgtttatatatatgtttgctgtcatgtaaaataacagtaacatatgtcatttatgtgatatatgcaaaactctgaaggataatgagagaataaaagtacaaacaagagcaacaaaaattttggatcctgaaaagatggacaagaacgttaaattctttttttttttaattttaatttattttttattattattatactttaagttttagggtacacgtgcacattgtgcaggttagttacatacgtatacatgtgccatgctggtgtgctgcacccactaactcgtcatctagcattaggtatatctcccaatgctatccctcccccctccccccaccccacaacagtccccagagtgtgatgttccccttcctgtgtccatgtgatctcattgttcaattcccacctatgagtgagaatatgcggtgtttggttttttgttcttgcgatagtttactgagaatgatggtttccaatttcatccatgtccctacaaaggacgtgaactcatcattttttatggctgcatagtattccatggtgtatatgtgccacattttcttaatccagtctatcattgttggacatttgggttggttccaagtctttgctattgtgaattgtggcattattcacaagaatgttaaattctaagccaaccagtagagaaagccagtatttcccatagagcctcctgaagacttggatttgggactatagatgcatctgaaagtgtgaagtatggggcttaaataggagagttggttgaacttcctaagaagcaattagatccccaggcccccaccttagcttttgtgcaataggacagacaactgccctctcttattccattttggaaactgaaagtttgctttctgttaagggtaaaacaggcttttggattaggatacaccagccagagttgaaagtagcgtgtataccactgaaaatatgggattaaatgaatgtttacataccagatacaggggtatccaagcttctccccacactaggatccaacaacacaggtggtcaggctcaaataccttccaggcaggagagtgggcagtccttctccagagcctctgaccagctcaaaagagcagttgtcgggggctctttgaatgacagtcggccagatgaccctatactgaaggccatagtggacttcagacagcttctgagtaccttctccttaagtaggagcagaaaccaagtattcccagatgtctaactcaaaaaagactagactaaatttgaaggaaaaaagacaatgtaaggagataaaaatgttacatgtcccaaaaaattctactatcatttatgttctcagtaagaacatataatatgtacatatatcttatccctcagtgaaagaggtactacattcatgaaacaaaaaatgctattaacaaaaaaaaggatattcaggccgggcgcagtggctcacgcctgtaatcccagcactttgggaggctgaggtgggcagatcacgaagtcaggaggtcaagaccagcctgaccaacatgatgaaaccccatctctactaaaatacaaaaattagctgggcatggtggcgcgtgcctgtaatcccagctactcaggaggctgaggcaggagaatcgccggaacccaggaggcggaggttgcagtgagccaagatcacgccattgcactccagcctgggcaacagaccgagactctgtctcaaaaaaaaaaaaaaaaaaaaaaatcaaatgattaaaagtactcttagaaattaaatatataagtttaaaattcagtagaaggattagacagtgaaatttagactatcttccagaaactaagcaaaaagacaaagaaatggaaaataagggagaaaagatgaaaagatggatcaggctagaagcaatattcaaataatagagtttgcggaaaggaaaacatagaaaacaggccagaaaaaataaggaagaaattaaaggcagttacccacaattgagagaaacaaatgtctccattgagagagtctaccaactgcccagaacagtagatgagactagaccaacactaaggttcatcatagtgaatttcaaaacagtgggaacaaaagacagtcgagagggggaaaaaagttgatatacaaagaataaaaaatcagagttgtttttggacttctgaataactacactggaaactggaaatcaatgcaacaatgctttcaaacaataaagggaaattatatctaatctacaagtctgtatcaagccaaaccgctcattgaatatgaacatagaatagatactttcagatacacaagatcagataaacaaaacatttgtctcctagtcaccctatgcaaaccattggaggatgaactccagaaaagtaagagtaaccaagaaagggaaagagatggaatatagggaatgggagatcccacaaaggagagattgaaaggcatcctcaaaacagtagcgaagggaagcctggggtggcagctgggcctgaagcactgaggatgactagaacagactggatccaggccagagggctctaggacagattgtgttaagatgaaatggcttgaatacctaatgtgtctgaacatatatttaggaggtttagacagttggcagagagtttgcgattaaattattgataagtacatagagacaaagtagaacaacagaaaagacagttgttaattccagggaaaacaatgttgtacaagaaagaataagtaatcctagtatattacatggcttacctagatacagcaattaaacagtcaaaataatgtcaacactggatgtagatctaaccaaaattatagtataattatgttgaaatggtggaaagatagggaggcaagagtttgccatgacaggggtaagggggctcacagcagtgaaagagccaaatcctcatttaccgagcaaaatgggaaatatatataatgcctaaacctgaaaagatcgagaagtcaagaggtgacaatatgagcacgttattttaacatacagaggtaactaaaagtatcaggtaagtctctacggagtatagtatggaagctgggagcctgttaattttcataacaagccttggaattatttggctctttaaactatgttcatacataattttactcaagtgaaaacgttttaaaaagaacaaaagtgctatgagaatgggcagactgggtttttaaaggacgagtaggagttctataggcctagggaatggaggagtgttcgcgcaggtagagaaaagaagactagcggtaagccaggtgtatcctggctctaaggaagcttgggatgtaggatatagtcacacttaagtatatgggcttttctcccttggtgtctgtgttgtttagaattgaagacatggaccttttgttactgataaaattataacctattactatttttggttattgttttaacataacattattctttgaattgatctcaaagagaggaaaatgagaggtcactgaaatgaccctggcagtaaaatttgctgaaaagcagcgtcctttacaagtccttacctccgaccgcaaaagagtcttctaaagaccactctcagccctcaagggtccttgcaagtcagtgacaccacaggaaatgggaaccttgccaagaattagggaaattcaggtgtctgcaagtccctaaaccctagggccaaaaaaaggatttggcagatgtttgtgtgtcctggaggcagatggatgaaagtatcagtaggctccgtggcttaagtgctagtcagtgctcgccattggtcttttgcagtcttgtcacttctgtctggaggcattcagagagctgaaaggtacacagtgcagtggtaacatctggaattgacccctggctccaccatcttcatgattagtaaagtcactaagcccctttgagagcaagatcaaggcagtcacagtcacaggggcattatgagtatcacgtaaagtcatgtattcatatatgggaatgctttgtaaatagaacatttctgtataaatcttgctttcagttagtgagtttgtgtattttttgagttggtctctctgtaaatgtgccttctttccctagtacatttattattactgagtccaggtacgtttgtgtattagttaaggtataggctaaggtactataatagaccccagaatatcacagtttaaacatggtagaaatttgtttctccatgtaacagtctagagctgcaccatccagtgcggtggccactaagcacatttgattatttaaatgtaattcgagcaaaataaaaagttaactgcctcagttgcactggccgcatttcaagtgcttagtagcctcttggctagaggttactgtattggacagcacagataaaacatttccatcattggttgggtgtggtcatcctatgtgcttatgcgtatcagcactttgggaggccaaggtgggcagatcacttgaggtcaggagtttgagaccagcctggtcaacatggtgaaaccccatctctacaaaaaaaaaaaaaaaaaaaaaaaaaaaaaacccaaaaattagctgggagtggtggcaggtgcctgtaatcccagctactcaggaggctgaggcaggacaatcacttgaacccaggaggcagaggttgtggtgagctgagattgtgccactgcactccagcccgagtggcagagcgagactctgtctgaaaacaaaacaaagcaaaaaaatgcttccatcatcacagaaagtttagttgggcagccctggtctagaggagtggtctagaacttgatgggtgctctgctgtacaaggtcatccacaggcctgagttccctaaatattattgctctgccattccctaggtaaggattcatagcattttttgtgccatggatcactttacagagtgacaaaggctagggaccacttcacagactaatgcttttaaatgtgcaaaatcaggctgggcgcagtggctcatgcctgtaatcccagcactttgggaggctgaggcaggcagatcacttgagatcaggagtttgagaacagccaggcccaacatagtgaaaccccgcctctactaaaaatacaaaaattagccaggtgaggtggcacgcacctgtagtgccagctactcaggaggctgaggcaggagaatcgcttgaacccaggaggcggaagtttcagtgagctaagatcacaccactgcactccagcctgggagacagagtgagactccatctcaaaataaataaataaaaattttgtttaaatgtgtaaaataaaacacagagttacaaaggaaattaattatgttgaaatacaattatcaaagtattttaaaaacccaaaatttatgacatagtaatatgtactttattaatacatcaaataatgatctagtgtcaattctaaaggctatttttgtaattccaaagtagtgatgagtatttgtgatatttcaagacaatccataagtataatgtgatatgaaaatacctataatttctgttattgacagagtcatggacactgctaataatgtggtttgttccctccattataagtgaaggaaatgctaaagttatgggtgttttttgtttttgtttttgtttttgtttgtccttccaaatttaaagaccagtgaattctattcatggactccttgagggtctgaggaccccagggttaagaagccctgctgggaattattaaagctagcccagcaattttaagtccacactctagatgtgggaaggaagagaggaaatggaaggcaaccatttcctgcttaaaggactggacctggcagttgctcacatcccatctcattggccaacattagtcacatggggtgtaaggcatgctgggaaacacagtctgtagttgggcaaccctgaaccttgctggtaattaaaaaaaaaacaaaaaaacaaaaaacaaaacaaaactgggagagttccatcagtaaaaggaagaagggaagaatggctagtaggataaacaacagcctctaccacagcttggctcatctctatggaattaaaacaaaagtgttttttcaaaaatgtgctgtttactctccgacactttgtataccttcaggtctacagcagatgtcaacaggaagcatttcactcttactagctatggacaggcccctatggtggtgccagttcgtgaggcacacagtgtctaaggtgggggggtgtccaatcttttggcttccctgagccacgttggaagaataattaccttgggccgcacataaaatacactaacgatagctgatgagcttaaaaaaaaaaaaaaagaaaaaattcatactgttttaagaaagtttacaaatttgtgttgggctgcattcaaagccatcctgggccacatgcgttagacaagcttggtctaagggatatagctttattttttaaataagagacagagtcttgctctgtggcccaggctggaatgcagtggcctgatcatagctcactgcctaccacaaattcctgggctcaggtgatcctcctgcttcagcttccgaagtagctggtgtaccaccatgcctgctaatattattattattttcttgtaatagagacagtgtctcaccatcttgcccaggctggtctccaactcttgggctcaagtgatcctcctatcttgctttcccaaagcgctgagattacaggtgtcagctaccatgcacagccctatgtagcctattttgaactaataatcctcagttctgtgcctgtagttgctgacagagccaacacttcacaagtgttggcttctgaagtgtgtttgtctcttgcttaaagcaaactcggtacaacgtgatctgcacttacaaaactaataacaaattaataacaaattagatctctgctcctgttaccaatgaccaatattctatgtgcaagagagcataagtagaaggagacagactttttccaaacaaacagatcccttgagcaaatgccctttaaactttaaaataacaacccccttgggttgtgcaggcctttaacttttcagagagctttaagtaccttaactcttcttattttattaaaacacccaggtcatgggttggttttttttctttccaagttagttaaataaataagcaattatgacgcagcgccacatggccaacagcttttagcttataaacatagagtttgaaaagcagtacttagaggccaacttggttggctgctgccggcaggagggagccgagctgttcccggcccagataacacttaaagggccaggcaggccctcatgcatgcacatttgtctacatccagggagctgttttttttctgatgcaacatgaatttcagtgtggttttttttttttttaagtgccaaattgtgagctcctgatggccagccacttgtgtcttataagcctccacaaagcctggtgcaactccttgtatgtcacagacatagacatgtttgctgacaaattgtttgtattttatgagcgtttataatggccttttaagtaagtgacgttttagagtttgctgaatgaagagtgatttttatttagtctcagaggcacagttgtttggtgtggttggttttttttggccacccctcccccaatctatctctaattttaagatgtgattcactaggaaaatatgattctgttaattgaattcattttatagccaacttttcaggaacctatctatttctgtaaagtgagagccacttgtaaatgtaccgtttggtgccagcactcaaattttccctgactcagttgctccagtggtgtttaaatatcttcccataaatcaggcagccagcgctccatacttatttactgggtcttgtgattcagcccaggatcctgatagtgatcttggatgggtgatataaatagactaggatttgccaatggctatttttatcagggaagctttctaagttgatttctttgaacccagaacaacttcctccctctggcttcccctgttttcctccaagactagggagatcctttctttattctgcccgcccatcttctgcccctcccccagccagctggtgtctgcagaaattagaaggaaggtacgtgcctgacacagagttgcctgaaatcatatatctttaccccctttcaggatcatctttctttcatccggcccaagaatggcaccttccccgcccatcaggccacctgcactcaggagtcggctgcctgtcctgaaatagatctctaccagctctcaagcagaacaattccttgcattcatacttgaatgtataatttgtgttattacctcttatttgtctttgtaagtttgtccctgccccagtttaaaaaaaaaaaaaaatctgagttactgctactgaaccaaagggcctcattcgaggtcttctttctccccaccccctcccccatcccagtgatacagatgctgccttgtctggtcaggccttcagggaggatgtcctgaccccctcaaccccccatctccaaagctgtcccctcgctctttgtgcaactcgccgcccacatccagcacagtaaaagcaggctgtcagctgggagaggctcgccttggaggactgtcctttctttacatcctcttcccagggcttcatgctgcaaaacagcacattctcaacatgaaacaaaaatggattctgttttctttttcacctagtgtttttggccatactgttcttggcagtcagacttccaggcttggggtagaatcgatagcttaaaagataaatgtttacactggtcagcaatgtgccatttggagccttggtgcccctggataatttgccagagtctgtggctttgtgtccggaattggtgggttcttggtctcactgacttcaagaatgaagccgcggaccctcgcggtgagtgttacagctcttaaggtggcgcgtctggagtctgtcccttctgatgttcagatgtgttcggagtttcttccttctggtgggttcgtggtctcgctggctcgggagtgaagctgcagaccttcgcggtgagtgttacagctcataaaagcagcgtggacccaaagagtgagcagtagcaagatttattgcaaagagcaaaagaacaaagcttccacagcgtggaaggggacctgagcgggttgccaatgctggctcaggcagcctgcttttattctcttatctggccccacccacatcctgctgattggtagagccgagtggcctgttttgtcagggcgctgattggtgcgtttacaatccctgagctagatacaaaggttctccatgttcccatcatattagttagatacagagtttcgacacacaggttctccaaggccccaccagagcagctagatacagagtgtcgactggtgcattcacaaaccttgagctaaacacagggtgctgattggtgtatttgtaatccctgagctagatataaagactctccatgtccccaccagactcaggagcccagctggcttcacctagtggatcctgcactggggctgcaggtggagctgcctgccagtcccgtactgtgcgctcacactcctcagcccttgggcggtcgatgggactgggcgccgtgagcagggggtggtgctcgtcggggaggctccggccgcacaggagcccatggcgggggtgggaggctcaggcatggtgggctgcaggtcctgagccctgccccgagggaaggcagctaaggcccagcgagaaatcgagcacagcaccggtgggctggtactgctggggtactcagtacaccctccgcagccactggcccaggtgctaagtcccccactgcctggggccagcagggctggctggctgctccgaatgcggggcccaccaagcccacacccacccagaactccagctggcctgcaagcgccgcatgcagccctggttcccgctcgtgcctctccctccacacctccctgcaagctgagggagtgggctccagccttggccagcccagaaaggggctcccacagtgcagtggggggctgaagggctcctcaaatgccaccaaagtgggagcccaggcaggggaggtgccaagagcaagcgagggctctgaggactgccagcatgctgtcacctctcagcttcacccacccagtgaccttgagtctccttaactttccaactagcctacctcccagaggtcccccacacccctctcccctccttcggccagccctgagggccaggccctttctcacttcctgaaccaagtactggaagtagaagaaactgttgtcaggctccgagttccacctctgggtcaagggctccagagcctggtgctgcagcttggccaagggaacccaaaaaccaggtcagcagtacatccactctctgagctttggttctgtcattgcacaggattaatgttccatctcagattaactctgaaatcaaatgaggtaatgtattagtacttgtgtgtacagaattggtgggttcttggtctcactgacttcaagaatgaagccatggaccgtcgcagtgagtgttaacagttcttaaagcggcacgtctggagttatttgttcctcctggtgggttcgtggtctcgctggcttcaggagtgaagctgcagaccttcacggtgagtgttacagctcataaaagcagtgtggacccaaagagtgagcagtagcaagatttattgcaaagagctaaagaacaaagcttccatagtgtggaaggggacctgagcgggttgccattgctggctcgggcagcctgcttttattctcttacctggccccacccacatcctgctgattggtccattttacagagagctgattggtccattttacagagagctgattggtgcgtttacaatccctgagctagacacaaaagttctccaagtccccactagattagctagatacagagtgtggacacaaaggttctccaagtccccaccagagtagctagatacagagtgtcaattggtgcattcccaaatcctgagctagacacagggtgctgattggtgtgtttacaaaccttgagctagatacagagtgccgattggtgtatttacaatcccctagctagacataaaggttctccaagtccccaccagactcaggagcccagctggcttcacccagtggatcccgcaccggggctgcaggtggagctgcctgccagtcctgcgccgtgcgtctgcactcctcagcccttgggtggtggatgagactgggcgccgtggagcagggggcggtgctcgttggggaggctcgggctgcacaggagcccacgggaggcagaggctcaggcatggtgggctgcaggtcctgagccctgccccgcggggaggcagctaaggcccagggagaaattgagcgcagcaccagtgggccagcactgctgggggacccagcgcaccctctgcagccgctggcctgggtgctaagcccctcattgcctggggctggcagggccagccggccgctcccagtgcggggcctgccaagcccacgcccacccggaactccagctggcccacaagtgtggcgtgcagccccagttcctgctcccgcctctccctccacacctccctgcaagctgagggagccagctccaaccttggccagcccagaaaggggctcccacagtgcagcagtgggctgaagggcccctcaagtgccgccaaagtgggagcccaggcagaggaggcgctgagagtgagcgagggctgcgagggctgccagcatgctgtcacctctcacttggagtgctttatgaaacgtagagagcataacaacagcaagaatatcgtagctgctgtcttatgaacatctactgtgtaccaggcactgggtttctttttttgaggcagcatcttgctgtgtcaccactatgcagtcttgatctcccacgctcaagcagtcctctcacctcagcctcccaagtagctagaagaactacagctactcatgtgccactatgccaagctaatttttttttggttttttagtagagacaaggtctcagccactgtgtttagtttaacacatgactgtctcatctaatcctgataaatacccttgaaaatattaacaccgctcttttataggtaaggaaagtcaggctcaaaaagatgaagtaagtggcccaggatgacaaacgaaggaaagtggttgagtcaagattggaatctggccagtgtgacttttagacccatgttctcatctactaagcaaactgttttccttcccataatcaggatttgcaagagaagcataattaactttgaagatgggcgtttgcaattcattttcttgggatgcccatctgaccttcccttttcagatcagcaggcagtttcctgtgcttaggactcattcccctctgcagaaggaactctggtgattttcccaccgggagagggagacatgagatgtggcttcctgttccaggaaataccgcccagtctttttacccaccctcagccaccccatgcactatgttagtcatagtcagtgcatggcgctagccagctctatggtgattctgccgggtaagccactagctgttgagatgaccaaagctcagaaagtgcttgctgcatttctgtttctgttgttgacagtggcctgatatgcatagcatacttacatagctccacttttcagagcctctggcaggtacaaattaatcaatcccctggcacagcacagtgctaaccacaaggagaaaagaaagagaagtatgttccacgcaggagaaactgccaagttgccaagtgcatctggtctaggtttttttttttttttttggagagagagtctcgctctgtcacccaggctggagtgcagtggcatgatctcagctcactgcaacctccacctaccaggttcaagtgattctcctgcctcagcttcctgagtagctgggattacaggtgcgcaccaccacacccagctaaattttgtgtttttagtagagacagggtttcaccatgttggtcaggctagtctcgacctccttacctggtgatctgccctcctcagcctaccaaagtgctgggattacaggcatgagccaccgcgcctggcctaggttttaaaatgcttcgttcctgagaagatctgatagaagttgaattttagttttaattcaagaaaagggacactataacacttagccacttttcagtgtgttcatgtctcaactgagaggtggtgtcggtgtttctactcactgtgtctcttgcgcgtgtgtgtgtatgtatgtatttttgagacagagtctcgctctgttgcctaggctggagtgcagtggcacgatcttggctcactgcaacctccacctccccggttcaagcgattgtcctgcctcagccacctgagtagctgggattacaggcccgtgccaccacgcccagcaaatttttgtatttttagtagagacggggttttgctgtgttggccaggctggtcttgaactcctgattacaggtgggattacaggcaggaaccaccccgcccagcctcaagtgtatattgacaagacattgtcccaggggtaatgacagaattgaaaatggtgacatggggcagtgggctgcacggccacatgtatacattaagcctcatagaactgttctctctttctctctctctcatacacatacacatcagttttatcacatgtgaatttttaaaatattttaagtaagatggacccttttcctcaaagagtgtaggtacagtttaatgggggataagacaatgaattctcttgctgggctaaagacagtctaaaccacaagagaagttgaaaaaagcagtgctgtggggcttgaagccagcatgagacactgctggccacgggaagtctcagccttgatggttgggtagtgtgtgctgaagatcagaaagtttgtggaagggcagggtagaggcatgggggaaggacatacgttttgggaacagctcacattcctttttaaaaaaaaaaaaaaacaaaaaaacataggacatagttcctaagctgatgtttgttgagcaccaactctgtaccaactgctatgttagtttctggggactctgagatggaaagaatgcatccccaactcatcagggaagatatacagatggcaaataaacacatgaaaagatgttccaatagcattaggagatatacctaatgctaaatgactagttaatgggtgcagcacaccaacatggcacatgtatacatatgtaacaaacctgcacgttgtgcacatgtaccctaaaacttaaagtataataataataaaattaaaaaaaaaaagatgttccacatcatatgcccattcaaatgactagataccatgtaaacacctactagaatggccaaaatgcaaaacactgacaacaccgaatggtagtgagaatgtggagcaacagaaactctcattcattgctggtgggaatgcaaaatggcacagccacttaaaactaaacacactcttactgtgtgatccagcaattgcactccttgagatttacccgaattagttgataataggtccacacaaaaacctgcacttgatggttatagcagctttattcataattgccaaaacttagaagcaaccgagatgtccttcagtaggtgaatggagaaataaactgtggtccatccagacaatgaaatattccatgataaaaataaatgagctatcaagccattaaagacatggagaaagtttaaatgcatattactaaatgaggcttggcgcagtggctcacacctgtaatcgcaacactttgggaggctgaggcaggtggatcacttgaggtcaggaattcaacaacaccctggccaacatgatgaaaccccgtctgtactaaaaatccacaaattagccgggtatggtggcacgtgcctgtagtcccagctactcgggaggctgaggcaggagagtcacttgaacctgggaggtggaggtttcagtgagctaagatcgcaccaccacactctagcctgggcgacagagcaagaccctgtctcaaaaaacaaacatattactaagtgaaagaagccaatctgaaaaaggcagcatactgagtaattccacctgtatgacattctagaaaaggcaaaattatggaggcaaaaattagttggggatggtagcgcatgcctgtaatcccagctactggggaggctgaggcaggagaatcgcttgaacccaggagatggaggttgcagtgagtcgagatcgcatcactgcactccagcctgggtgaagagccagactccacctcaaaaaaaaaaaagaaaagaaaagaaaagaaaaaaacaatgatggagacagtaagatcactggttcaggttaagggagagaagaggatgaataggtaatgcacagaggatttttgaggcagtgaattaaaagaaaaaaaactcgatccctgtccttacggatctctggtctagtcggagtcagcaggcacacagaggcctgctgagatggagaatcgatgctcagattcttcctctgtatccagaagaagccagaggagggtactgcctggccctgggaggcttcactagaggttttcgagaggaagatgcacgtctaaggtgtgacgggaaagggccagaaagagaatgagggaagaacattccaagccacagaaatggcacatggaagagagcagagatgagaggagaaaccatctgtgacttaggtggctcagcagagctggagagagtcgggcaattgagttgaagcacaggctggggccgtgccatgcaaggctttgccagctatacaagggcaccacatgccgtggggagaaccagagtgtttttagcagggtggtgtgatcagattcctacttcagaaagatgggcacagtgtgagggatggattggggtgatcaggctggctcaaggagtcccagtcagagagggcaggctagaaagaagtagacaattgaatcgatgttgaaaatatagaatgtacaggctctggtgattggttggatggtgagtgggagagaggaaggggaccaaggtgcttccctggggtctagtttagatgggttgagggcggggcaatcagagaaagactagttgtagagagagggagcaggaaaagggaaatagagctagaaagttaattagaaccatgctgtgaggatactgaatgccaaggtcaagactgtattgaaaaacctgagccgaggctgggcacagtggctcacgcctgtaatcccaggactttgggaggccaaggtgggtggatcacaaggtcaaagagatcgagaccagcttggccaacaatggtgaaaccctgtctctactaaaaatacaaaaattagctgggcgtggtggcatgcgcctatagtcccagctacttgggaggctgaggcaggagaatctcttgaacccagaaggtagaggttgcagtggcctgagatcgtgctactgtactccagcctgtcaacagagcgagacaccctctcaaaaaaaaaaaagaaaaaaaaaacctgagacaaaacaatcttagtgcagatcactctttgttactctgtttctttgctacatcagactttgaccagaacctgagatggagatggacatctgggagttgctggattctagaataaacatttgacagcctttcccagagtggcccatacccaaattgataatcaggattgtggaagcatagggaaacacttgataggagctgaaaagcagtgtacttttaagagaataactttcactgaattctaacaattatttctgaaagtattgaattcaactggtaagataaacaatcttaatctcctatgaccccaagtttctcagctggtaaatgaaggaaaaagacctgttgatctcagaattctcttgcagctctgcaattctagcctaataaaaattttcatcaagatttaaaaaaaaaatcttatataagtaaatatagagtccagtgctatttttcattgatcttcaaacatttttttccccaaattttaatgctgaaacaccaacttgccaaattttccagagtgcaaatcccctgcccagtgagctgttattatttgaaaatattgtggcctctaaagctgactttatctttaaaaaacaatttttttttaaccagcaaaaggaataaatttccatgtttataccaatgagtttcctgaaactaagaaaaactaaccattatattgtttcatgtaaggaacttgggtactatcataatccccattttaatgatgaggaaataaataggcgaaggtaattatttcagactgtgtttccttgacgcagtatttctggatggtgaatcttactcagattttgttttgatgctattcttgggattgacttgagaagcaccagtggctgactctttctttctcagtgcggaggggtaaattgggaacaagctgtcttgctttcatcatattatttgctgtcatcatgaaaggcaggcagtgagaggagttttttttttttttttttttttttttttttttttttttgagacggagtctctctctgtcgcccaggctggagtgcagtggggcgatcttggctcactgcaagctccccctcccagattcacgccattctcctgcctcagcctcccgagtagctgggaccacaggcgcccgtcaccgcgcccggctaattttttttgcatttttagtagagacggggtttcacagtgttatccaggataatctcgatctcctgaccttgtgatccgcccacctcggcctcccaaagtgctgggattacaggcgtgagccaccatgcccagccgagaggagtttttatactaccttaagcatcttttgtttcaaaccaaatcatcttcacttcctccttcccctccccacttgcagataatgacagattttttgggatcttaccacggaaatagctttggggccaccttcatacagctcaaggctgtgctgatgttgcaggagtgagggaaggagagatcccgtcccatcccccagatggcagctgtgtgtttgagacttttgcacatgaatttgtttaattttcaccaaggtcttgtgagacaaggaaactgaggctcagagaatgtcagtaaacccacccagagtcacacagctaaaagatggcagagccaggattcgaacccacttaggcagaccccagctcatgctccacacctcgatatgctcctctaccatgagtggcaagccctggtttattaaaactttcccagcagtgttagagaactcaaatgtccgaaaggccattctcttccattagtttattcactcagtaaacaagtggagctgatacatctacttccctcctattttgagggatattttgaggattaaagagctataattctgcttatagctcagcagcgagtgtgtgctaaccagtagctattatggctactgatggtggctgccgtgccaggcaccataccggatgggctggggacatggggatgaggaagatgccgtgctggccctggaggaacacacacacaggcagcagaggaaatggccccacagcaaacaacaagtgtgggtgaaagcagggcctcagcacacacattctacacttctgagctcgccctgtacctcacagcagccattatggccacctgacaagcttggtctcacagtcattctgtggatctgggccttggcttgtcagtaactggcaatgtgtttgggaagtgatttctctttcttcattatgtcagcatttaataataataaagaaaaagtcagcatttagtaggagccaccccacacctcacccgccagcattcttccctgagaagtaggcacagttggttgtgagtcttctccatggggccaacattctgcaaacaagtgagcatttccttgcacttaaggctgcctattagcatcaggggagtagtagttgctccaggccccacgcaggagcttgagagggagaatagcagagtggacagctgtagaccattgggttcccagtttccccttccatgatatggggaacatggtaaaaatgcctgtctcgcagcaatgctgagacatagttccaacagatgacagatcatgagataatacatgtgcagcatttcagatcagtagagccctaggcagccattggttgccataggcagccatgagttgagaaggccagtgccacaggagcacaggggcctaagaacgctggccatacgtgctagatgctgacaaagaccaggggaaagcagagtgtgactgggaccggcacaggaaagggtggctaagagtcacagagggtgacctcacctggactcataaacccaaagatgagggaggggtatgtggtggtggagaaaaagaggtgacgttttagactggggaaaaggcgcatcgcacagcagggcacggggaaggagcaagccaagcaagggatctgcccctggtctgctgccagggctgccgtgggagcagcatggcctggccagcccaggaagggtttttttgtttttttttttttaagacggagtctcgctctgtcacccaggctggagcacagtggcgcgatattggctcactgcaagttccacctcctgggttcacgccattcttctgcctcagcctcccgagtagctgggattacaggcgcctgccaccacgcctggctaattttttgtatttttagtagagacggggtttcactgtgttagccaggatggtctcgatctcctgaccttgtgatccgcctgcctcagcttcccaaagtgctgggattacaggtgtgagccaccacgcccggccccagcccaggaagttttgtggggaattttcctgacatggaatgactctagactgccgccgctgccgacaacaataacaaagtagataaagcctactggtatggcactcaactctttatgccgttggtcctcactgcagtcctgacgtagctaccattgttatctgcattttgtagaaagggacactaagggccatagagtattaagggacttgcccctaggttatcagctaataagtgaccaagccagggttccgtttcagatctgtctatccctagaactcaagcccttaacccaagcattacaaggttattcttgggaggagaattgtatgccttccaagtgcattcacctcctttcagctagctgtgccctacttgggaacagccctgtggaagaggtaagtcaccacgcagaggctggcagatcatgttgatggagtatcagggaactctgacaccctgaagctggggagaatcatgtatttttagaactgcccaccttttgtgccttcattcctttctgctaactataggtgggtttacagtaatttggagatgattctgggcttgctaggggacactggggaattccggaataagctcacgatttattagtgagatgagcggatgagcctcatactgtgcacagttctgcaggtcggctgagttagtcaccaggacttaggcaaggccactgagacactcctgtaagaagctggacagagctgggaggggcttgaaccagaaggaatcgtgccccaaggcagcagacataattattcatagaatttagactaaaattctagaggtcatttataccaaaatggtctacccaaagctttcagtgggtaatttcatatgactgtgaacagtaaattcaagtaaatcgtaaccttcaaaatcgcctgtcaaatgcccaccccaggcctagactgctctgagcttgtggtacagactgtgaacatgcatgctgttttgatttagtgtctgaaggcttcctttcacaaattagtagatagctctggatctagaacaaacgtatctgaggtcaggtcccagcccgccacctaccagccgcatgacctcaagccacttgcttttcctctctcagccctgttttctcatctgtaaaatggacacaatgataccttttagggcttttcagaggtgccgatgaaatagcctgtactttataaagtatgttgtaaatgttgctgacataattttgtgtcctgtaggaaatgcttccttgggtgtttgtattatagcccaatccaagtcatccctgagaacatccccaggttgtaaggattagtcagaagtcatgatgactgttctatataaatatttggcctattaactaaaattagtacctttccatttcttctctttcttgggcggggcagcgggggagtgcaggggaggggaaatagggaacgttcaattgtgttttaagtaatgctcataaaattcttagccaaagatgatcttgccctccaccttggtgacccaccgcatacggggtacatctatctggcctgtctctaggcctagacagaagaaacagggaggattattgttaacttttaccacatgtatgacttgttcccggacaacccattcttcctttaggcagaggtgatatgcactgaagtgtttgatttagagtgatggaaaagtctgtgctgccattcctcagggagtcctaaacgttgatttgcctttgggagggccaggcttcacgaaaacctgatttacggtgttgctctgggcctgatttcctttgcacactctggaggaagtgctctggtgatgttggcactgagcaagcaacaaaggttttaaaatgtcggccctggaaacaaaactgtaccttgtgatgttagaataattataccacacttgatctctgattacggccaaaacagcagttgctaaatccagctaacatggaaaaactagaaaaagtgaggggaaatcagccaaatgcatagcaagggatggggaaagcggacctggactggacacagaatcttctgtttccacttgtctggtaataactgcaacacttcatggtccccagccccagcgcccaccccttgtctagagccattgcgctctgcatgttgacactagctgtgggaactctgtgatttaaagttgagttgaaagaactgcttttatcatttcaagtatgtagccccaggccaaaacagacaaaacaattttttaaagtctcagttcaaaagcagcttgaaatattctctgttccatcaaaaggaaccccaaatctctccactgttctgtgggcccctttcctctgattgtctacctggcaggctccccttcactagctgtgctgtggcttagttaagctgaagttgaaacacagacaaaggaaggcattgctttccagccacaatggagaagcccattcccactcttgtccccactgggaaactgggttagagttctgagaaatgggattttggggtttcccttcaactgtgaaatattacagaaatacacaagttccatacacaacggtgatagctgctacatatttctcagaaaagcagaattctaataaagaatgtatagtctgttttttatgctttaataaataccaggcacagtgactcatacctataatcccagcactttgagaggcctaggcaggaggatcacttgagcccaggagttcgagaccagcctggacatcatggtgaaaccccatctctcctaaaaataaaaataataataattagtcaagaatggtagtgcattagtcgagaatggtagtgcatatctgtagtcccagcagctcgggaggctgaggtgggaggaccagttgagcccacaagttggaggctgcagtgaattatgatcatgccactgtgctccagcctgggcaacagagcaaaaccctgtcatttaaaacaaaaacaaaaacaaaaaaaaacaaaacaggcattctgagtcgatagcagatccccattgtcctgtcatcctccaggtgaggttctgtgtcttacagattaagaacatgaccctaaatcagcagcagatgtttaaaataacacagaaacaaacctcgtatattctatattttccctagccgcttcagaatttgctatgaaatttaagggtatttattcctctgtctgtgcaaatctcactttatttatttatttatttatttatttttgagactggctctgtcacctaggctggagtgcagtggcgcgatctcagcccactgcaacctccaccttctgggctcaagtgattgtcctgcctcagcctcagctgggaccacaggcgtgcactaccacacccagctaatttttttatttttagtagagatgtggttttgccatgttggccagggttgtctcggactcctgacctcaggtgatctacccgccttgacctcccaaagtgctaggattataggtatgagccactgtacccagccagtgaaagtagaaattatttatttatttaactattccttgaaaagaggaaacaaaatgttccctctttagcctgaatgattaactttactcataagaggttcacagtaagacatgtgatttttttttttttttttttttactcctttgcccttgtatgtgacagatgctcatttgtttgttgattaacaccttttacacagccaacattaatatctagttatagcctttttttttttttttttaaacggagtcttgctctgtcgcccaggctggagtgcagtggcgtgatctcggctcactgtaagctctgcctcctgggttcacaccattctcctgcctcagcctcctgagtagctggaactacaggtacccgccaccacacctggctaattttttgtatttttagtagagacggggtttcaccgtgttagccaggatggtctcgatctcctgacgttgtgatctgcccgcctcggcctcccaaagtgctgggattacaggtgtgagccactgcacctcgccagttatagccatttttaaatcaaaagaccactagcagctgctgaaaagttctgtcacctttaattcctcatgtgtagagactctacctctctcacaggattattttgagaatttaaaatgttattgtgatagttgactaggcttggtaaactgttcagtgctgtgctgatataaatgtgataactgctgctctgtttcccaaattcacaggcagaatatgaaattctgtaatcttgaatcataatcttcatcaagggccaggcaccatggttcatgcctgtaatcccagcactttgggaagctgaggtggtcagatcgcttgagctcaggagttcaagactagccttggcaacatggcgagaccccatctctacaaaaaatacaaaaattagccgggcctagtggtgcatgcctgtaatcccagctactcaggtggctgaggcaagagagtcacttgagcccagggaggccgaggctttagtgagccgtgatcactccactgcactccagcctaggtggcagagtgagactcaagtctcaaaaacaacaaaaaaacccccagacaacaagaaacataatcttcatcaagaactcttaccataatagaattttgactattttttaagatgctaatttataagcaataggattattagcaatgtccctgattctactacattttgtcaaagtggttattattggtgtatagcaaaactattgatttttgtatgttgattatattccaccagcattgttgacctatcttgttagttgtaacagtttgaaaattctttcagattttccacgtagacagtggtatcttttgcaaataacaatagtttatactcttgttgtctgtgtacctcatttctttttcttgttttactgcattcactaaggctacaaaataatgttgaaatgaactgcttatggaagattcctgaaattgttcctgactttgttaagaatgaatctaaagttttaccatttaccatcatgtttgctgtagattttattaaggaagttcccttttgttactgattttctgttttattaaaattgtgagtgaaggtaaaaaactttttctgcatcttttgagatgtttaattttttgtccttttataaaaactaatagtgtggtatattaaattactatatatatagtatatatatgtgtgtgtgtatatatgtgtgtgtgtgtgtgtgtgtgtgtgtgtgtatatatatatatatatatatacatacatatacatatacacacatttttttgaggtggagtctcactctgttgtccaggctggagtacagtagcacgctctcggctcactgcaacctctgcctcccaagtttgagcagttctcctgccttagcctcctgagtagctgggattgcaggcacatgccaccacacccagctaatttttgtatttttggcagagatggggtttcgccatgttggccaggttgaactcctgacctcaggtgatccactcaccttggcctcccaaagtgctgggattacaggcatgagccaccacgcctggcctttttttcttatattgaaccatccttgtcttcctgagataatgtcattctcttctacctgtccctgggtaactatttaataccatagttaagaatttgcattcctgggaactcatgggatatcatcagtggcactgaactatttttcatgctacataaacacctcaattatcagtattatcaggattgcatgggaaggaatacagagatctgtggtcataggcatgagagttacaatgtatgccccacaatcatatagaaggcaaacatatcaaagtttgagaaaattctatcctagaaaggattttaactgctttaagatttgcctgtaacaaatgggttatagtttaaagaggctgagtaacactcttagttttaatttaaaaactcaagttacagttatataaggcctttcagatgtcttttctatttcagatgttgtaacagccaacataggtaagattttgttccaaagcaggtattttcatttccttgtttgtgactacaaacacagtaatgtgttgcccgtatccatgcagaaatgcaggagtgggctgatttgtgatgcatcctgcagtcctgcctgtcatcttgaatcattaaatcttccctgctttgcctgttacttgaagatcacccacgtgtggtcccttctgcttcaattgtgggccttctgttgccttctcatgttggggaccaacatgagaagtaaacgaacaacttaatgaagtaaagttctgtttactcttctggtttgaaagataaccatttcacggggcaaggttttctgcactgaatcttctttatagcctgcaacaatattgacttcattcaacaaatatatcttgagctgctgttattaaatcagcaaggagcagcccctgcttatgtgcccaggtttattgaagtcataatggcacatactttaaaaaaacataagatagctatcttaccttcagaggaatcgcagtcagtcacttacagtcaccaatatccgggaagtcagatggtcacgtacctcctatgtgtcagccatcatcagagaccttgagaagcctacagagaaaaatgcttacctctgatatcacagtctgacatagagtctaccagaggacacaatacaaaatgcatatagaaagttaaaatagtttgggcgcagtgactcattcctgtaatcccagcactttgggaggctgaggcaggaagatccacaaggtcaggagtttgagaccagcctggccaatatggtgaaaccccatctctactaaaaatacaaaaattagccgggcatggtggtgcgcacctgtagtcccagctactcgggaggctgaggcaggagaatcacttgaacccaggaggcggaggttgcagtgagccgagatggtgccattgcactccagcatgggcgacagagcaagactccatctcaaaaaaaaaaaaaaaaaaaaagttaaaacagcattatgagaataaaatcacaattcagggacacagcagaagataagtcataaataagatgttggactcatgactgcatattcggtcagactgtcagctggagggagagaggtacagataggctttctgcagaatggatgggaactgcaaaggtgggcctggaggacatttcaggtagaagaaataccatatggaaggcactgtggaaaaaagggggcggtacattcaggtgacagtggaaactacacgtgtaggtggacaggagggcatgggagggggacggggcaaggaaggcctgggaatgaagaggctgaggctgacatcctggggcacctccaaagccagccaggttgaagagttgggagtttgctttgttttttaagacttaacaaataaatatttaaagataatatatagccctttttgaaagtaattaagatcattgattgggaggaaaaatccaataacatttaggaaccgtaacacaagagaagctgcttgcccctcctaccacaagcagtaaagcctatagatgacattgattttatgttcccagatacgtggcttcaaacagagaattgttttaagtcttagtcatatgaatgaagggccttcttcaaaatcaggacttagaaatacagcagcttgtcctgttggccttgggctggtagtcagatgaggtcaagggcttgttttcatgagggagacttgttaaatacttggaagtatacgatgttatcagcaacgtgaagtttgtccctgtgaccacctggctcttgaataccacagccttaaaaatagggaacttcttgatttttttctcataattgaggcttcacctggttagcaacgtcctggtctcttcagtggcaagcatggcaggggacaccccacacgtcatcgtggtagcagtgggaggggacagggcagaaaggaccagagagttgatgtctctgcccgaaggtaccaaggatgctgagatggctctgtgctcgtcagcccctcaggtgttggctctgtcaccttttgctcctttgcccttttcttactcaccctagcatgacccatctgcaccaccatcctcttgcccaggagacaggaggggcccagagacttccttctcactccttttcttttgaaagtgcatgtatgtgttttggacagaggaggaccttctacttggatcagaggtgtcgttggcttttttgaggacgcctctcggtcttggctggagggtggtggttgcaggcaggcctgagaactggatgacccatgcagaaagagccagcacagatgtgttataatacccttcccacctcagcagacatgactaaacaaactctgtctgctttgaacaattaaagcatttgtcagagcggctcccagagagagcgaggccctgcaagcagtggcatgctctcagaggaaagcagtgtgtgtgcggtgcgcgtgcagtccctgtgctgttagcaggctgcctggccgtactccgagaagcactctgcatcgccaccttctgcatttaaacagccagaatgacctgagcttgggtacaggagtgtagcttccagactgtctttcatcagttttgagaaacttggatgctgaattgggaaatgatgatttgctttaaagaaatgcaagaaatgcaaagataaatacaagaaaaaccccaattctttccagtcggcacccattccagacttgatggtgaaatgaatcccctcctctgagaccaaccgctgttgccctcctgaccccaccctccagcagtgacccccactgagccagtatctttctctcttcaatccttcttaataataaataataatttccacgttctacctttaaaatgaagcctgagcctgtaatcccagcactttgggaggctgagtcaggcagatcacttgaggtcaggagttcgagaccagcctggtcaacatggtgaaaccttgtctctactaaaaatacaaaaattagccaggcgtgatggtgcacacctgtaatcacagctacttgggaggctgaggcaacggtgttgcttgcccctgggaggcagaggttgcagtgagccaaggtcacgccactgcactccagcctgggtgacagagtgatactctatctcggaaaataataataataaaatgaagactgccttcctcactcaccgtggtcctggctaagtgtctgctcaccacaggactatggagtcggcagagcgggcttcttgcctctctggctggttggcagggaagggctgaggcacagagaagttattctcctgcctggtgctgtcagcagtaggtacagagtcaagactaaaaccccgttgttctgccccaggtctggcagtctagaagaagggggggctgtgcagggtacccagccaaggcagagtccagaggaagtcaaggaagagtatgaatgtgagtgtggggcagggagcactgtgcattagcctgagaggtggggggcacagaggaacaggtcacttaatgcttggcacttaggtctgagcctgtttatgaatgcactggggtgcaacccacctggcaaggcaaagcaccttcctgaggtcccaccaccccctgtgtgccagtccattactggctggcattagggtgctcacctctctgtagatttccttaagcccaaggggcaatcacatggtccgcaagtctgcatattggtttgcactaaactctaccctgacaacataccataaaaatggtctaggccaggtgcaatggctcatgcctataatccagcactttgggatgccaagggagttggattgcctgagcccaagagtttgagaccagcctgggcaacatggcaaaaccctgtctttgcaaaaaattagccaggcatgatggcacatgtccgtagtcccagctactcgggaggctgaggtgggaggatcacctgagcccaggaggttgaggctgcagtgagcccagatcctaccactgcacttcagcctgggtgacaagagtgagaccctgtctcaggaaaaaaaaaaaaaaaaaaaaagtctaataacagagcagctaacatttattgagtgcttactgtgtgccaagcactgcgctaaacactttgttggcatcattttatcaaatttctcccagaatcttctcttagaaaatgattagttgttttgacttagaaactaaaatattggattttattcctcctcctcctcttcctcctctcccctccgccccacacgccaccctgtaagggactgtggggcgctgcagggctggggttcttgcccccaaggttcctaagagtcaaaagaagatttgctcattcaacaagcgtgtattgagtatgatttctgatttgttgagcatttattgatgcaatgcaccacatgagatgctgcagacacaaaactaatgcatactcgctgatctcaaggagccggcacacatcatctgcaagggacaaaccggaagtgttgtgtgctatggcccaaaacagaggaggaaacggaggaggacagagctgagtctggaaagaggaggtggaggcagagagagggagatggaatcagtggtgaggaacacaggcttctcaggctgggtgcagtgcctcatgcctgtaatcccagtgctttgggaggccaaggtaggaggattgcttgagcccaggagttagagaccagcctgggcaacatggcaacgtcctgtccgttcataaaattcaaaaattagccaggtgtggtggtgcgcacctgtggtttcagctactcaagaggctgaggcaggaacactgcttgagtccccaaggccgaggctacagtgagtcatgactgtgccactgcactccagtctaggtgacagagtgagacctgtcgtaaaaaacgaaacaacaccagcttctctcccaagaaatgaggttaacaataacaccatctccccttgtggcaaggatgggtctagatactgcatgagatgtcgttagcatggtgcctgaaatgcaatcagcagttggtaaaaatgaattattttgttgagagttaaaagtgctttggaggaggacctgagtcttgttatctttgcaccaccccagcccccagagtcagcactgcctcacatgaacaccgtgccccaggatgctagctagtaaggtgtcacagacagggtggcgaggagaagcaagccccagcctgagcgggaatgactggaggaaaggtcagagacagagcagcccggaggtgcgctggtgcgcagagcagacagtggagggttcagtgggcagtgctcttcaccccgggtctgaataatgcccggggcttgggaggcccctttggctgggcactttctcagggtggccatgctgagctgctgacccccaagccctcctctccagctccctttcatcatcaccgtgagtgttcatttaaactcagcaagacccatgccaacaaaaacaaagaaaatgatctcttagtggttatttatatggtaaacctcctctggggtgattttttttccagtccagcttgcaataatttcttaagaaagataaagtgatttttaagtgtaattttaaggagcaggcccatacgttagcttgcttgctgttattcttctgttcatgttgttcacaacatgaactttgatttgtcttctccaggtagtttgggaccacagagaaaaatcccccttctgttaaaaaaaaaaaaaaaaagccattacacaaatacttgaaagcagaaactcttctctgaaatcttctctgaaatgacgaaaaactcattaaaaactgcttcctgagaaggtagaacagatgcaagggaacacatggagctgattctttaaagatgttattttttgaagccacagttgttatttcttttctgttagccaaaatgtagccttacattttgaacttagcacctcatatttatcagcagagaaacagaaaagagtaaaacaaaagaaactagaagcagaaaactctgaattgtttataaaatgggctttaaaaatacttattaagagaatgaaccatgctttcctattttgctcttaaaaatttaagcactttcaagtgatggctgattaaaaaaacttggagcgcatcttgaggcccaggtttcccaccatcagaaatgtgcagccacaaaggaaaagtccagaatttcagcacttgtgagccgtgccactgtcagagttggaaaagtactagccagcagaaagcctcctcctccccccccaggggaaagctgccagcctatccagttggcacagccatgcccctttgcccagggcttgtcacctgcacacacagatgaggatgttcaatctgaatgagaaaggaactggagattccagcagcaccctaggtctaggagtgaaaagctcccagagtcttagcactgtgcccttctgccgcaagctggactgagtcgattctgcggcagcaggcagatgcccgttctgcaaaggcatctatatttaggtagggacaccagcttgccaaggtaaagaagggcatgatgggcgtcgcctcagaatgctgttggtcttggaacagaggccctcagcatctgtcctcacatcttctgctcacaggcaggtcctgtgttgccctgtgggttagacatgctcatggaggagaggacacctccccagagccaaggcggtctggaacgcatcagggttcttcctgaatgtgcgtccttcatgccgggtggctacgtgccgccaggcagggactgcatactgcggtttcgtagtcgctgtgctaaggggagctgccacacgccgtctgttagcaggacatggagttgggccccaaatggccctagtggtgtcaaaagcagatgtcttcaacccacagtgggacgctgctccctcccagcgcagcctggtaggcctcttgaccacctggggggagtcactgtctgcctcgaggcacctggccactttgggactgcacagcaccccttctaccctagggaggagtagctcagctcagctcttcttccccaggctcagcccaatgcgcttcaggcccacgtaggcgcagccctgctgcggaggcgcctctgcctttccctttgtgacttcctggcagaagcctccactccagctgcaattcagtgctcatcttgcacattctcatcccaaggtctttgctcccttaatggccccagctgtatggtcctatccctgcccttgcgggtcacctcctcaggaaatctgtaaaggcccagcggattcttcctaagatgtgttgcttgggggccccccttgaggctgacatttctgctggaatatttcatccttcggggcctggacccgggccatgccctgctgagccttagctgagtgcccagccctttgccccctctagctcaggccagtctttgcaccccttcatcagacaccctgcctggtgtcatctgaggtgtcctttacctgcctggctggactgaaggctctcagagggaaaggccatctcgtgttactcatctctgtctcccagtggcacccagcatggtgcccaagtccctgtggaggaaccctggcttttgtgattctcaaagtcttctgcgtcggccctccctgagcaggtttgtatggcaatcacaggggccaggcaggtctcagagcaggctctctttgatggattagggggaggtggtgacagtgggacagtagccctgcctggggactctcaggccagtgaaccgaggggacagctacaagccctacaggaggactcagctcttcagcagtggacttgactgatgattgacagatgaggcacacagggtccctctgaggagggctcggccctctctcttttcaaccaggctccttggtaaagaagcgggggcgtgcgctggggggagaaccttgtgttctcagtcttaggagagctgttctcaattcccgccttcccaagagccctctggggcatttcagaactcccgtggacctgccagcttcgcacccttgcttgaatggtgaagcatatcagtcctttttaaagagtgtctgcagatcccctaaaacaggagccccaaagcttatgctccttagcagagaaaagatgattccatgtgggatgacgcagcgttgcctgccaaaccagccatcaggccatccagtgcagctgtgggcccaggagccccccaactgctggggcctccatctccatgggttctaaaggaaaggggcctcataactggctagttggggcaaggagaccaccctcccagcccagccaggctgttttctcagggctggtctgtgagggggaggaattagaaaggactgcccccgggccaggggagtgggattggaggagaaccgagaggttttcagtagattgagaggctcattaggggtgaactaggtagccaaagaaacatctttaagaactgcagttactgaatacagcccctcatcagcgctgaggttggtccacttaacctttggtccacttaaccttgctatcaatgtgggctcagggaatgtgcctgccaggacaggaagacagccttgggctaccggctccacctggccagcgccctgttcccacagcaggaccagctccttcctaactgcttttgttttgtcctgggacagagcctggattttgggttaagtttgtgccttccaggctggggaagaagccaaaacttctgtttcccatgcaaaacgccaccacacacctagggaggatgtttgtgttccacggaggtcgccacccatctgttttcagagtaaacgtttgtgtgagcgcactctggcggggagtcccgagagcggaccctcttgccactgcacccataggtgcggaacgaacctgctgccccgaccctgcggctccgaccggggccgagcagcgaaggaccaccctggtctggtcacctacgattctgggtccagctcagctggtgaccttgcttaggccacacccctctctgagcctccatcttcccttcagcagctgtgtagggtgaacttaatgttgtgcaagatcatgtccagctctggaattttaggattatgagcttatttacgatcagcctgttgattctacctctaaaatataatctgaacccgtatactcccctccatgtctcctggtactccatgatcttgtcgcttcctgcccgagttctgcagtttagaataaacccaggcccctctccgcggaccctctgatggcagacctccatccctctgcacagggcctcacccacccagccacgtgctctgctgtcagccccccggagcccctgggatctttgcacctgctgttttctccgtagagagctgccctccctccactcctggacgggctggctccttccttccttcccatctttcagagctcagcttcaagtgttggctccactgagaggccttacccccaagtccctttctaaaagaactgttcctccatcattccacctctcaccccatttttttcctatattttgtagctctttccttgggtggatctggttttgtgttagtctcttgtcacctccactaggcagggacctcccagggcagggacggacgcacctgtcccagtcatggctgatcagcgagagccaaacatatcatagcacatggggtactgtaggtgttcaaaggatgctggctgaatggatggagacttccttcatagagccccattttccttcctgatttcttagtctcagttcccattttctctcaaagatccaggggtcacaatgagagtgattataaaacaaactacacatgcaacacgaactcctcagtcaatcccaagagggctctcactccacacttcatcatctgccctgtgacctcagattaaaactcaggcttaacatttcctgaggccctgctcggtgccaggttctgggtctgtgctttccagttgttttatgtatccttgataacctctgtatggttggtggtaaaatggagagatgtattttcctgcggggaaactgagtcctgagaaacgagctagcccacagagagctggtggctggtagagcccggatccaaaattgggagcgtcttgccccaagtccagtgctgtttcctttatacccaatgccacagagccaaagtggtacctggccgagatctggccctgaatgtagaagaggccagggaaaggtggagggaagagggcataggtcccagtgtgggattccagatgacccctgttgtccagctggctaggagatatgtggaccccagggctgacagatgttcctgagggccacagggaacctgacggaaggttggtggcatttctagaggcaagtggtcagagagagcatgggggttttgtggggactgggaataaccgagggcctcgtggcaggctgggtggcactgccctctcaacgctgacctgtcagctggttcaggaaggcctttctgaggccagcacagactctatcacaccatggaccttcaagggatagctctcttggcaaaacacccttttgccagacctaattgccagaagctgcagtggaaatgagaacccaggacatgggacgagacagacctatgtgtggatctcagctctgccatttgctagctgtgtggccctgacagtcacctgccttgtgagctctgagttccttaagtgtaaaaatgccatggtatggtagagaggaaagagactcatatttgaatatgacacagaataggcccttagtgccagcctcaggggctcacacctgtaatcccagcactttgggaggccaaggcaggcaggttgctgaagcccaggagttcgagaccaccctggtcagtgtgatgaaactccgtctctaaaaaaaaaaaaaaaaaaaaaaaaaaaaattagccaaaaaaaaaaaaaaagccagatgtggtggtgcaggcctgtggttgcagctacccaggaggctaagatgggaggatcacctgagcctgggaaggtcgaggctgcagtgagctatgattgtgccactgcacacatactgggcaacagagtgagactcttgtctcaaaaaaaaagaaaaagaaaaagcccttagtaattcttgagaatgagtgactgaaggaaggaatggacacctacctaagatgtcctcctggaagagagcatggagaagggatctgagcttcttgctattttcaatgtgaaaagctttaatctggctgtaatacaaggtcgattacccacagcttccaagaacttaccacaaaatgttaatgatatcaactgagatttttttttttcaggttgtaaagttgtgttctccatcattgtaagcaagtaacaacacagatgatgtgtaccctgcatcaggtgcagttctgagcactttatgcccactaactcatttcatggtcacaacagccctacgagggagacagcatttttgtcctcatttctcagatgagaacacagaggcacaaagagattaaataaatagcctgaggtgacatagctagtcagtggcagagcaggacccaatcctggaagtctggcttcagagacagagctcttaactccacctgatagtgattaatggctatagcagaatcagatcagggtaagagaaggcatggcactgagccggggaggccagggaaggttgggctggaaggattctgttctccttaaaatggttgggaaataagacctctaactaaatgagtgggagactgcgttggtgctttaggggaagtgggcctgctggcggggggtcgcccactttccacctttggtggttctgaaaaagacacggtatttctcttatgacatttttggtaattattgtaaatatgtttttatattgtgaaactccccccgtcttaagctatattcgttttctcttatgaatttaaaaaataaaatctattgatgcgcatacaatcaaatatatgtaaaagtgcacatttctgagctttgagaaacgtactcgcttgtggaaccagcacagttcggcgacatcgagcaggtctgtctggcctgtcctgccctgcacagccgcctggaggttcacctgcatcattgcgtgtgtcagcgcttggtgcctttctgtcgctgagtagcgtctcgctgtgtgagtgtaccagaattgtttactcactcacctggtgagctgttcttgggttgtttctagtttggagctgttataaatgaagctctgatgagtgagtgtgttttcacttctcttgggagattatctaggactagaattgctgggtcctatggtggaagtgtatgtttaacttttaagaaactgttatttttcaaattcactgtgtcgtttttgctgttgccaccagcagagtttgagagttctggttgtgccatgtgcttgtcagcacttggaagctggtagtccttttcattctggccatttgagtagatatgcaagtggcatctcattatggcttttattgtagttctctgatgacaacatctttcccgcatctctgatggggaacatcttttcatgtatttatttgccacctgtagatcttcttatgtgacccttctttcaaatcttttgcccatgtttccatcgggttgttatatcttattgaactgtaagagttcttccaccctgagcaacatggcaagaccctatctctataaaaaataaaaataaattcactgggcatggtggtgcgcacctgtggtcccagctactcaggaggctgaggtgggaggatcccttgagaccaagaggtgaaggctgcagtgagcagtgatcgcaccactgtcctccagctagggcaacacagtgacaccccatctcaaaaaaaaaaagtcttatattttctagacatgagttttttggtcagatattggtattgcatatattttctcaatgtctttggcttgccttttcattttcttgatgttgtctttaagagaggaaaagttttgaattctgaagttcagttaataatttttttctcttacagttcctgcttttagtgtcctaagaaatctttgcctatgtccaaagtcttactgatttttctttttttttcctaaaaaatttatagttttagctttttttgggggggggagggggggagtcttgctctgtcgcccaggctggagtgcagtggtgcaatcttggctcactgcaagctccgcctcccaggttcacgccattctcctgcctcagcctcccaagtagctgggactacaggtgcccaccaccacacctggctaatttttttgtatttttagtagagacggggtttcaccatgttagccaggatggtctcgatctcctgacttcgtgatccgcccgcctcggcctcccaaagtgctgggattacaggcgtgagccatcgcgcccggctggttttagcttttacatatatgtttgtgattgatttcaagttaatttcatgtagggtatgagttaagggtgaaagttcatttttctctatgtggttatctaattgttccagcaatgtttgttgaaaagattgtcctttctcgtcaaattactgtgccacctttgttgaaagtcacctgcccgtgtttgtgggtctgtttctacctctgtattcctggttatcctcatctcagtaccaaactatctgctgcctgaagctttatagagtcagtgggtcagtgtctgccttgttacttggtctccgatggtccggcccagtggcagaggatgtcaccttgccagcacatgcctccctaggattggatcatgcccctctcctgagaagccatgtcacctgcatttgcattatttgaaggtgcaagatgtcccttctcaccaagtgaagttggtgtgtttatatcctgcgtcctccccacctcaccctggaactctgagctctccagttttcctcctcctcttctccctctctctgatgttgaccccaaaagccctttgaggtagagaacaaacatgtaaaagtgcctgcctttttaaagggaaacttttcaaaaacttttctaaggaactggaaataagaactacgtaacagaaaccatttcacaaccttcagcatggccatttatctcaataaccatttcgtttaaaatgtgggccaaacatataaatcatatcttgaaagaaagcatgtgggtgccacaaaaatcaccctgtattcttaccatctaattttaaaaatgtgtttcgaagcctggaaaaaggcaaacaagcctggggcccgtgccctcctcccacagggccagggatgcagcggagaggctggagcactggacagcataccccgttgctagccattcgcgtcagcgacaggagccactgctcttgaaacctccctcctctgcatgtcacttggtagatcaggagctgagagccccaaaaccagtctgcttctaaccagtgcttggacaagcccttgcacttaggcagtaaacactccaggagagatcgtgtagatattggtgcttatttagcgacatccccagagggagggtgccaaatatagcgggaccctgaggtccattttccagactaataagagggggagacctagagcagcctgtcgctgtgggctgggaattccagagtcttctgccggaaacctcactaaggattgcaaggctaagatgtcagcatttcctcttggcaggtttcatatttgcttcttagcacttcctgggagggaaaaacaaaagacaccggcagatgtaccttgccatgggccatggcccttcctgtggcccgtgtacctctcacctgggtccctggagacaccagtatccccactgctacactgacccttttttctcatctggtcttccatatttcctctttcccagcctagtagctgctctcaaccaccctctgcttccctcttgctcctcctttaagatgacagtcccctgggcatcctcccgggcaccccctcccgggcgtcaggtctctgtttccagcctgggctctgttcttgggagtgaagaaggtgacgtttggaacggctgagcataacctgtgcctcaagtgtagctcggaggtgctgaccttcctctgggtctaggttctgaggcatgagactgttccttcagactcctagctccttgtcagttgcagccctgagcatctttgtagggggagtggggaggatttgggggatggaatgcctctggaggtggcatgccagcccacacgtgtgcacaggcctggtctgctgcccccctccctggaggtgcctttaatcagctgcacaggccacagttagatggcggcgtcctccaaccgaccccacggtgcaggagcagccccaccctgccaacatgaaacctgtcgttttctccttttaatctcctcatccctggctgcccgatgttccttgtgtaagtcacgctttacatcttaccagccgccttggccatgactgtctttgtagtagaaccttaaccttgttcctggaaccccggagcagtgggtgtcatggggcagtgcacgtgctctctggactggcagcagggggctggggttggaaaggctgggagaactcctccctcagaagactagaagtagcccccacagttctgtttccttcttgctcccatcttcccccctgcctcagccctcagctgcctgtgtctggagagctgagtttggggcaatggttccctgagaagaggggtttggtcttaattcctctgccaagtctggtgcccaggctcgaggaggcagtgagtgcttagagtacaagagtgggaaggcaggcgggtgtctttccaaagggaggcaccggggtggtgtgttaggaggagcacaaggctggccgcggtggctcatgcctgtactcccagtgctttgggagactgaggtgggcggatcacctgaggtcaggagttggagaccagcctggccaacatggtgaaaccccatctctactaaaaataccaaaaaattagctaggcgtggtggcgcacgcctgttatcccggctactcaggaggctgaggcacgagaattgcttgaaccgcggacctctggggacgggagggggaggacccatttcatctctgctgaaggatggtgacaggctggggatggagggtgggcaggggcaagggctggggctgctggcagcagacatcaagggcacccaagtccctacagggcatgaaccatcagccccaggctggcctcaccatctgctctggccttccctgctttgtgcagtctgcctgctcccttccctcttggttcactccttcaggctgctcatctgcccgcaccagcagtctgaagcagtcacaccggccatccttggcccaggggtgaagggatctgggagcttttgcttctggattcattgtgagagtaggcagggctaattctgagttgccccaggtccccatgctgcgatggggctccgggcaggaatctgggagccaggaagtcagaccctgggccttcacccggcagcacttccctgtggccctctccagggcccaggtatggctgcaaaagcagacctgggtccagcaagggaaatggttaacccgtgaggccccccatctgcagagccccacagctactgccttgcagagcaccctttttctgaccagccccaatcctgcctggggcctcttagagtccagaagcaagaagtacccaccgctgtgtgtccctgtggcctctggcccagagccaacccacagtgaggccaggaaggggaatgagggcgtcagtggcctgggacccagacttccctcagaaagctggcctgccaccccagctgctcccgcctggggatgctcacagtgcttgcccccgcccacccctgtccttctgggccctggagtccaagggcctgacgtgctggagtcctcagaagccagctgggccgaggggcccgcccttgactgtgtgtgtctcaggtattatggtcacaccaaaaatccccctttcttttctgccctatggaatcatatccagaacagatggttctgaatcattgttcctgcaaagcctctctactagaccaggctctgagccggggctggggatacagtggtgaccagacagaccaggccctaccctcacgcagcacgcagtcccctggggaagtcagatgcacagactacaaggtgacagcaaattatggtggggtcgcaggaggaaccaagagggctgagaataaggtaggccagcagggaagtcgctgcagacccagcggagccagctgtgtgggaggggctgcggagaggagctttctaagccaaagaagcctgtgaaaaggctgagcaaggggagagccaggaggctgcggccgctggaatctggtgggccagagagagggtgccggggtggggagcttggaggggtgtgcagggccagggctgggggcctagggccctgaagagtttggacttcactctccctctgtgcaaggggaagattttgaaggctgcaaaacttgggaaagatgatgggattgtttttttgagaaattcagtctgatgccctgtgggtggaacagtgccagaggcttatggacaccccagaagaaccacggtgacggatacctgtggggacaacagatccttctcttgtgggcatcgagagcctgcgcagtgaccctggagcgagccctgcctcccatcctcggctcccggctggagagtctccacggcctgcagccgctccttcctctctgctctttcctgcccctgccaggccacctccctgtctcttcttgtccataaacctgacctaggacttcacggaccaagccctaacccacagccttctggccttggcagccccgccagccctgtcccctctctgggcctcggggctgtgcttgggctccgtgtcccgagcagccctgccaggcctagctctcctgggcgtgtgtctctctgttgtcagcccccctggcggttcttccttggaatcatcttctggatgtcccctctcctttttctcctctagtccctgtagccaccccctggcagtgctcagtaagggctagcaaactagcagcctcctgcagaagaagtgggggttagcacccccatacccccattgtttcccggaggcattttgggaggccaagccagaggattgcttaagcctaggagtttaagaccagcctgggcaacatagggagaccccatctccacaaaatataaaaaattagctggttgtggtggcatatgcctgtagtcccaactactaaggaggctgaggtaggaggattgcttgagcctgggaggtcaaggctgcagtgagttatagatggcaccacactccagcctgggtgacagagtgaggccctgtctcaaaaagtaaagaaatgccaaaactggatttttttttttttttttttttttttttgagatggagtcctgctctgtcacccaggctggagtgcagtggcgtaatctcggttcactgcaacctcttccttccgggttcaagcaattttcctgcctcagcctcccgagtagctgggattacaagcacatgccaccatgcccagctaagttttgtatttttagtagagagggggttttgccatgttggccaagctggtctcgaactcctgacctcaggtgatccgcctgacttggcttcccaaaatgttgggattacaggcgtgagccactgcgcccagccttattttaaatgtttacatttaacaaatgaacgcttttaacggacacacagaaatataattgtgccattcccaaggtaattacagtgtttataaaagaagaaccttagttcatggcatgcttcaggcagtgtggtccagaaatgggacccaagtttgaaattggatgatgagggctcctttcaaactcgtctgtctcctttggagagagttaaacctcaaggccctttgggtgtgtgtggtccaggctgagccttctccctcattccttgtgatgggcccaattgaaaggtccctcttcccctaatgcagagtggcagcccatccctgccctcttccattgcagggcagcggccagtggggagcgctgaggtgctcaggtcaggctgaccagaggggctgagcccacccttgccagcggagagcagcacaggctgatgccatcctctccctaactgtccaagccatgggctctgccttctgaactgggtcataccaaggtggggacttgggagccaggtcaggagctggcctgtcctttcggctgcccaggtttattcatggtgctggtgggtgtgtgctgttgctcttgggcacctattgtgcatttgcgtgacaggcggtgaatggaagagtgtctggggcccagagggcagaatcagagactgtccttaatcgtctttagagggaattatgtttaacaggaagtagtgagagaaagtggaaaaggcctcttccttcgcccttgctagcttggtctccttgacaagttctgctgttttctctgtgcttcagtcccctactttgtaaaatgggggcaaacatgtgacaccattgtcctcagggctgccgggaagagagtggaggcaggggtttgagtgacattcccctgtgtggacagaccacgtttcatttattcatcagttggtggaaactggattgtttccactcgtttcctattatgaattccacgtttaacttttatgaatactttcctatgaatactactgtgtttgtgtacaagtttttatgtggacacgttgtcatttctcttgggcagttacctaggactggaattgttgtaccatatggtaactgtgtttaatttttggggtaaactgccagctgttttttatgaggtggctgaaccatttcacatttccagcagcaacgtatgaaggttctagtttgtccacatccttgtcaacacttactatgatctggctttttcactgcagccatcctagtgggtgtgaagtggtagcttatggttttgattcacattttcctgatgactaattatgtttgagtatcatttcatgtgcttcttagcaatttgtgtctttttctggagaaatgtctatccaacatctttgcccctttttttgttttgttttgtttttgaaacagggtcttgctggagtgtaagtggcatggtcatggctcactgtagccttgacctcctgggctcaagggatcctcccacctcagcctccagagtagctgggactataggtgtgcaccaccacacccaactagtttttaaatttttttgatagagacaggatttccctgtgttttccaggctggtcttgaactcctgggctcaagtgaccttcccaccttggcctcccaaagtgctgaaattacaggcatgagccaccacgcttggacttttgccacatttttaaattgtgttttctttttattattgcgttgtaaatggcctttgtattttttctttaatttcttaaagatggggtctcactatgttgcccaggctggtctcaaactcctgtctttatatattctagatacaagtctcttatcagatacatgatgtgcaattattttctctcattctgtggctatcttttctctttcttaatagtgtccttggaagcacaaaaattttaaattttgactaactccagtttacttattttgttgttgcttgtatttttggtttccttttttagtctttaaaatatataagatatatgattcaaaattaaaaggcatgctcagagcagtctcgccttcatccccacctgccctctatagggaggcatttaaattaatttctccttttatcgttcctgtgtttatatttgcaaaattaaaaacctttttttcttaaacaaaggtggtatgctacagatactctgcatttctttcttcttttctttcactaaagaaatcccggaactgagcccccgtatcagccgattgaactcactgtgtttcagggccacagtagtccaggtgtggatgtgcatcaaatggtttagtcagctggttccccgctgagggcctcttgggcctgttcccagtcttttcctgtaagagatcatgcagcaggggataatatcctttcgtatagtggaggtgtgtcttcaggacagactcctaaaagtgagacggccgggtcaaaagttaagccgtaggaatcgtggctgttgccagattgtcctctgcaggggttggactgctctgtgtgtcaccagggaggtatgagagtggttccaccacaggctcacaaacagaacatattgtgaagcagtgaggttcttgccagcgttatctcagtgcagctttttttttttcaatcagctgtattgtgtgatttacatacaatgaaatacacccactttaagtgtccagtttgttgagttgtgacaaattatctacttcctgtcaccacagatgggtttttgcccttgtaggatttcatataaatgaaatatgaagtatgatgtcttctgtgttagggttgttttcttaaaaactgtatatattcaaagtgtgtaaggtatctttatatcacatagtgaaatggttactacagtcaaggaaattaacacatctgtgaactcccatagcatgtggtgagagcacctaaaatctactcttagcaaatttccagtgtacagtccagcatgattaacagtagtcctgtgctgtatatcagacctccagactattcatactacgtaactgccaccttgtacccctcgtacccttcgaccccattccccaccccttccagttgggcttccttgacccaggataaagacactgagattcatatgtgttgtcgcacccatcagtagtttaatggcttaggagtatccactgtacggatacaccacaatttctctgctttcccgttgatgatcatttgtgtggtttctagtttgtacctattctgagtaagactgctgcggacattctggctcaagtttttctgtggacatgtgttttcgtttctttggagtaaacaggagtggaatggctggatcacatggtgagcgcacacttaaacagtcactagaccttcctccaaagtggttttgccagtttccatccccactaggagcagtgtgtgggcccttcctgccccacatcctcacagacatcgggcatcgctggcctttagcttcagctctccgaggaggtggggtgcactgtctctttatggttttgatttgcatttccctgaggactgcaaactgcacgtcttttcttatttgccattatatttcctctttggtgaagtttctcttccaatcttttccccaaaaatcaagtttttgtctctttattattaagttgtaagagttctctttattttctaaatacaagttcttttaatatagagatattttctcctagtctgcaacttgccttttcattttctcagtggtatccttccaagatcagaaattttaattcttgtgaaatgcaaacccatttttttttctggttagtactttttgtgtcttaagaaacctttgcatttcctttattatgagtagggctgtgcatctttttttttctgtttaagggccatttgcttattttttctgagaactggccgtgtctttgtccactttttaaaaatttggtctattggtctttctcttcttgaattttatttatttctttgagacagggtctcactctctgttgcccaggctggagtgcagtggtgcagtcacagctcactgcggcctctacctcccaagctcacaccatcctcctatctcctgagttgctgggactacagacacatgccactatgcctggctcatttttaaaaaattattgtagagaaagggtctccttatgttgcccaggctggtcttgaactcctgggctcaagtgatcctcccgcctcagcctcccaaagtgctgggattataggcatgcctggcctctcttcttgatttctaagagctctttgtctattaccgagatgagccctttatggtatgttgttatgttttctctcagtttgcctttttgactgttttcccgtgcatattgcatgcatgtgtttttgcagagtccagtgtatccatttttttattgcttatggatttgggatcataggccttccctactcccaggctataatgagcttacccgtgtttgtatctagtattcttatggtttcattttctctaacgtttggatttttatcccatttggagttgattctaacatgcggggtaaggcatggaatcaattttatctttttccaagtgactctctacttctcttcatatcagttttttaaaaagtctatcttttcgtaatgagccgagatggcactccccaggccattatcattaaaatccttgatttccacatgttcttggacatggtcttctcgtttctgtactcgtcgtgtcctgcgggccgtctgagtgttccgtgctgacgcaccctctcctcctcgggggtttcatggcgtctccctcggcccatggtgggggcttctcaccgctcttctgttcggagggtttcctgggtgtgtctgcttcctgtttttccacatagcctagaaccagctcgcccggctccagaaaacatttgttaactttgaaaattgagactttgttaatgtattcactttgagaaagctgacatctttatggatgttgaatcgtcctatgcagaaacaaggggtgtggctctatctactccagtttacgtctttccaggagagattcttctaggactgtcgcagctgttttagaggcttcatatggattctgtacatccgatgttaggtttattcccatgtgtttagctttttcactgcttttataattttttttaaagtttttatttttatagagagagggtcttgctctattgtccaggctggtctcaaactcctggcctcaagcagtccactcgcctcagcctcccaaagtgctgggattacaggcacgagccgctgtgcccagccaatataatgggttcttttcttttcttttttttttctcgaggcagggtctcaccctgtcgcccaggctggagtatagtggtgcgatctcagctcactacaacttctacctcctgagttcaagccattctcctgcctcagcctcccaagtagctgggactacaggtgcccaccaccacgcctggctaatttttggatttttagtagagacggggtttcaccatgttggccaggctggtctcgaactcctgacctcaagtgatccacccgccttggcctcccgaagtgctgggattacaggcgtgcgccaccacgcccggcctctttcattctgttttgaactaaacattgtttgcactgcatgtggtgggttataattggttgttgtcaattttatatcttgctcttactaaatactttttcatttgtattctaaggatatcttagcacttattttattggggtttccaggtgtgctttgatattacctacaaagagatcatttttccttagggttgaatgtttttaaaggtttgtattacatattgccaaatcttttaaaaaatatggtaccaatttatacttctcttgtggcagtgttttgccatacccttgtcggcactgagtattgatattttttaaaatgtgccagtttactatgatcttcactaagaggacattcactgtgccccttctccacaccagttgcactgccaaggacacagctgcggtgaggacacagtagagcctgcagatcccagcccccagtcccactccagtccctgtccctatccccaggagtccctgttctggttatttcttgaggtttcaaatgaagatggctgctgccctctgagcccagccaatgggacgaagccagtggagagcccgtccctgccccagagattcgctctggaaaatccctgagtggttttgtaaaatgcattttacaaaataataatccccgcacaataagtcttctgggtgtctcgcaggatcccctgcacagctcaggcactgccagcagccgcatcccctcgagtggctcaatctgtccaggagcaaggggtcagccaggcaccttccagggccagtcccaggccacccagtcccagtgtggctgagcacctatgcctcttccccatagctaaaaacccagtaaaatggatgataaaatgggtaacacctccctgaaagtttctactttcctataaagcccagccccggcccaggcccgagtcctcttatgaacagaacaaccccaaccacccatttgcagagggcactgctgtttggtactgaccctgccctgcccaggctggcagccctccaaggaggctgggcaggaggtcccggaggacacggcccacaatgctcacccttttcattctccatcttgccccatcacctcccacctcggccccttcctccaggcagcccgccccgcccttttccacacacccctggttcccagcactgaagcttgcttgctgtgtgatctcaggccaattgccttacctctctgggcttgtttccatcttcacctcacaggtagatgtgaggtcacctcacaggtagatgtgaggagtgaaagagggagtattcgcagcaggtctacacagcgtgtggcacagagctggctacatgaatgtgtgttcgttgaatgggagagtgaaagaatggatggattgtgctggcaaaccctccaggggctcagtttcttccactcggaccatcagaacccagagatcagatccaggagctcctaaatgcaacctttgttagaaacacagctcccctgccctgcactgctcagtcccaccctgggggagtttccagccgcactgaggatgagctcggtggggacctgacccagagatagggacacctggtcactggaccgcagaccggcccatccacagcctggctgggctggcatctagacctcgcttggcagtcccctcccaagagctcagatagtttggcctcgggagacaggggcagtgagaaggctgcctcccctcagcctgggagctgggtcctcaggagagaggaaatttccttctatttattttcgacatcctcgactttgaaagccaagctggtgttgatatttaccttggccaggcctcccatctccccgggccagcctcgtgtaaacatgctgttccttctctcagctctgctagcactgaggtggccttttgcaaccaattctaggaatttggaagtctgaaggcgtaggttcagggactggccctccagggagccctgggtgccaggggccctgggacctgctgtgctggccttgggctctctccctgggggctgacaccaaggactgcagggaatgaatgggcctgggcccatgggggtgtcggccagggtggctcttgctgggtccctcagttctcctcacagccacgttggggcctcctgctccccaggttcactgcgaggctcagactcggaggacacgcattgagggactgtggcaggatctggctgtctccactgtctttgctccaggccacctccaccctggctggtggggagggcttgctcttgagccagctctctagtgtgagttgggagtgtgggcagctggactacagttagagggaacatggagcaggtgcccagggtgcagcctcccaaggcagcacgtgcccatgccagaattcctgccctcagggagcttgccttccagagggcaggtggaccacaaggagaacaagctggcttggggtgggggtgagtgctgcagaagccaggatgagcagaggctggctgggtcagggacggtcccccgaggtggacatgcaggaggtgagcagaggcacattccccagtgcaaatcccagccctcccctgttggttccaccaggtggttcacacactagtgacgccttggcaagtctgagatttggtttccttgtacagaaatggggtgacagtccctcagaaacaagggagtggttctgcaggtgggagctgccatgactgctgcggttttgaagcatctgtgtgccccccaccgggcagtgggacatctcggctgagcctctccccttctccatgcagatctgggacatgagcgatgatgagaccatctgagatggccccgctgtggggctgacttctccccggccgcctgctgaggagctctccatcgccagagcaggactgctgaccccaggcctggtgattctgggcccctcctccataccccgaggtctgggattcccccctctgctgcccaggagtggccagtgttcggcgttgctcgggattcaagataccaccagttcagagctaaataataaccttggccttggccttgctattgacctgggacttggtcctccatgcagtttttatttcttgtcacagtgactgatagccatcccccaggatcctttccccttggccctgagggggtgacccaacacagaccaaatggggaaatgagcaaccagctcctgcccagagccactgcgggaggtggcaccctcatccccggaatgtgctgcccaccgcaccgcaggctcctcctgtgggggccctgggcatgggtgagggtgggaccccgtgagcgcactgcaccctggccctggtggagcgggaggaggaggagagccgagctgggtacgagactaaagggcccacatgacccagtgacgccagatttccaccaaggactgagtgagctgctcagacatggctttctgcctcccagcctgtcctccactgtgggcatagcatctgtgcctgcctgcctgcttgagggagaggagtttctgctgctgccttgagctggggggaagagcccaggggcagatcctggcagctgcctggatggggctcctccctgcccttatgagcaggccaggcccagaaaggccgagcctgggctgccttcctgccccagccgagggaggggtcagacggctctaccatgggtaactcaggcaagagctggttttcctctttattctgggtgtgtgcagctgtgaggccccaacccaggagaggccatggcctaggtacctgtgaccaccctgcccccgtgtagagggcatcgtctttcctgctattttattctttcagcttttgtcttaggcccagaatcaaagtgaaaattgagtcgagctgacccttacaacagtaggatttagtagggtagatttcaaatgaggcttcgcttctcccaaagtagccagtccaagttccagtggctgtcgttcagctcatgggagcttcatggggacacagccggcacaggtgcagggcccgagtccgcccacccagcctggcgctgaaactgcacacgtacactatgtggtttaagagcactttattattgttcttaaggctacttttaagtacaaaaaaagatggcctgccaaacctttttttttcttcttccaggaaaaacaggccacagagaatggtatattacagatttacacacatgaagagaaggtcagagcgcactgcaggcagcgcggctctgggaagaacttcacggagccccttcttagagcagggagggggctttctcagtgaaatgtttggttttctgctgcctcctctgccccaggcccccctccagggtactgcctatcccagataggtcagtgcaccagggacccggccgccagcaccgccgacccctcccagagtgacgcccttgttcactgacaaagagacctgtcccaggagtgtcctccaccgagccggtcagctgtgggtggttttcctgttacgacgctcagtagcctgtagcaataacaaactcgtggctatgaatgcagatgcagtgttctcatagaataactgttcctgcacttttacagacaaatctacgacaaaaaaaaagatcaactttttttttccgaacaacaaaaaaaatgaatgattacaataggaaagggaaaaattaaatagctacatatcattaacaaattaatgttcttcaaaaaatacctacaaatttctctgtacattctttacgcacagcgtaacgatggtctcaaaatcacccatatagaaaagtgttctcaacgatttttcctacagaaaatataggggcctgaatgccaaagcttggaagcccagtacagtgggagtgaaatgtgtgcggggcaaggagaagggcttttctttcctccacttttcaaaggcctgcagccactctgtgactacaagagccagtcctccgaccttttcacccagtgccaatttccaaaattcaacagctaaaaactgtaaaaccgggggtcatacggtgtgcagagtccacaaagccttgcaggtgaggtgaccacgcccacgtcacctggtcaggtgccatcgtcgtgagcctctggtgggccaggtgggacacagcacaccccagggggaggggatagaaacgctcattgaccaaaaaggagcagctgtgacctccacagctgtgtctgtcatgcttgcttcatctaatttctagttagtagctattaatatagcaaataataaatgcagtaataacagtataaagtcagaggaatgtatactgccttggccccagcgtacgaggaagcgtataaaacaccatatcacagattgtctgtcagtaatctgctgttcagccaagagagttcaaagggagcagtttctgcatgtagggaagttggaagacacaaaccccacctcccctgggagcttgtaacaaagcagacagggatgcaaaaataaatgatgtcagcctgcagccaaactccagcatcccacaccgcagctgacccactgctcatcgcgagggcctgccaggagctggcctcccgcactacttgtgagtaaagtgaatatcaaataccaatcttagagtacaactgtaccagcagtaagtatatctaggactgtaactgacaaaaataaactaattctgaaaagaa

SEQ ID NO: 736 - DNA, 285130 bp, Homo sapiens; identical to SEQ ID NO: 735

SEQ ID NO: 737 - DNA, 285130 bp, Homo sapiens; identical to SEQ ID NO: 735

SEQ ID NO: 738 - DNA, 43652 bp, Homo sapiens
gtgcgtcgcgggggcggggccgcgcaggcgtaccgggtgccccggctctggagcataaacaagagcggggacgggatgaggcggcggttgatcccagggtggcgagtggcggcgaccgaggcggcgagcggggcccggcgccgaccctgagtgcagcctgacccgccctcgcgcgcgcgccctccccggccgggcccactcgccgcgcgcccagccatgaacctggcgagccagagcggggaggccggcgccggccagctgctcttcgccaacttcaaccaggacaacacgtaaggccggggtcgggggtcggagtcggggtgaggccagggtcggacccgggctagggggagggcctcgctgccaagctcggcggcgtcgcaggctcggcctccccgcgggccaaggcgcgcagaggcgtccccaggggcgggcccggggcgtgcagggaggggcgccctccagggagaccctcgggtgctggcctggagctgcggtcccggagcgggagaggtggtggagagggggctgctttcaccctcttgcggggaggccccctggcttcagacttaactacttctcgcaaagttggggccgaactttggggcttgacttgtcttggccgcctgtggagcgctgggtgtgggtcgcttcctctcctctcgtctcctcttcccgctgcttgctcagcgtctcccactcactctcctttgaatcaggcccttctccttgtcttttcatcgtcttaagacccttctctctctcttgattttcttttcttcgtttctcactgtttttttgtttgtttttgttttttggggtttgttttgttttgagacagagtcttgctctgttgcccaggctggagtgcagtggtgccatctcagctcactgcaacctccgcctcctgggttcaagcgattctcctgcctcagcctcccgagtagctgagactacaggcacgcgccactgtgcccagctaacttttttgtatttgtagtagagacagggtttcaccatgttggtcaggctggtctcaaattcctgacctcaagtgatccgcccacctcagcctcccaaagtgctgggattacaggtgtgagccaccgtgcgcggccctccctgttctttttgggacatcaactttgatgtcttctccagcaagtaacaaacttagcaataaccttggcatctgacctagctagggagaaactgagccaagagaggcgttacggaccagtgccccaggagtctcagagctccagcgggtgggtcatcctcagggcaagagaaggccttaatgccagcccgtgcattcggaacgctgtttgtccccactgatacgggttggatgctgcctgggaggaggacttgtggggatggttaatagatgagcgagctttctggagagagaagggtgagttatggggttggcagggaggagagccatcttggaagtgagtaagaggaagtgaggaaagagaaggagtggggcatttggcatcttactaagtcattggttgagttgttactggctgagtggaattaacatagcagaaggtaagattctttaggaaattaaaagtgaattgtagaatggacaacactcagtgggtggtgtacagcaggcactcaatagcacctccccaaagctgtgaagacagtcgcacagtgggactgtattgagagtcggaaggggcaaatcacctcatccaactacagatgaggaaatccttccgaaaggctccaagctggtctgggttttggaattggttaatagtggagcgggggcaggagtggaatctcgcctcctgagctctcttccaatgttctttctgctctgccatgctgtttttttttctgtttacagagtagaattctgaagacagtgaatttagaaataatagcataacaacgtgtaaagatgaaaactcccaagtactgtagcgttctgtgtgaccaaaagccagaacaacaaacaattcggacaacctgttgcagttcaagtggaatagactatgttaatccagatagggaaaaggacacatcccaaaccaattctaatttggtttttaagcccaaggccacagtattttgagaccagtaagaaatggtagtagtagtagggtggtttatgccttgtataaattagagagtttccaaaacattgtcggccactctttcagtttttcactaattatttctatcagaatgaaatcaaatagagaaaagcattctcttttactgttacttcagctggactgccatgttccctgtgtcacagaagagtgtcactctggcctgaaataggaccttttcacacttggacattttcacacttacccacttctccatgctccccgaagttattacagttcaagagatttctgttactttgagatttcataactttgacttgccagagagaccttgatgtagtgtaaacctaaattggaatgaatagtaagctaggattatactagaagttgactgggctaaaatgacggtaatttgttttaaatctacacttgaaagaaatagagaagttcccggagagagcttttatggcttataccttttcctcccttcttaatctccagaatttattgaggagcacaatttttagcaagtgaaagaatgaccgtctagaactcacatttactgtatgcagtgagaaaatttggaagccagttcacttactagaatatatatgttatagggtcatttcccttttttttgtcttttaaattctttttgtatttgttacataccaaactataactgtcctgcctttctttactggtaatatgatttccaatgtcgtactttttcatgattcctatcctaaaagtgtgcataagttttatttgttttttaccatttgttttttgttttgttttgtttttttacctagagaagtgaaaggggcatcaagagcagctggtcttggccgtcgcgctgttgtctggttagttccaaccctggtttctgaaagtatcaccttggaaggcttatgttagaggacttttttggctttttgaaattgcagtgaaccagttaataagtgggagaggatcacttgaatctgaaatggaaatatcaaggactacatttttccagtggataccacagcttgtgggaagttagtgatgtagcaatgtctgttttaaatgccatgtctaaaagggatggaatgaagaaagggacttgactttccaagtcttgtgtttgtagaattgatgttatgaagtgtgtggagacaacaggagaaacctgttgttttcttccaccatgtctcttctaggttatgcttattgtgctgggaaggtactgctctcctctctttgttcatctgtaaatcaagggtttgggtttttgtttttgagatggagtctcactgttgcacagtttgaagtgcagtggcatagttataatgatcatagcttactgcaactttgagttcctgggctcaagcggtcctcctgcctcagcctcccgagaaaccgggactacaggcgtaggccccacacctggctaattttttttttagtttttgtaggcacagggtcttgctatgtcgaccaggctggtgttgaactcctggcctcatgcgatcttcctgcctcagcctccagagcattgggattacaggtgtgagccgttgtgcccggcctgaagatggtttctaagatccttcacccttaaagttttaagtaattctgcctgctatgcaaaggatatgtttgaggagggcagggggtgacttaggaggatatcatccaacagcagtgaccagtgggaaggagactgtctcgccatcaggacttgtgtgacccacaggacgtgcatcatgcagccaagggagaacttaggtgacgcccagtttctggcttgggttctgggtgaatgtgataacatcgtggtgaaaaagccgagaaggagagaactctgcttggggatactgatgagttggaaaggccacagggatatggaggtggaggatgtgagggggagcggggatgggggtgggctgtccatagccctgaaagagagggcaccagggcctcccaggtctgggctggcagccacagttgaggttgcttttggtttacagtgtcgggctctatccgcctaagcacgcaatcaagtatggcttctccgcaaagatgatgaagaaggagagtctttacggactgacgattagggaagggggagaaaaggaaaataagcaaaaaatctgactcacatcttcatttttgagtggcagtcactgtctctttgatgttcaatgttcaagtttaaattcattgacggagactttcagttaaaaatgatggatcaaacataagcatttattttggttccatccccagaccctaataaaatgttaatcagtaaaatgtcaaaaatatacattttctaattttaaacatttcttaattttttatttttgtagagatggggtttcactttgttgccccaactggtctcaaactcctggcttcaagtgatcctcccgcctgggtagctcagattgcagacgcaagccaccacccttgacctcaaaaagatattttaaaaggcttaaactcatacgatagaaagaatgagaaaggagatattagccagtttggaagctagcgagtggtaaaggaagtgggatctcaaattgctagtgaagaaagcagagaaccaacctagtttaaactgcagaatcccctccaggctcaggaatgggcaggccagggctccagaggcgggcttgtggggccgtgaaatgaggaggatgtgttcaagtgcgtttaaaaagcagtgactctgtccttccctagagaaggacaggcctactctctggggagggtagagcagggtctctgggtttgggcaccaggcacagttgaaggtggggatactggcaaaatgggggattgagccaatacatatttttttggttgtgatttgctagttttcccctttgtcaatgaaagagcccactaatggggacaggcacagtggctcacgcctgtaatcctggcactatgcaaggccaaggtgggaggatcccttgagttcaggagttcaagaccaggttgggcaacacagggagacctcgactctacacaaaacaaaaattagccgggtgtggtggcacgcgcctgtggtccccagctactcgggaggctgagatgggaggatcccttgagcccaggaggttggggctgcagtaaggcgagatcgcaccactgtgccccagcctgggtggcagagtgagaccctgtctcaaaaaaataaataaaaataaataaatcccactctgttgacttaaaaataaataaataaacattttttggcaataaagctatgtattagggaaaatctcctacttacctgttgctctgcctttcccattagtatgtctgccattttatggtcaggtcaattttgaaattgtttaaagccaaatctccaaaggggtgttgaacttgattgttgatgttgagacgaaaatatcaatcatatttatatttaataccattctttaaaaatactcatctaggccaggcacggtggtcacgcctgtaatcccagcactttgggaagccagggcaggtggatcaccaggtcaggagttcgagaccagcctggccaagatggtgaaactccatctctactaaaaatacaaaaattagccgggtgtgatggtggtcacctgtaattccagctgctcgggacgctgaggcaggagaatcacttgaaccgggaggctgaggttgcagtgagttgagatcacatcactgcactctagcctgggcaacagagcaagactccatctcaaaaaaaaaaacttatcttttgctgggcgtggtggcttacacctgtaatcccagcactttgggaggctgaggcaggtggatcacctgaggtcaagagttcgagaccagactgaccaacatggtgaaaccccatctctactaaatacaaaaaatttgctgggcacggtggtgcatgcctctaatcccagctacctggaactacctggaaggctgaggcaggagaatcgcttgaacccaggaggtggaggttccagtgagccgagattgtgccattgcactccagcctgggcgacagagcaaaactccatctaaaaaaaaagaaaaaccaacttatctttactgataaagtgtactcatactatggtatatatatctcaaaaaatatttggaatatttttgtttccctttcttaacggattggaatgcacagttttgtaaactgtggggttaaacttctagctgaggtatttaatatcctaaatcagcttccaaatatctgaacttgattggcaaagtccagttttaacaaatgctgtgtgtagggagcacagcagagaactgggatgtctaacccaaggatcagggactaaggctcgttaattttgcccatgggagaagccccctcgaagctcattttatacataatgctaataagcttggtgatttggtttccaagtcaccaagaaattaggaaggacgggctgttaatgacggcaggatggtcacgaggaaaagtgacaactgtcggcaaaacaagagatggaaaaatatttttataaactcagtgctacaggccgggcatggtggctcacacctgtaatcccagcactttgggaggccgaggcaagtggatcacctaaggtcaggagttcaagaccagcctggccaacatggtaaaaccccatctctactagaaatacaaaaattagccgggcgtggtggcaggcacctgtaatcccagctacttaggaggctgaggcaggagaattgactgaacccaggaggcagaggtttcagtgagccaggatcgcgctgctgcactccagcctgcatgacagagcgggactccgtctcaaaaaacaaaaaaaaaaaaaaaaaaaaaaaaaaaaccataaaataaataaacttagcactacagtctggctgtttgatatggggtacaccaaaccctcaactcgaaagaacttgtcatcccttgttttaaggacacaggaaggtatacaatttaagaacaatttgtttttttaatcagaaaatgggagtgggggagtcctgcttaaaatagcaacccttagttatctggaaaatgttttcctgaacatcagtttcccgaaagttctgggttgctgagattttgttttagttttagcctagggatattactctattcttcttggttcttttattaattttcaaaatagttacaggtaataatacctaattatttcattgatacaacaattgatgtaactaattcagtatagtaaagaagcaaaaaatttttgcaaagaaaaattatatgagctggtagagttttgtttctgttctttttatccttctaagataaatcaatgtgattttacagattaatactgattatagcaactcttcttggaatacatttcttccacatacgtgtgaaagagtagttggaaatctcaagtttttaataaatcacatgatcattaaaatagccctgatcctatcttggggtacaaatacttagtgtgaaatgtgccccttccctgtttcagccttctgttttacctcctcattttcatgttctcccagatgttaaaagtgatcctggtatctgattcctctgtaccccggtgcttcctgcttgttcgctcatctttcttctgctgaaagctggacttgcttcttgttttgctttctttggtcaactgggttctggagaggcacttttctgatgaggaaaccccttctgtggtgtccccgaggcccctgctgggaggggctgctgagctgtgggctccttgagcctcctcgcagaagcgggtgatgagtatggactcataaacgcaaggccatgaaaccaatcctctgctttttccttgtaagccaacgacggggcctttgattccagactctaaggtagctttggagtccgtttcgtttccagcccactgctcagccatggcacagcacaggggtggagccacgggtagtaaaggcctgcagaagcacagagagatgcctgcgcccacctcgattttaaataccttcgtttaaaatttagaaaattcacttacttaacttttttttttttttggttggagtctcgctctatcacccagtctggagtgcagtggcgcaatctccgctcactgcagccacctcctcccaggttcaagcaattctgctgcctcagcctcccaagtagctgggattacaggcgccttccaccatgcctgactgatttttgtatttttagtagagacaggttttcgccatgttggccaggcaggtctcaaattcctgacctcaagtaatctgcccgcctcagccttccaaagtgctgggattataggcatgagccaccacacctggccagcttacttaactctcatattctgacatatactgtgtgtacacatcagaccacttgagaaacctcagtttgttttgaggaaaccagtaaggctgattccttgtgcttatatcccaaacttaaagttttatagagtttgttttttagtattcttattttaattttccctccactttattgtggtgtaattaaaattgtatctgttgaaggtatacagtgtgatgttttatatacacacgtcttttgaagtgatcaccagtccagttaattaacatatctatcacctcaaatagttacctttttgtgacaagcacacttaagatctgctgtctcagcaaatttcaagcacacaataccttattatcaactacagttactatcctgtatgttagatctccagaaaaagttttttggtttcttttcttgagacagtatctcgctccgtctcccaggctggagtgcagtagcaggatcaatcttagctcactgcagcctcaacctcctgtcctgggctcaagcaatcctcccatctcaccctcctgagtagctccctgggactacaagggcaccaccatgcctagctaattgttttatttttaatgttatttttgtagagatggagtgtcagtattttgcccaggctaatcttgaactcctgggctcaagcagtcctcctgccttggcctcccaaagtgttgggattacaggcatgagccaccacatccagcctcagaaaagttttataggatttaagtaataatattgtctgtattttattgaccttgtggcatcttcctgtgccaagcacttgatacaaacagtgtgaaatgatttgctctgtgctgatttgtggagggcacgcggggaacttgctgggaactcgctgggaacgtgggagctggtttctacattgtcactgtctgcacgtatcagctcttatttctgaatttggcttttttgcaggtccctagctgttggtagtaagtccggttataaatttttctccctttcttctgtggataagctggaacagatctatgaatgcagtaagtgtttgctttatttttccccttcttaaaaaaaaaaaaaaaagttgtacttgaattggaatgcgatctaaaattcagacgctgtggttgaagtccagacaccctcttaccagtcctctgcttccaccttcatctccccaagaggtggcaactggtgacacctgtggccgtctgccctgatctgtgcatttgcctacataggagggcaggtaccgagggagctctgttcatgagggtcttcagtacatgagcacataccatgtgtactggtctgtaacttctctcccttttaatgccatttaaaccgtctaaattactgtcataaagggcttccagaaaattgaaaattttacagcccctgtaggaacaatttattttcccgcgttggcattttacagcattgaagtggcccgcgtgtcggagaggcgcatggaacagcgggaggtcatgcgctttggcctcttgctcagtcatgttttgtgtggttctagatggattacttcatctctgggcctcagtttcttttattttttgcaaaacagaaataatgcaggtctgtaagattattgccaggattagagattatgtatgtgtgtacttaacagtgtgcaaaaatagtatttgctgagtaaagcctgtgatggagactgtgactggaagctttggaccctttccacgtgcgtaatttttaattaagatagttatggattcacatgtagttgcaggaaataatacaggtcccttgcatcctttaccctgttcttcccagtgtaacatctcgcaaagccccagtgtaatatcatagctgggatattgacatccacctctcctgagcacactctccagtcctccttgtgctcgtttgtgtgtgcgtaggttctgtgcagtcttttttgtttgtttttttttgagacggagttttgctcttactgcccaggctggagtgcagtggtgccatcttggctcaccgcaccctccgtctcccccaggttccagcgattctgaactttgtgctggtgacttttaattatggtgttctcctggcccgccagcaggtgcggcctttcggactcgctcctgggccctggcctcctctctgcaggtgagcctgcaggtgcccctcacctccatcggggatgtgtctgattcttcccagcagtgtctttcctgttgctgcccccaagagcaagtacccaggccctttgcagggagagagtggggcagcagaatttccatgatcagcgtccctgactcatggctcctggtggctggcttaggttttactcctttctttgtccttagacttgcctgctggtacttactaaatcttccaaaaaagcctttcttctgccacggaggctgggagatgtgatctgggcgataacataggtgtgagccagggctgtttatcccaggcgccgcccgccttcctgaagtcctgtcacctggctgccttcacgtgagccacacgggattgctccccacagtggtttctgcagtggagggcagccccgtctccaggcttttacgaatgactgaaactcagtccagatccagatgaagcgcctgaattgtgctgttaaattgttgctggagtcactgtagtcatctgttttgaaatgcacagaggtttttcccttgctgggggccagtgcttataaagagtggaagaatgccaaaacctggtctttccttttcctcaaattgaagtttagttactggcttctagtgccttatttcccagagatttttagtggaacaaaatgggatgtcttgatagtatcttttagagtggatattggccgggcgcagtggctcacgcctgtaatcccagcactttgtaaggccaggacaggcagatcacatgaggccaggagttgaagacgagcctggccaacatggcaaaaccctgtctctactaaaaatacaaaaaaattagccaggcatggtggcgcacacctgtaatcccagctaatagggaggctgaggcacgagaatcacttgaacccaggaggcagaggttgcagtgagccaagattgtgccattgcactccagcctcggtgacagtgagactctgtcttaataaataataaaaaataaagagtggatgtttcctgaccaacatggtaaggtgggtgcatgaatgtctgtgttcttcttagtgaactttggcccttaaaaatagatgatgaaatggacaaagaatgttttgagggttaatactttaaactgatctattacattgttctattccaagaatattatctgcctttcctctttcacactttttttttttagtagataagagaatgtctctagaaaacaggttagctactaagtgaaatgtcaagattgttttctagcatttttctataggtggactcagaggaaagaatgtttcttcatgtctcagtatttagttcaggctcagtattgacgtctaccctcaaaacttttaacaatccatcataaaatcagatctttgctgtcactcactgtggctgttacagaaagaatgggccagagctggtcttagagaaaaacaagatggacagctacttgttgttcttttgtttacttagaaaagaaaattcacacacacacacaaaagcttggtctagcagtactggaagatagattttctaccatcaatgttgtaatttcaaacttgaaagttgcaggaactgccagataggctttgcacattgtttatgggcgcctcatatatgtatatatatggggacagagtctcgctctgtcacccaggctggagtacagtggcataatcatagctcactgtacccttgacctcctgggctcaagcgatcctccctcctcagcctcctgagtagctgggaccacaggcacatgccactacacctggctgatttttttttaatttttgtagaaacggggtcttactatgttgcccaggctggtcttgaactcctggcctcaagcagtcctcccacctcagcctcccaaagtgctgggattataggcgtgagccactgcatccagcctctcatatgatcagtgctgggattacaggcgtgagccaccgcgcccggcctctcatatgatcattttctttctccatgtgcatttttgttgtcgtcattttttgaatatacataatgcacaaaatgtggtctcttttccctaaaatattctacaacagtatcctacactgttaggcaaaataaatgaagggtatgggtttattatttgtaaaagatcacaaaagtttagaagttggcttttttcaaaagctgcactgtgtgttttctttgcatttgctaaactggattctgagctaggaaaacatctcataaacattccgttctgaaacccagcacaagcagactgctccttagctcagcaaaagtgactacagcctgcgttgattatggaagtgtagctgttgacatataacatcttttatcaaccttcctgcttggccaagaaactaatcatttactttacgggccatcatctgcatcttaaggtttgagaaatggtgttttctgacgttagtcttatttgacaggcagtgcactggttggaatattaatttcagtgagatttatagtaatgtatcctacagaggagaaaccacgagcgtcccttggcctaaatctgtggtgctggaatgctggcctcttaccttgcatcctggcggagccgcagacacacacggaagtggattcaagcagttatttcatggcctcattcttcccttcccactccagagcttcatcgttgccaactataaaccacgccagcagaagcaaaaagcaacattcttttttaaatcaagtaattaatttcttagattttagtcaggcaatctctaggagggaagtttggcagaaagtgtggctgaggccacctagaatgagtgctaaaagcaaggcctcattcctccagtgggatggaagtcactaaagtttacgttcagcctttttttttttttttttttttttttgagacggagtgtcgctctgtagcccaggctggagtgtagtggcgcaatcttggctcactgcaagctccgcctcccggattcgcgccattctcctgcctcagcctcccgagtagcgccaccatgcccggctgattttttttgtgtgtgtatttttagtagagacagggtttcaccgtgttagccaggatggtctcgatctcctgacctcatgatccacccgcctcagcctcccaaagtgctgggattataggcgtgagccaccacaccctgccacgttcagtctttcttagtgtcagcgtgagtgcctcttggcactggtgtcctgggacgtgccatcttgagtcaatacatctgtgcagtctggtttctttgctttcttttgattattatggcatctttcacctagcagcctgatccattgtccaccattatttcatgggagggctgagccaggtttgtacttcagtttactggaaagtgattgttctgggtatgcgggttccatgtatatttatatgtttgaaagttcatctgggccgggcgcggtggctcacgcctgttatcccaacactttgggaggccgaggcgggtggatcacctgaggtgaggagttagagaccagcctggccaacatggtgaaaccgcgcctctactaaaaatataaaaattagccggacatggtggcgcgctcctgtaatcccagctactctgcaggctgaggtaggagaatcacttggacccgggagtcaaaggttgcagtgagtcaagattgtgccactgcgctccagcttgggctgtctcaaaaaaattaaaaataagaaagttcatctgtatgtgaagtgtaatagaaaaatattagagcatcttgaaataatacattagaaaaatggcaacaaacctaaactactagcaatatataaaagtaggttgctttctgaaaggtgtattcctgaaaagatctagtcagatttggtccgtagaacttaatgtcactgcgaagtgcatccttttgtgttatggctgttaccactactactactactgcgtttttttttttaaaacacagggtctcgctctgtcactcatgcagtggtgccagcacggctcactgtaacctcaacctcccgggctcaagtgatcctcccccttcttgcatagctgggactgactacaggtgcacaccaccatgcccagctaatttttttttaagagttggggtctcactgtgttgccaaggctggtcttgaactcgtgggctcaggccatcttcctgcctcagcctcctaaagtgctgggcctacaggtgtgagccaacatgcccggcctattagtcttttttttttgagacggagtctcgctgtatcatccaggctggagtgcagtggtgagatctcggctcactgcagcctccgcctcctgggttcaagcaattctcctgcctcagcctcccaaggagctgggattagaggcatgcaccaccacgcccggctacattttgtatttttagtagagacggggtttcaccatgttggctaggctggtctggaactcctgacctcaggttatccatccgcctcagcttcccaaagtgctgggattacaggcgcgagccactgcacccggccctggcctattagtcttaagtaatgacaaaaatatgttcactccagagtgattggtcgttcatttctgccttttgcagagccacctctcctacttttggttactgactcttgtaaatgtgatgagagttatagatctatctcccccagaacactcagtgtttagcatatggtttcagcgacgttagagattcaggaagcccatccagttatccacggacacctggtctttgcagttggccgtcacacttagtttctgtcctgcctctgctgctgcccatgtccccacaggaggaggtggctcactgtgcaacctccacctcccgagttcaagtgattctcctgccttagcctccttagtagctgggactacaggtatgtgtcaccacgctcagctaatttttctattttttttagtagagatggggtttcaccatattgggcaggctggtgttgaactcctgacctcaagtgatccacctgcctctgcctcccaaagtgctgggattataggcatgaaccatcgtgcctggccttatttacaattcttacatcaactcaaactgagttcttttttttttttcccccatgcagtcatgtgctgccactgttttttttttttttaactacctgtttctgccgtttgcctgtttttctgttgggttatttatctcctaatgacttaaagcaaattagccatttgttaggggttgcaaatattttttttttctggactgtcatttgccttttgaccttgtttatgattcttttcaccattctgaagtcttgaatttctatgtattcaaatgcattggtctttttttctaaggcttctaaatactagaaagggtttttcctgctcccagcatgtacataaaacatttcccaaggtggtcctgtaatactctggggtcatgttctaccttcaatacttggagtgtattggatgtaaggaatccctcccttgcattaaggggctgggaaggatgcttgcctgtgtccttacttatgtagaggggcttactctgaagcatttagggtgaatgtcagaaggagcttctcttccaaacttcaataaagaaaaaatcattgaagcaaaatggtagaaagttaatatttgttggattaggtgttgagtatatggaggttcattttactgttctcttttatgaatatttgcagttaaaaacgagcttttctgccttcatcctcccatccctgtttaaagcattctgaaagctctgctttttctcattaacattttagaaaaaccatttccaagtgatggttggtggtattaccttctcagcacctgcacgtaagcaactgaagacatcatttttctttctaacattttattaaaggaaattttcaaactgaaaagtggaaagtattttacagctaacacctgtgtatccaccacttagattcttcccttgacattttactatacttgtcctaacacacacacacacacagacaccatctatcttttttatgtttatttctttttttgagacagcatctagctctgtcacccaggctgccaggctggagtgcagtggtgcaatcatagcttgctacagctttgacctctggggctcaagcgatcctcctgcctctgcctccagagttgctgaggctacaggagtgcaccgccatgctcagctaatttttcgatttttttgtagggacacgatcttgttatgttgtccaggctagtctcaaactcctgggctcaagtgatccacatcagcctcccagagtgctgagattacagacaaaccaccacacctggctttattttgtgtgtgtgtgtgcatttccaggtagacggcaggcatcagtacatttctcctcaatactgagtagagttcaatgtttgtttttttcttgtaagataaaatttacttacagtggaatgcatctatcttgagtgaacactatgtgagttttaacaaatgcctgcatctctgtgaactgaaaccctatcaaggtttaccatcactccagaaagttctctcatacttccttccagtctcagctcccttctgcccacattccccaagaggcaaccagtgttctggtttttttctactgtagattagttttgtcttttctagaacttgatatgaatggagcatctactcttttgatgacgtttcttttgctctgcattttttttagatttatccacatcttatgtctcatttgcccagtatgtgaatatatgacagttgttgatgtattcttttcatgacagttatctgggctctttgtagttcagctattatgaacaaagctaccatgaacattctcgtacaagtcttttaatggacagatattttcacttagataaatattgtagtggaattgttggctagatatgtgtttagttttgtaagaaacccccataaccttctcctaagtgactataccatttgtggttctgtcagtgctgtatgagagttctgattgctctatgtcctcactaactttttttttttttttttttttgagagagtctctgtcgcccaggctggagtgcagtggcacaatctcggctcactgcaacctccacctctggggttcaagcagttctcctccctcagcctcccaagtagctgggattacaggtgtgcaccaccacacctggctaatttttgtatttttggtagagacggggtttcaccatgttggccaggctggcctgagactcctgacctcaggcgatccggccatctcgacctcccaaagtgctgggattacaggcgtgagccaccacacccagcctcctcaccaacttttgatattactagtttttttcttttcagcccttctgatgtgtgtataatgataacttcatggttttaatttgaatttctcaggtaactaatgatgttgaacattttcatgtgcttgttggccgtttatatatcttcctctgtgacatgtctgttccagtcttttgttgctttttaggtttggttgtttatctttttattatagagttgttagagctctttagatattctggataccagtcctttgtcagatatgttttgtgactatttctcctagtctgtggcttgcctgttttctttctttgagcaaatggtttaaattttgatgcagtcatatttatgttgtttttttttttccttccatttatggtttttgctttctaggccctgtccaggaaacttttgcctaccctgtagtcaggaaggtgttttcctatgtgttctgtgaaagctttatatagttaacactatacataaaagctaaagtttttatatttaagtcaataatctatctcattaatttttatgtatgttgtgaggtatgaatcaaggttgtttttttcctaatggattcctattccatcatcatttgttgagaagatttttcttccctcctgggattgctttggtgctttacagtcctgtgacctgtgagtctgtttctggactctttagtctcttctaatgatctatttgtcagtcttcaactttgttctttttcaggatagctttgcattttctagtttcttttcctttccatataaaatttaaaatccactttgtctgcaaaagagcctgttgggattatgattaggatgggattggacctagagatcagtttgagggttgatacgttaataatattgagtacccagaatatggtatatctcttcatttatttagctctttttaaatttgttttggtaatattctgtgatttttttttttttttttttttggtatggaggtcttacatcttttgtaaaatttattcctaatactttggattttgacattatcataaaagaaaattatttcactgagttttccagtttgctgctggcctaaacatatagttaattttttatattttaatcttgtatcctatgactttgctaaattcatatattaaatagttgctccatagattccttaagatggcagtgaaggctgtttgatgtcttgctttctaatgtttgtgccttttatttctttttcttgcctcactgcaacgtgtaagacctcgagcacaaagtaaggagagtgggtatccttgccttgtttctagtcttaacgggaagagatcaaatatcttcaccattaagtacagtgtcagctgtagattttcttaactgtttcttaaccttcatcagtgaaagaaggttcttcctaattccaggtttcttaggtttctaccatgaatgagcattgcattttctcatgctttttctgcatctgttgggttggcacagtctttctctgtgcagttgaattggaatttatcaccacctctaatggcgacttgctctttgagatgatcgtctcatactgttctcactttgaaatctcccacctccatcccatcacagttaacacctgctgctgcttcaagagaggttggtgctgtcggtctggggctcccttctctttccttcttcaggtgaccagccccctaagtggtttgttcctccaggcaagcagtctcaaccataaatccatctcagtatatctagtagctcctgtatttgaagacagaaacttcccttgcccatgcatatcccccagcccctcccatatttctacttctccagaacataacttctttttttgttttgtttttttggtttttttggtggagtctcgttgtgctgcccatgctggagtctggtggtgccatctcggctggctgcaacctccgtctctcaggttcaactgatgctcctgcctcagcctcccaagtagctgggattacaggcgcccaccgcgatgcccggctcattttttgtatttttagtagagatggggtttcatcatgttggccaggctggcctcgaacgcctgacctcaggtgatctgcctgcctcagcctcccaaagtgatgggactccaggcgtgagcccctgcgcctggcctgtagcataactcctatagatagttgcctaagtttttttccacttctcattctctttcatgtttcagccattcttcctacacatctccatcaaaatatgtcaaggtcgccatataagctcctcgttcccagactcaggggacgtgtctcatttcctcttccctcctctgcagtgctgggcacagttacctgcttgctgttcttcagatgccctcttctgttgacttccatctcatacacggtcttggcttttctcttactcaatctcctttgctgacctttggcagtttcggtgccacacagggccctgggcccacatctctttggcctcctctccgtgatggcaggcactgccctgtttaccactgtatacttgggatggtctctactggtgtaggatctgctgtttgtgttgaatgggtgaagtaaataagtcaagttttaccaagcaaagcagtaagaacctattctttgaaaaaaaataaaaatacagttgattcttgttgttcacagttctagtctgtaagtctctgggacgctggattagcgaatcatgaagtgttgctcccaggggaaggattggtaggtggcctctggtcgcaacattttcatcagctgatcaaaagacaacctcgttttgtgtgtgcttccctgcctcaagacatgctgacgtaatggggattgttggttcactaacattgaactcgcggctcgcatagaactcagcccacacatgtgctttctccgcggggtacatcccaggctgcttgtgcttagggatactcgacgacactcagcactgtgccagggccaacagtgaaatcaacaacaagcacaaaagtgcaaaaagcagacactcagtagccctatgtagaccaggaaaaggacagttgttttcagaatcaacacgagaagataggacgttgccctgtgtgacctcagccaggaacatgtgcatcatgtgactcaaatcttttcccgaggctgggagcggtggctcacgcctgtaatccaagcactttgggaggctgaggcgggtgcatcacctgaggtcaggagttcaagaccagcctggccaacatggtgaaaccctgtctctactaaaaatacaaaaattaggcaggcgtggtggcatgcaactgtagtcccagctactcaggaggctgaggcaggagaattgcttgaacccggaaggcagaggttgcagtgagtcgagatcacgccattgcactccagcctgggcaacaaaagcaaaactctgtctcaaaaaaataaaatcccacttcgcatgtgtctacggacggctgtaaaacaccgtgagtgtttatgcggggtcacaaagaaaccttacctagcaggtgagttcacagatactgagcctgtgcatgttgaggagcagccctatttggaagtaagttcttttcaccactgattggatttaggaggccagtggagaggccagtggatttaaataaaattgtacttaataaaaaaccagttttgtgtataccaggttttcctatgtgtcccaaccctgaagttaatgaagctgagagtccaactcttctttcaccattcaggaagtagatatcaggccttacagctaattagagcagagctgagactggaatgtgattgttaaactcgccttcctgcagggtcgccgtggcacccagtactcaccaaggttgcagtgccgcacacacgcccagtacatgtgttaggacgcgtgccgctgagcttcaccaagagcacttctgcctcttggatgtagcactggggttaacagcatttcaccacccactgaaactgaatggcacagagattgagttttgttttttgttgctgttgttgttgttttgatgtttttaaaacaacaccatttggggagtttggggaatatccaaaatctggtcataaggtccattccatccgttcagccagtgtggaaggagctcctcgtctatgacaggcgacattagacctgggggtggtgcagccgtgaatgggccaaacacggcacctgtcctcagaccatcagtccagcagggaactctgtctctcagccattgcctagattctcagtggtaagcgcggtgactactagaggcaacaggtacaggatgcaaccgggccagtgcgtgcagcccctaatactaccaagtactacctgagaatggggtgcctggagagtgagaggctagacagtggccggggaagggccttgtgcccctggatttgcacatctggctgccggatttgagaagtgagggtggcagcctcaggacaccagccatgatcatcattcagtcctaccctcctttttggggcaggactggtattacagacagggtctcgctcttttgcccaggctggcatgcaggaacgtgatcaccgctcattgcagcctcaacctcctgggatcaggcactcttcctacctcagctacacaggcatgcaccaccacgcccagctaatttttgtattttttgtagagataggacctcactatgttgcccaggctggtctcgaattcctgccctcaagcaatcctcccaccttggcctcccaaagtgcggggattacaggtgcgaagcaccgcatctggccccagccctctttctcgcccaccgcctagcaagcagggctgccgtgacttagtatccatgtcaatctcctgagggaaagaggggactggtcagagaaccagggtctgatctttagagaaattatttttactgcaaataattgacattctgggttatgcaccatctcttctgagttgggttggcctcgtgtctgagtggtgctgcatgccaggtgctagaggtgtatccgctgacaaagattcctgtgtccacgcactggcatgatccctcctgatcgtgcctttcgttgacagatcctggaagacggtggccgctagtctgagatgctgctgagcagagaagctgcagacagagcctgtcctccctggccccccgaccctgccaccatctccccatttgtggcagacgcttgcatctgttccttttgaatgaaggtcgcttgctgttgtcagaaagaaggtttatgacagctttctggtaaaagcaactgaaaagacactgaatggatgctgtgaagagcttaggatgatgtacttgtgtttatggcccgttccatttgaagtggtgtcgcactgcaggatggcgcgtaggtcagcgaggggccgcgggtgcgagggtggtcctgtgagaggagcaggccgtgtttttgctgcagctttcccatgtttcattcacacacacaagtacttgtcactgtgctgcagctggccacagtatccagttagtcacacgcagcgcaggtctgtagccaggagccacaggccacagcatacagcctaggggcatagtaggcctaccatctagatttgtgtttgcacgacacaattgcctacggggcttttctttgttttgttgttgttgttgttgttgttgttgttgttgtttttgagatggagtctcgctctgtggcccaggctggagtgcagtggcgcgattttggctcacttcaagctccgtcccccgggttcacaccgttctcctgcctcaggctcctgagtagctgggactacaggcgcccgccaccacgcctggctgattttttgtatttttagtagagatggggtttcaccatgttagccaggatggtcttaatctcccgaccttgtgatccacccacctcggcctcccaaagtgctgggattacaggcgtgagccaccgcgcccggccccttcagggcatttcttagaacgtatgtcagcgttttgtgacatgagtgtaatagcgacatctttttaataaatatgtgtcatgccactttggacatgtgtgattctttggccagcctcagtatgcgagcacgtaggctagcgctcagcacatgagtctatggaacccaggggaagcaattgcagtttcgtagtagtttgtgtcttaattaagggagcccctagaccttactctttcactttacctaggagtttggttcctaaactcaccattcaaatccagcaacagaactgactgaaaggaacctttgtctttcgtgtgaatgctcgtgaggggccatccttagagtggaaatgctcctgaggctccagcgaatcaagaccctcagacccccgggctgtccccaccccatgaccacatgttccgcaggcaccctcagcgctgtgccctgcgtgtcgcccaggcaggtgtttgtttttgagcgcagattctgcctgtggccatagccatgtggagatgttcacgcatgtacttccctttgtgatttcagccgatacggaagatgtgtgcattgtagagagattgttctccagcagcctagtggccatcgtcagccttaaagcaccaaggaagctaaaggtttgccactttaagaagggaactgagatctgcaactacagctactccaacacgattctggctgtgaagctcaacaggcaggtgagcgctgccccagctgggtgtgggcttgtctgttgctccctccagcactctgggacaagcccaccccaccggcatgcccctccgtcattcccttgctgcctggccccacgttgccgggcacagatccttgcctacagagaccagctctgtttcctcacccaccagctttgctcagcccattccattcacgacaaatgcccgggcctctgccacactgctcccatacaggcgtccccggccccacccagagggtggatggcagtctctttcacctattacctggttttgcttttataaatgttacttaaaaaaaatatatttggccgagcacagtggctcacgcctgtaatccccacactttgggaggccgaggcgggcagattgcctgaggtcaggaatttgagatcagcctggccaacatgatgaaaccccgtctctactaaaaatacaaaaattagccgggcatggtggcaggcacctgtaatcccggctactcgggaggctgaggcaggaaaatcgcttgaacccgggagtcggaagttgcagtgagccaaggtcatgtcattgcactccagcttgggcaacaagagtgagacttcgtctcaaaaaaaaaacttacagacttttttttccttttgtaaattgttagtttaactttgaattcaagatgaaggatttattactttatctccccctaaactaataagactgtctggcacagaggaaggacgtggtgggtggcatgtgtgcgtgtttcacgcacgtgtgtgtgtctcccagcttgtgctcacgcccagggtaacagcaccacccgggagacccctggcaatctgattctgcccgcactccctgcagggaaagctgattaggctgctggctgtagagtggacatgatgacagccagtagctgcaccctgagatacagtgactaggtgaagtcacagtagagacgttcttgccttacgcagttgaaactaggaagtggtctgttaactgacatagttggttagaatgggaaattataagacatcatatcttgagcatttaaaaattgtgttcacgtccaactaatgtagagctggtcatctttcttgcataagttgtctcagcgatgcatcgtctgcatgtctacattcattttcttccaaatggagcaggaacttgcaaagtaatctgagtgcacaataaaatgttagaccttttaaaacccccttattttcattttacctgtgctgcactcagcatcagttttaaaaagcaaatctttccaaatctattcacagcacacttgtcttagctgtaggttagcatttgcctaacactaaactaaatggcctggttagaattcccagtagagatggggtgagtatgagggagaggtgcatccggcctggctccttcttgattgttgatggaaagcagctgtatccttggcgcttctaacattggtctgcatggtgttctagaaggaactaagattgtgaagccaacgcaggggtggatcacctgaggtcaggagtccaagaccagcctggccaacatggtgaaaccccatctctactaaaaatacaaaaattagccaggcctggtggcagtcacctgtaattccagctacttgggaggctgaggcaggaaaatcacttgaacccggaaggcagaggttgcagtgagccgagatcacaccactgcactccagcccgggtgacacagcgagacactgactccaaaaaaataaaatacaataacaatagaaggaatgagagcgtcatagtccaggagtcagtcaactggagattggggcaggtattgcactggccgttgcttcacgtttggtttcgttttgtctctcgcctagaggctgatagtatgcctggaggagtccctgtacatccacaacattcgggacatgaaggtgctgcatacgatcagggagacgcctccaaaccctgcaggtgagctaacttgtgaggagagaatcccatttttctgattttgcccttgaaagatagctataggtgagagagattttttctttttataggttccgcagatgagacagattttaaaagtattgatcccaaaccaagctgccttcctactgatgctggtcatgtgaccacataagctcattggtttgatcaactttcaagtttgaggttactgatcagttcaaaccaaaggcctttaatctcttgacaatactggtatcacctaaggtggggatttggggttgcagaactttcctaacacagcaaacaagattgtatccaagctattatttgttcctaatgctctgttaaatgaatgctgaattatgtctgacatccaagaaggaactctcaggtggaagtttgcatctcgtcctccgtgtgtcatttgcaggcctgtgtgcgctgtcaatcaacaacgacaactgctacttggcgtacccagggagcgcgaccatcggagaggtgcaggtcttcgataccattaatttggtgagatgcctttcctgctcgaatagctctctaaagtgtggctttttcctgaagaggagcactgtggtgtccctggcatcctgacttggctcagcaatacaaccgctgcacttttttgtttgtttgtttgtttttgagacagggtctggctctgtcgcccatgctggagtgcagtggtgcagtcctagctcactgcagcctcaacctcctgggctcaattgatcctcctgcctcagcctcccgaggagttacagtcatgcaacaccacacccagctaattttttatttttgtagagatggagtcttgctgggttgcccaggctggcctcaaactcctggccttaagccatcctcccgcctcggccccctaaagtgctgggactacaggcgggtgccccgcgcccagccccactgctctcttctcagtagcagagtaggtctggctcattctgcttctggatctgctgcggcgttcagagcagtgctgagctcctcgccacgggaatgtttgaaggaacatagaaaaccttagggataaattgctttgctttttctaaagttggagcagcatttccttggatgcccagccccagtaaatcaagtgggtttggcatttgtttggaccgtaatggtgttttaggaacagctaattggcacttgcggaccaagtgtcagccctggggcgtgggcggtcactgtgcggtggccactctttattggtgtccctttttcagagagctgcaaacatgattccggctcacgacagtcctttagcggcactggcctttgacgcaagtggaactaaacttgccacggcttcggagaaggtgagtctgcttttccccgggggagcactggtgccaaggcgtccacagactttttcagttctgttcacacagccaccttagaggcaaggtcctatacttaccagctccgggagaagcaaagacagccacccacttgtcaggccacaggcgtgtactgcccgagagtgagcggagcttgcagtgtgccactgggacgggagagctggtccacatttgtagtagaaaatacagaaatgtccagaggagacagaagtgccgtgtgtaaccacaccgctcacccagtgtgtttctaaatgatgaaactaccacataacagtaaagaacccagacagtgatgaaatgtgaaaaagcaaagacagaattctatccagccagtctgaacacatttcagtgtatttcattttctctttagtcaacaaaattgggatcctactatgggtataatttatcctttttcactctgcatgacatttgtctaagttcaaaaacacttgtaatggccgcgcagtatttagttgtgattcatgtcaacatcacccttttgggactttgtttctaatatgttgctgccgtaggtagtagtgtatttaagtcatgtatcaatgttttatatgtatttctaactatgaattcaagagattccagtaagaagaatgtctggctttaaaggagatggcctctaaatgtccccgtgtacctgtgaccgcgtggcgaggctccctggcccccaggagactgaaggctccttgttctcttcctcatttggactgtgcctctcttttcgtttcagttcctcttttcttgaaagttgcgtcttccattcttctgtcttgaggtcgcgtctgttctcccgcctccgttttctccgctcttcattggccaccgatgacctttactttgatttggatatgattttgcttctcattgaaatcctaaaatagcctcccctttcaagccatctctcccctcaaactattgaccagagaagatacaataaaacgtcggctcacttccttagctttcctgcctgggcctttgttcttcagtctcacacccgagttctgtaataatgatgtcaccgcttatgggtcacttctgggtcgtgaattatcctggatcttttatcttcattacctcatttgtttcccctcagcaaggtaaacagttctctgtttcatagcaagggctcagaaaggttaagcggtgtgcccggggccgcccaactgggcagcaacagaggggtcagactccaagtctgactttgattctaattatgctagactatcccaatagcaccttgtccttttcttttccctttgaaatggccctgaaattctgttaccctttgactaatcaaagtctcactgttaatgtttctttagtagctcttataaaggcccaaaagtacttgatggaattttaaggcccataaaaatagatttttttttttctggactataaagaggaaccttgattgcttgtacatggaatgctctcatctgtggagtgagagcagcaaggccttcccagccccgctctgtcccaggtgctgaggccccctgaggcctgtgacttaatcctgctttcaagaatcttgcggtcatgtggcaacaaaacaactcttaattaattagtattgcacggtagacgtgcgccacaaaattatgtctcatctgaaagtttaggctgcagaggacaaaacctttgccgtggttatttttgtatatggatgcagaaaatagttcattctctaattctcaatgttacaagctcagtttgtgtccctccatccagagagaaccaagtgttctcaagtaccagttttttttttttttgagacagggtcatgcttgctctgtcacccaggctggagtgcagtggcacaatctctgctctatgcaacctccatctcccaggcttaagtgatcttcctacttcagcctcccaagtagctgggactacaggcacctgccaccacgcccggctaattgttgtactttttgtagagatggggtttcaccctgttggccaggctggtttcaaactcctgagctcaagcgatctacaaacctcagcctcccaaagtgctagaattacaggagtgagccactgtgcctggcctatattctgatttctaatagctgtatactatcccattgtatgagtttaccataatttatgtaaacagttccttggtgttctacacttaggtcatctgctgctttttgctttttttttttttttgaaacggagtcttgttctgtcccccaggctggagtgcagtgtggtatgatctcagctcaccacaacctctgcctcccaggttcaagcagttctcctgccgcagcctcctgagtagctgagattacaagcgcgcgccaccacacccagctaatttttgtattttgagtagatggggtttaaccacgttggccaggctggtcgtgaactcctgacctcgtgatccacccgccttggcctcccaaagtgctgggattacaggagtgagccaccacgcccagccactttttactatttacaaacacagagatagtgcagtggcatgatcatggctcactgcagcttccactcctgggacaacaggaacgaatcatcaggcttagctgatttttttgttttttgtagaggtggggtcttgttatgttgcccaggctggtcttgaactcctggactctagtgtttctcctgtcttggcctccccaagtgctgggattacaggcatgagttactgcattcagcttagatagtcttttctttctttctttctttcttttttttgagacagagtctctctgtagcccaagctggagtgcaatggcgcgatctcagctcactgcagcctccacctctggggctcaagcgattctcgtgcctcagcctcccaactagctgggactacaggtgcgtgccaccacacccacctaatttttttttttttttttttttgagacggagtcttgctgtgtcacccaggctcaagtgcagtggtatgatctcggctcactgcaacctccgcctcctgggttcaagcgattctcctgcctcagcctcctgagtagctgggattacaggcatgcgccaccatgcccagctaattttgtatttttagtagagacggggtttcaccatgttggccaggctggtctggaactcctcacctcaggtgaccactcacctcgggctcccaaagcttgggattacaggcgtgagtcaccgcacctggcccacacccagctaattcttttgtattttagtagagatgggggtttcaccatgttgcccagggtggtctcgaactcctcacctcaggagatctgcccaccttgaccttccatcagcctagatattcttaacagtttttatatttaacagtttgaacctcctaaaatttgtatagtaggagggtgaatgttgaataattcttcctgccctgcaaatttggaatgctacccattttaaggcctttctttccatcagtctatttctttttgtgctaatttaataccgttatatcacttgatagtattcttttaatattaaagcattcaaagtcctgctcgttattttcttggcgcttctctgtttattcccccagatgttcatgtctgtctcatcatccacagatctgatattaacttgggggaagttggcatcttcaagacacttcccattaaagcaggcacatgccgagctcccttgtattcctagttctttgtcttagtaagattttcttcatgtgcatcttaccatttggtgagttgggattgactccttataaggtagttgagatttccagctaatcggctctctggatccgtaactgaatttaaagtggcaggaaagaccttggtggggtccgaagcctcgtcagaccacaaggtcttgcccgtgtaccacacacaaatccaggcttttattttttttttttttccccccccgagatggagtcttgctccagagctggagtgcagtggtgcagtctcggctcactgcaacctccacctcctgggttcaagcgattcttctgcctcagcctcccgagtagttgggattacaggcatgcgccaccacacccagctaattttgtatttttagtagagacacagtttctccatgttggtcaggctggtctcaaactcctgacctctgatgatctgcccgcctcggcctcccaaagttctgggattacaggcgtgagccaccacgcccggcccaggcttttatttttaatagtttaaacttcagatgactcagaacaatagaatgatatgccacttttgccctgaagactgttagtgttgagagtaagtagtcatttaaaataggtttaaagagaagattgaacattaagtcaacaatagaacaggggagtgtttttctatgctcgtggcaaaaagtgtggagatgatgttcaaggggggccctgggggaccccagactccttggtggcccagggcagagctgtcctggagatagccgtgtggcgcatttgcagtctgctgtgaaagatgggaaattcctgttttaactcagctcaaattcttcttttctcttttccttccacaggggaccgtgattagggtattttccattccagaaggacaaaaactctttgagtttcggagaggagtaaagaggtaaagtacgtgaatgtccagaatggattctggaggttgtatttggatttcagttttatgttatctatgaacaaacaagtagaacccccaggagaattccacacgagcatttctagcccggctgggtcaccgggtaagatctgggcgtcggtcttgtcatgggaattgaagagcactttcagaaaagcaaattgggtttttgtttgcgatcccaccagctagcgtgagagttgtgaagagctcacgcaaccaggtgggccctccagtgcccggcagctcccagcctgctgtaagggacggggcggcgacgtcatgggtagcacaccctcccctttaaaggccacgctctgagaacctgttccagctctccagctccgcctccaccctcagcaaatggcattggccccttcttttaacccagaagccgcagcctggagttctcttgtcttcctccctccaggctgcaaagcttccctcatcggtgcttacatgcctcctgtggcgcctgctttggaggcaggactgtccctccctcgtcggacagtagagcgggggaggcctcgggctctggagcccgtgcctcagattggagccctagggagcactttcagtcgcatggccgtggtcggcgggaccccacctcaggtctgtggctccacgtctcggatcagtacctccctccctgaaggtggctgttgaaagaggaggggctgtctttcggggactctcccgccatctggtcccctttcctcatgggatccccacaggtgcagcaggtgcacctcagtatccccaaacgtcaccgctcctccagctcctgcctcctcgtgtcccttggtcttcttccttacaccacatctttctggagttttcctgtgttgctgcttctgcccagttcccctcctgtgcctgtttctgccctggagccgctcttcacccaacccccttcctcacccccgtggcctgtgtgtgtgctgatcccggggctggacgtgtagcctggcttccttcttgaggtgcccgtattcctcctgcctgctgggcactgggcacctcaagccaccaggccagtttgcccctggcccctcgtccctcacactccccatcttggtaaatagcgccacttgccacccccgccagcaccctggcacccaagccagagggactcggccctgcatccttccgcctgaatggtgcctccagggagctcccacctgtgggcccgccctgtgcctctcccgccacgccacctgatccaggctttgcctggtttctgctgttgccctggattcctgtcaggccgttcttcagactctcacccaggctgtttgaaaaatgtaaatataatccaatcacaccccacctgacatctcccaccacacctctgtcctgcaggattagccccaggcccctgccttggttcagcaggcctcccggcaccagcccttccgcccagcctgattctgtttcactgtccctgtcctggctccagcagtaccgcactttcagatcctcagaagagccgatctcttttatccaccagggtcttgcgtgagctggcagatctggtggcctggccggcttctgtaaccctgggagtccaagtcgagtgtcgccctcgaggaggcctttttttgatccttgggttaaatccctttctccatgcgtctctagtgccttccacgtatttttctcacattcctttgcctgtggcaaatggaatatttgggtgaccgcccaaggggttcaccttgcccgctgcctaggcagagccgattcatcaagatgggaattgcagtagagaaagtaattcatgcagagctggccatgcgggaggctggagttttactactactcaaatcagtctgtctgagcattcagggagcagagtttttaaggataacttgggtggggagaagccagtgagccaggagggctgactggtcagagatgaaatgttagggagtcggagctgtcttcttgcactcagtgagttcctggctgggggccacaagatcagatgagccagttcattgatctgtgtggggccgccggatccatcaagtgcagggtctgcaaaataccataagcaaactttctcccaaagttaattcagcctatgcccggggaggaacaaggacggcttggagatgacaagcaagatggagtcagcaaagctagatctcgttcaccgtctcagtcataattttgcaaaggcggtttcgtttgcacctccctgaccccacccccatcgctggatgctgcattaaggcgagaacattcctaattcatacacatggtcaacactgactccaggaaaaccccttgctattacggacagggctaaaagtatcttgtatttctagggttatgaagaaattcacatgaatttagtggctttgggatgccgattgatttttaagacacactggagccactttccctgttgaaagttttgctctgtctttttttttttttaaataattgagacagagtctcactctgtcgcccaggctggagtgcagtggtgcgatctcagctcactgcaacctctgcctcccaggttcaagcaattctcctgcctcagcctcccgagtagctgggactacaggcacccgccaccacgcccagctaatttttgtaattttagtagagacggggggtttcaccatgttggccaggatggtctcgatatcttgacctcatgatccgcccaccttggcctcccaaagtgctgggattacaagcttgagccaccgtgcccggccctttgctctgttcttaaactttactgaggttgccgatttaccctctggtgtggaaagaatggctgtaacttaaattactgagttttcttttactcaccttaggactataaatccatcctacttcagctaaaagtggtttagtgaaatcctactccttttgtcatgtggaagcttgcagctgtgttaacgaattgttcttagtatttccttttgaacattttcctctctcaaggaaaatgtttgagaaggtggctagaggggaataaaacttaccagcaggcccaagtgtgcccgtgacaggaactcttctccgccacttgagttgaacccctggggcagctgctggctccggtggcccgccccaacctgtgcgtctccccaggtgcgtgagcatctgctccctggccttcagcatggacggcatgttcctctccgcctccagcaacactgagaccgtgcacatcttcaaactcgagactgtgaaagaaaagtgagttgcaaatatacgtttctttaaaaatgatgcaaaaccctttgtccccacttgctgccgggatgagaggtaagcacggacccgcccaccctctgacatcgttagccagtgaagaccccggagctggccatggagcgagcacctccgcatccaggctcggcagtgaggaggatgggccccagcagatgagcttctcccacaggcagcacgcagggtagacagagccctcgcgtagggcatggagggcccaggtggacatccttttgtcagtgaagatggcctctcctcaggttcccctcacgacaaaagcgtttgtgatcagacagcccactagggtgaatggctcgtctcttaccttcccacgggtaagcagagacatggacggcttccacaagaatttattatcgcaatgaatgtgtagcatgaggggggtcttatcttttaagaggggcttactctgttgcccaggctgcagtgcagtggtacagtcattacttattgtagcctctagctgctgggctcaagcgatcctcctgcctcagcctcctgagtacctgggactataggcgtgcaccatgcctggctaatttttaaaattttgtagagacagaatttcgctgtgttgcccaggctggtctggaattcctgggctcaagtgatctgccggtgagccaccgcgcccagcctgtctttaaaaattttaaaaagaacatcccactcagaccagcgttaacaataacatactttaggtggtcaaaaataataaattttgttgggtatatttcatcacaatttttaaaaagacaaatggagcatgccccgccctcccccccaaaaaagatgaatagcaacacaaacaggatacgggaaaataacattttggggtctatactcaaggtttttggagacttctattacagagacctagcaggggtcatcagttaggccctagacgtcctcacacccttgcaaaggggatgtgtggtcagctgccacgtcttgtccgtggccaaaggctgtagctcctccctgaagcctgagcacccctcccccgacacctcccagaggaagctccgtgatgcccctggggccctgagtgtctgcttataaccaaccctgtttaattttcctgtgaagaatggagacttttgctgtcggctccagagctgtgcgtctgtgtgagtagggggtggccgtccccccagggagggtgcagcttcatgtgtctggtggcctttccttccagacccccagaggagcccaccacctggaccgggtacttcgggaaagtgctcatggcctccaccagctacctgccttcccaagtgacagaaatgttcaaccagggcagagccttcgccacggtccgcctgccattctgcggccacaaaaacatctgctcgctagccacgtgagtagagccggcgcctccgtcccccaccccgtgtgcctcaggccgaggggcccagtcctggcggcttgtggccccttccgtgcttctgaacaggagcagcttcttagagccgacactccatcgagagttgtcggggatgggaggtcccctggcaggcactaggcttgccgctctgtgcgggggtccatttccagacgggctcccgttctgtttttgtggatagtctgcggtattaatgaaagacgttaagtcaaacctcgtgagtgtgccgtagttaaccctttggggccacagaaaccgcacttgccgagtctcaggcatccgtccggctccagggtctggcctcagaacacacacagggcctgtggaggttctgtgctgcgtgcgggaaagattgtcattacacccagtgatggcagggctttgggcttccgtgcgtctttaaacatcattttccagttttgttatctgactagcatcctggaaaacttctctgacgatgactacctataataatcccagaagccacaaaactggtttcatcccgctctcgtctcccgtgggcttcagggctcagcacacgagtgcagccttggccgtgtgagccgaggtcagtggggcgccagacacctgcagctgcccttgtgctcatcttgctggggtctctttcctcgcctgccaaaagtgaggccgccatgtagtaagaccgtttctgtgacagttgtctagaatttggctgctctttattctccctagaattcagaagatcccgcggttgttggtgggtgccgccgacgggtacctgtacatgtacaacctggacccccaggagggcggcgagtgtgccctgatgaagcagcaccggtgagtctgctccggccgcttcacggagctgctccgtgctggcggggggctttcggggcacctggcgaacgtttgtttatttccttgcaaaccagtgacatagaggggcagattccagcacagcggcccatgccgcgcaggtcgggagcttcgctttcccaggtgaaatcaatgccgccgcaagacagggagccccgggctgcggctggtggcgtcagggctccctcagggactgggcacagaggcgacgcaggggtggcgggagccgcatttgttcttaggtgggggagaggtgctgggaggccaggccttcctccccagggtggagtttcgcatttggaaaggaagggcgcagcgtggtggcctccacaattcagtgcacgtggctgagagcctcttgtctcactgtgaggtacaggtttgttcttggaaaacagggagttaacatttgttcattgggaagtaatgcattttcattctgtcttacatgttttttaatgatcaaaaagttctaacaacatataattttttattttagagatagggtctcaccctcgcccaggctggagagcagtggtgcagtcacagctcactgcagccttgacctcccaggttcaagggatccttccacctcagcctccctagtagctgggactacaggcacacagcacatccagctaattactttcttgtgcagggtcttgctaggttgtccaggctggtctggaactcctaggctcaagtgagcctcctgccttggcctccccaagtgttggggtaacaggagtgagccgctgcacctagctttttgtgtgtgtgtgtgaaatggagtctcactctgtcacccaggctggagtacagtggcgcgatctcggctcactgcaatctccgcctcccaggttcaagcgattctcctgcctcagcctcccgagtagctgggatgacaggtgcatgccaccatgccctgctaattttttgtatttttagtagagacggggtttcactgtgttagccaggatggtctccgtctcctgacctcgtgatccgcccgcctcagcctcccaaagtgctgggattacaggcgtgagccactgcacccgggctagcctgactttttttgtaaatagtgaatcctcgttattagttagttcttccattgtaaaagtgaaatattgtcttgttaggtataactccctctttagactttccatgtaaaactcttcatgtaaaaacgtgtgcagatagacgagattaaagttgccacggcgtgatgaatgcctggcgtcctgtgtggtgagtggtgtgctggctctgttgccgcagggcagccagtgtgtactgcccgcagggctgccctgtgtggagacgctgagctgtgtcgctttcttccctccaggctggacggcagtctggaaacgaccaatgagatcttggactctgcctctcacgactgccccttagtcactcagacatacggcgcagctgcaggaaaaggtacttacgtgccttcatccccaacgagacttggtaaggggcgtgacgcaaacctggaaggtaattagccccacagccccgagtgctactgccttctgctggctccggagccaccccaccagctcctcactgggaaagatggggactggttctgagaacataagcgaggttggtaaatgggtgttcccaaggcctctctcaaggctgaattcagtttcgtttccttttttttttttttttttaaaggagagatggggtttccctatgttgcccagggtggtctcaaactcctcctgggctcaagtgattctcccgcctcagcctcccacagtgctgggattataggcatgagccaccgtaccaggctcattttctccgtttttaaagaaaatgtcatcctggctcaggtgactctggggtcacgtgacttgggcccagactggccacctctcagccaagataccaccctgaaaagtactgccaagggttttgcctcagtcttttccctcccacctttttcgtccttcagcaaatctgcatcgagtactgccttcatgctgggcctgtgaagtgcagaagctgtaggggaatgaggccaatgggctcccctccggcggcagcactaagacccatgcatgagatcctccagccacagccttggctatgtgagccaccttcttaaaaaagccaactcgcactccagtgggagagcctgtggttttgcacccacgcagggctgtgcctgctcgctgccactcccatctgtgaaccggcacttccagttcatgagcccaccctgagagtctcctagtgtcattttttttcctggtgttatttttgagctcttaaccagcttgagagagtttgtggcccgtccatgagggagcctctgtttactgtgcaggcatcattttgacatttatgaatgtcagagaacaaatgacttcatctcgagctgcctaaggctgcaaagagttcattagaaagcaatcagaattcagaacgtcttagtacaggcttcagtttataaatatacaccagtgtttccaaaacacagtcctcagtgtgtgtcatggggtctgtggtgtgtccccagcctttgaagggtgacttcgtcgtctctttgcagcctacacagacgacctgggtgctgtgggtggcgcctgcctggaggacgaggccagcgccctgcgcctggatgaggacagcgagcacccgcccatgattcttcggactgactgaacttgacctgtgacctctgacccggggagcagagaacactggcttcacagaggactttgtgcattgctgctatgaactttgacctgagtcgggggagaggatggcagagactttattaaaaaaaaaaaaagattgtagtggtagtctaactccataacgctgaggaaatacatcattttcacttcagtggcttttaaatcctgcttatgaattttagctttttgtttgtttgttttctctttttgccaaaattaactgtttggtgaagcccgcaaaacctcctcgctttgcatgcatgaacgtgccaagccagcataggggagctagaagccactttccagccacctgccgttgggttttttcatatctgtacataatgccgagtgcgtaaggaaaccgtggcgtcgcgcacagtgggtctgcttgtcaaggccagttctgcagtgacaggcccaggggctgcccaccaggtgtgctgggcagacttcagctgggacagaagtccgatctccctagggccccacctggaccattttccctccgttttattttgttaattaaattctttccaaattggatcgctctgggatttcttccatggtggacttttgtttctgatcttgttttccctgtggatattggaggacagcgaggttctttctgatactaaaaacctttctttcaggcagcaaatgaacttgaaaggttgcctggactcgctggagcaaaggaaagcgattttgtttgtataattaaatgatctgttcttctacttcactcttcctgttgaaaaactgtgtgatttttttttttttttaagtaaagtttgtagctcctcccatgcccaggaaagcacagaactcaagtgtggtggccgtctgagctgtcctttcgctggccccgctgtccgcaggggcttcctacctgtgtgagaggtcgtagcgggagacagcaacagagagtaggcggctgggccacgtccttcacagggcgtcatgtgcctttctattttcatcttagaaaatttcctcagcaaaccgatgagagattgtggttgcaagcttcagtatttgcctcgcttcccttcccttttcatatttacagaattaaaacaacctcaagtacctcagactctgcattccaaaccaaggcacccagcagccaaagtgtcgagggcatttaagtggcattaatggcaggagagatggttttagaatctatggagtggtggaagttacggatagaagggaaaaggcaaaaactatttaccctgcctttgcaggctggggtttttgaaccgaggaaggctgggacgcctgtttccagatggttgtcatggtcacgctgggcgaagagctggaggggagttgtcccctcagctgagcggctgcggtgaaatgccccagtgttcctgggttggctttacggcaaactaaatgcaggggacgctggagtccgactcacctacaccggcttcctcccagccgctggtgtgcggcacacacaacatctgcattaggcagaggtgcaagtgggctgattgaacttttccttcaaaacctgcttgtctgtcctggacctttgatgaaatgggatcccggtcacgcaggctgagacagtggggaccgccgaggccagagtgggctatgcttgagcagggatgagaagggccgcggcagcacgcagccttgacccacgcctgcgtcttgtggtgcaaggccagagggctctctctagaacctgaccgtgcactccatctcctgggagccacttttggcaagagtgagtgtggggggaaaaagtgtgcacaagagatacggaaccctgagctagggtttcctgtcaccaaagagtgagctgcatttccagttctgcgttaaagtatcgtttgttctggtgcctgcctgtggtggtgatttggagactcaaatttcctttgccaggtctcttttgtctttctttgggattggtagtatagaagatgctgggaattgtcttcctcgctcagcctcggcttcccgcactgtaagatgaggcagttgcagaggaggcctcggacgtcctgtgaccctcggcccacactcccccttgggtggccctggcagggctggctaggtgcgttccctgcagaccacgggaagccctgtgcttgcctgggtcagggctaagctgtgcgccctagaggagggaggaggactgcagattcttggtcgagaagaatgaagaggatttctgtgtttgctgagcagccattgtggagggttacccgcctccactttcccgttgcccatttcactgccaccagctcctcttcctctgctcgaacctatgagtcccagcctcactggcggcctcagacatgctcaggagtgacggggacagagggaggccgctgagttgcccgttagaactcttactgctgcgccagtgacccaggtggagagggaccctgaaccaaacagaacgtgtgctaattttccgaactccaaactgtacactcatattcatttttaaattgtatttttccaaacttcaaaaaggacgatgagcgtgggggataggaaacaaaacctgtaaacgttgtgaatgggctcagtggactctgggaccaaaccttctgtaatctctaaaacaatgggaccaagagctggatggaacctggagtcaaaaagaactgcttcagtccccgctgtaccgcctgcctagctgtgggagcaggcagggcgcctgggagcctgcgttttctggaccgttccatgggactcatccctacctcacagggctgttgtgaggtgttgtgtgactgcgtgtcctgcaaacgcccagctcggtgcccagccagcggtgggcacccaataaacgctacaacataaatgtgtcttctgcaattaaacacgatttttattca

SEQ ID NO: 739 - DNA, 43652 bp, Homo sapiens; identical to SEQ ID NO: 738

SEQ ID NO: 740 - DNA, 43652 bp, Homo sapiens; identical to SEQ ID NO: 738

SEQ ID NO: 741 - DNA, 43652 bp, Homo sapiens; identical to SEQ ID NO: 738

SEQ ID NO: 742 - DNA, 19587 bp, Homo sapiens
acagaactgactgaaaggaacctttgtctttcgtgtgaatgctcgtgaggggccatccttagagtggaaatgctcctgaggctccagcgaatcaagaccctcagacccccgggctgtccccaccccatgaccacatgttccgcaggcaccctcagcgctgtgccctgcgtgtcgcccaggcaggtgtttgtttttgagcgcagattctgcctgtggccatagccatgtggagatgttcacgcatgtacttccctttgtgatttcagccgatacggaagatgtgtgcattgtagagagattgttctccagcagcctagtggccatcgtcagccttaaagcaccaaggaagctaaaggtttgccactttaagaagggaactgagatctgcaactacagctactccaacacgattctggctgtgaagctcaacaggcaggtgagcgctgccccagctgggtgtgggcttgtctgttgctccctccagcactctgggacaagcccaccccaccggcatgcccctccgtcattcccttgctgcctggccccacgttgccgggcacagatccttgcctacagagaccagctctgtttcctcacccaccagctttgctcagcccattccattcacgacaaatgcccgggcctctgccacactgctcccatacaggcgtccccggccccacccagagggtggatggcagtctctttcacctattacctggttttgcttttataaatgttacttaaaaaaaatatatttggccgagcacagtggctcacgcctgtaatccccacactttgggaggccgaggcgggcagattgcctgaggtcaggaatttgagatcagcctggccaacatgatgaaaccccgtctctactaaaaatacaaaaattagccgggcatggtggcaggcacctgtaatcccggctactcgggaggctgaggcaggaaaatcgcttgaacccgggagtcggaagttgcagtgagccaaggtcatgtcattgcactccagcttgggcaacaagagtgagacttcgtctcaaaaaaaaaacttacagacttttttttccttttgtaaattgttagtttaactttgaattcaagatgaaggatttattactttatctccccctaaactaataagactgtctggcacagaggaaggacgtggtgggtggcatgtgtgcgtgtttcacgcacgtgtgtgtgtctcccagcttgtgctcacgcccagggtaacagcaccacccgggagacccctggcaatctgattctgcccgcactccctgcagggaaagctgattaggctgctggctgtagagtggacatgatgacagccagtagctgcaccctgagatacagtgactaggtgaagtcacagtagagacgttcttgccttacgcagttgaaactaggaagtggtctgttaactgacatagttggttagaatgggaaattataagacatcatatcttgagcatttaaaaattgtgttcacgtccaactaatgtagagctggtcatctttcttgcataagttgtctcagcgatgcatcgtctgcatgtctacattcattttcttccaaatggagcaggaacttgcaaagtaatctgagtgcacaataaaatgttagaccttttaaaacccccttattttcattttacctgtgctgcactcagcatcagttttaaaaagcaaatctttccaaatctattcacagcacacttgtcttagctgtaggttagcatttgcctaacactaaactaaatggcctggttagaattcccagtagagatggggtgagtatgagggagaggtgcatccggcctggctccttcttgattgttgatggaaagcagctgtatccttggcgcttctaacattggtctgcatggtgttctagaaggaactaagattgtgaagccaacgcaggggtggatcacctgaggtcaggagtccaagaccagcctggccaacatggtgaaaccccatctctactaaaaatacaaaaattagccaggcctggtggcagtcacctgtaattccagctacttgggaggctgaggcaggaaaatcacttgaacccggaaggcagaggttgcagtgagccgagatcacaccactgcactccagcccgggtgacacagcgagacactgactccaaaaaaataaaatacaataacaatagaaggaatgagagcgtcatagtccaggagtcagtcaactggagattggggcaggtattgcactggccgttgcttcacgtttggtttcgttttgtctctcgcctagaggctgatagtatgcctggaggagtccctgtacatccacaacattcgggacatgaaggtgctgcatacgatcagggagacgcctccaaaccctgcaggtgagctaacttgtgaggagagaatcccatttttctgattttgcccttgaaagatagctataggtgagagagattttttctttttataggttccgcagatgagacagattttaaaagtattgatcccaaaccaagctgccttcctactgatgctggtcatgtgaccacataagctcattggtttgatcaactttcaagtttgaggttactgatcagttcaaaccaaaggcctttaatctcttgacaatactggtatcacctaaggtggggatttggggttgcagaactttcctaacacagcaaacaagattgtatccaagctattatttgttcctaatgctctgttaaatgaatgctgaattatgtctgacatccaagaaggaactctcaggtggaagtttgcatctcgtcctccgtgtgtcatttgcaggcctgtgtgcgctgtcaatcaacaacgacaactgctacttggcgtacccagggagcgcgaccatcggagaggtgcaggtcttcgataccattaatttggtgagatgcctttcctgctcgaatagctctctaaagtgtggctttttcctgaagaggagcactgtggtgtccctggcatcctgacttggctcagcaatacaaccgctgcacttttttgtttgtttgtttgtttttgagacagggtctggctctgtcgcccatgctggagtgcagtggtgcagtcctagctcactgcagcctcaacctcctgggctcaattgatcctcctgcctcagcctcccgaggagttacagtcatgcaacaccacacccagctaattttttatttttgtagagatggagtcttgctgggttgcccaggctggcctcaaactcctggccttaagccatcctcccgcctcggccccctaaagtgctgggactacaggcgggtgccccgcgcccagccccactgctctcttctcagtagcagagtaggtctggctcattctgcttctggatctgctgcggcgttcagagcagtgctgagctcctcgccacgggaatgtttgaaggaacatagaaaaccttagggataaattgctttgctttttctaaagttggagcagcatttccttggatgcccagccccagtaaatcaagtgggtttggcatttgtttggaccgtaatggtgttttaggaacagctaattggcacttgcggaccaagtgtcagccctggggcgtgggcggtcactgtgcggtggccactctttattggtgtccctttttcagagagctgcaaacatgattccggctcacgacagtcctttagcggcactggcctttgacgcaagtggaactaaacttgccacggcttcggagaaggtgagtctgcttttccccgggggagcactggtgccaaggcgtccacagactttttcagttctgttcacacagccaccttagaggcaaggtcctatacttaccagctccgggagaagcaaagacagccacccacttgtcaggccacaggcgtgtactgcccgagagtgagcggagcttgcagtgtgccactgggacgggagagctggtccacatttgtagtagaaaatacagaaatgtccagaggagacagaagtgccgtgtgtaaccacaccgctcacccagtgtgtttctaaatgatgaaactaccacataacagtaaagaacccagacagtgatgaaatgtgaaaaagcaaagacagaattctatccagccagtctgaacacatttcagtgtatttcattttctctttagtcaacaaaattgggatcctactatgggtataatttatcctttttcactctgcatgacatttgtctaagttcaaaaacacttgtaatggccgcgcagtatttagttgtgattcatgtcaacatcacccttttgggactttgtttctaatatgttgctgccgtaggtagtagtgtatttaagtcatgtatcaatgttttatatgtatttctaactatgaattcaagagattccagtaagaagaatgtctggctttaaaggagatggcctctaaatgtccccgtgtacctgtgaccgcgtggcgaggctccctggcccccaggagactgaaggctccttgttctcttcctcatttggactgtgcctctcttttcgtttcagttcctcttttcttgaaagttgcgtcttccattcttctgtcttgaggtcgcgtctgttctcccgcctccgttttctccgctcttcattggccaccgatgacctttactttgatttggatatgattttgcttctcattgaaatcctaaaatagcctcccctttcaagccatctctcccctcaaactattgaccagagaagatacaataaaacgtcggctcacttccttagctttcctgcctgggcctttgttcttcagtctcacacccgagttctgtaataatgatgtcaccgcttatgggtcacttctgggtcgtgaattatcctggatcttttatcttcattacctcatttgtttcccctcagcaaggtaaacagttctctgtttcatagcaagggctcagaaaggttaagcggtgtgcccggggccgcccaactgggcagcaacagaggggtcagactccaagtctgactttgattctaattatgctagactatcccaatagcaccttgtccttttcttttccctttgaaatggccctgaaattctgttaccctttgactaatcaaagtctcactgttaatgtttctttagtagctcttataaaggcccaaaagtacttgatggaattttaaggcccataaaaatagatttttttttttctggactataaagaggaaccttgattgcttgtacatggaatgctctcatctgtggagtgagagcagcaaggccttcccagccccgctctgtcccaggtgctgaggccccctgaggcctgtgacttaatcctgctttcaagaatcttgcggtcatgtggcaacaaaacaactcttaattaattagtattgcacggtagacgtgcgccacaaaattatgtctcatctgaaagtttaggctgcagaggacaaaacctttgccgtggttatttttgtatatggatgcagaaaatagttcattctctaattctcaatgttacaagctcagtttgtgtccctccatccagagagaaccaagtgttctcaagtaccagttttttttttttttgagacagggtcatgcttgctctgtcacccaggctggagtgcagtggcacaatctctgctctatgcaacctccatctcccaggcttaagtgatcttcctacttcagcctcccaagtagctgggactacaggcacctgccaccacgcccggctaattgttgtactttttgtagagatggggtttcaccctgttggccaggctggtttcaaactcctgagctcaagcgatctacaaacctcagcctcccaaagtgctagaattacaggagtgagccactgtgcctggcctatattctgatttctaatagctgtatactatcccattgtatgagtttaccataatttatgtaaacagttccttggtgttctacacttaggtcatctgctgctttttgctttttttttttttttgaaacggagtcttgttctgtcccccaggctggagtgcagtgtggtatgatctcagctcaccacaacctctgcctcccaggttcaagcagttctcctgccgcagcctcctgagtagctgagattacaagcgcgcgccaccacacccagctaatttttgtattttgagtagatggggtttaaccacgttggccaggctggtcgtgaactcctgacctcgtgatccacccgccttggcctcccaaagtgctgggattacaggagtgagccaccacgcccagccactttttactatttacaaacacagagatagtgcagtggcatgatcatggctcactgcagcttccactcctgggacaacaggaacgaatcatcaggcttagctgatttttttgttttttgtagaggtggggtcttgttatgttgcccaggctggtcttgaactcctggactctagtgtttctcctgtcttggcctccccaagtgctgggattacaggcatgagttactgcattcagcttagatagtcttttctttctttctttctttcttttttttgagacagagtctctctgtagcccaagctggagtgcaatggcgcgatctcagctcactgcagcctccacctctggggctcaagcgattctcgtgcctcagcctcccaactagctgggactacaggtgcgtgccaccacacccacctaatttttttttttttttttttttgagacggagtcttgctgtgtcacccaggctcaagtgcagtggtatgatctcggctcactgcaacctccgcctcctgggttcaagcgattctcctgcctcagcctcctgagtagctgggattacaggcatgcgccaccatgcccagctaattttgtatttttagtagagacggggtttcaccatgttggccaggctggtctggaactcctcacctcaggtgaccactcacctcgggctcccaaagcttgggattacaggcgtgagtcaccgcacctggcccacacccagctaattcttttgtattttagtagagatgggggtttcaccatgttgcccagggtggtctcgaactcctcacctcaggagatctgcccaccttgaccttccatcagcctagatattcttaacagtttttatatttaacagtttgaacctcctaaaatttgtatagtaggagggtgaatgttgaataattcttcctgccctgcaaatttggaatgctacccattttaaggcctttctttccatcagtctatttctttttgtgctaatttaataccgttatatcacttgatagtattcttttaatattaaagcattcaaagtcctgctcgttattttcttggcgcttctctgtttattcccccagatgttcatgtctgtctcatcatccacagatctgatattaacttgggggaagttggcatcttcaagacacttcccattaaagcaggcacatgccgagctcccttgtattcctagttctttgtcttagtaagattttcttcatgtgcatcttaccatttggtgagttgggattgactccttataaggtagttgagatttccagctaatcggctctctggatccgtaactgaatttaaagtggcaggaaagaccttggtggggtccgaagcctcgtcagaccacaaggtcttgcccgtgtaccacacacaaatccaggcttttattttttttttttttccccccccgagatggagtcttgctccagagctggagtgcagtggtgcagtctcggctcactgcaacctccacctcctgggttcaagcgattcttctgcctcagcctcccgagtagttgggattacaggcatgcgccaccacacccagctaattttgtatttttagtagagacacagtttctccatgttggtcaggctggtctcaaactcctgacctctgatgatctgcccgcctcggcctcccaaagttctgggattacaggcgtgagccaccacgcccggcccaggcttttatttttaatagtttaaacttcagatgactcagaacaatagaatgatatgccacttttgccctgaagactgttagtgttgagagtaagtagtcatttaaaataggtttaaagagaagattgaacattaagtcaacaatagaacaggggagtgtttttctatgctcgtggcaaaaagtgtggagatgatgttcaaggggggccctgggggaccccagactccttggtggcccagggcagagctgtcctggagatagccgtgtggcgcatttgcagtctgctgtgaaagatgggaaattcctgttttaactcagctcaaattcttcttttctcttttccttccacaggggaccgtgattagggtattttccattccagaaggacaaaaactctttgagtttcggagaggagtaaagaggtaaagtacgtgaatgtccagaatggattctggaggttgtatttggatttcagttttatgttatctatgaacaaacaagtagaacccccaggagaattccacacgagcatttctagcccggctgggtcaccgggtaagatctgggcgtcggtcttgtcatgggaattgaagagcactttcagaaaagcaaattgggtttttgtttgcgatcccaccagctagcgtgagagttgtgaagagctcacgcaaccaggtgggccctccagtgcccggcagctcccagcctgctgtaagggacggggcggcgacgtcatgggtagcacaccctcccctttaaaggccacgctctgagaacctgttccagctctccagctccgcctccaccctcagcaaatggcattggccccttcttttaacccagaagccgcagcctggagttctcttgtcttcctccctccaggctgcaaagcttccctcatcggtgcttacatgcctcctgtggcgcctgctttggaggcaggactgtccctccctcgtcggacagtagagcgggggaggcctcgggctctggagcccgtgcctcagattggagccctagggagcactttcagtcgcatggccgtggtcggcgggaccccacctcaggtctgtggctccacgtctcggatcagtacctccctccctgaaggtggctgttgaaagaggaggggctgtctttcggggactctcccgccatctggtcccctttcctcatgggatccccacaggtgcagcaggtgcacctcagtatccccaaacgtcaccgctcctccagctcctgcctcctcgtgtcccttggtcttcttccttacaccacatctttctggagttttcctgtgttgctgcttctgcccagttcccctcctgtgcctgtttctgccctggagccgctcttcacccaacccccttcctcacccccgtggcctgtgtgtgtgctgatcccggggctggacgtgtagcctggcttccttcttgaggtgcccgtattcctcctgcctgctgggcactgggcacctcaagccaccaggccagtttgcccctggcccctcgtccctcacactccccatcttggtaaatagcgccacttgccacccccgccagcaccctggcacccaagccagagggactcggccctgcatccttccgcctgaatggtgcctccagggagctcccacctgtgggcccgccctgtgcctctcccgccacgccacctgatccaggctttgcctggtttctgctgttgccctggattcctgtcaggccgttcttcagactctcacccaggctgtttgaaaaatgtaaatataatccaatcacaccccacctgacatctcccaccacacctctgtcctgcaggattagccccaggcccctgccttggttcagcaggcctcccggcaccagcccttccgcccagcctgattctgtttcactgtccctgtcctggctccagcagtaccgcactttcagatcctcagaagagccgatctcttttatccaccagggtcttgcgtgagctggcagatctggtggcctggccggcttctgtaaccctgggagtccaagtcgagtgtcgccctcgaggaggcctttttttgatccttgggttaaatccctttctccatgcgtctctagtgccttccacgtatttttctcacattcctttgcctgtggcaaatggaatatttgggtgaccgcccaaggggttcaccttgcccgctgcctaggcagagccgattcatcaagatgggaattgcagtagagaaagtaattcatgcagagctggccatgcgggaggctggagttttactactactcaaatcagtctgtctgagcattcagggagcagagtttttaaggataacttgggtggggagaagccagtgagccaggagggctgactggtcagagatgaaatgttagggagtcggagctgtcttcttgcactcagtgagttcctggctgggggccacaagatcagatgagccagttcattgatctgtgtggggccgccggatccatcaagtgcagggtctgcaaaataccataagcaaactttctcccaaagttaattcagcctatgcccggggaggaacaaggacggcttggagatgacaagcaagatggagtcagcaaagctagatctcgttcaccgtctcagtcataattttgcaaaggcggtttcgtttgcacctccctgaccccacccccatcgctggatgctgcattaaggcgagaacattcctaattcatacacatggtcaacactgactccaggaaaaccccttgctattacggacagggctaaaagtatcttgtatttctagggttatgaagaaattcacatgaatttagtggctttgggatgccgattgatttttaagacacactggagccactttccctgttgaaagttttgctctgtctttttttttttttaaataattgagacagagtctcactctgtcgcccaggctggagtgcagtggtgcgatctcagctcactgcaacctctgcctcccaggttcaagcaattctcctgcctcagcctcccgagtagctgggactacaggcacccgccaccacgcccagctaatttttgtaattttagtagagacggggggtttcaccatgttggccaggatggtctcgatatcttgacctcatgatccgcccaccttggcctcccaaagtgctgggattacaagcttgagccaccgtgcccggccctttgctctgttcttaaactttactgaggttgccgatttaccctctggtgtggaaagaatggctgtaacttaaattactgagttttcttttactcaccttaggactataaatccatcctacttcagctaaaagtggtttagtgaaatcctactccttttgtcatgtggaagcttgcagctgtgttaacgaattgttcttagtatttccttttgaacattttcctctctcaaggaaaatgtttgagaaggtggctagaggggaataaaacttaccagcaggcccaagtgtgcccgtgacaggaactcttctccgccacttgagttgaacccctggggcagctgctggctccggtggcccgccccaacctgtgcgtctccccaggtgcgtgagcatctgctccctggccttcagcatggacggcatgttcctctccgcctccagcaacactgagaccgtgcacatcttcaaactcgagactgtgaaagaaaagtgagttgcaaatatacgtttctttaaaaatgatgcaaaaccctttgtccccacttgctgccgggatgagaggtaagcacggacccgcccaccctctgacatcgttagccagtgaagaccccggagctggccatggagcgagcacctccgcatccaggctcggcagtgaggaggatgggccccagcagatgagcttctcccacaggcagcacgcagggtagacagagccctcgcgtagggcatggagggcccaggtggacatccttttgtcagtgaagatggcctctcctcaggttcccctcacgacaaaagcgtttgtgatcagacagcccactagggtgaatggctcgtctcttaccttcccacgggtaagcagagacatggacggcttccacaagaatttattatcgcaatgaatgtgtagcatgaggggggtcttatcttttaagaggggcttactctgttgcccaggctgcagtgcagtggtacagtcattacttattgtagcctctagctgctgggctcaagcgatcctcctgcctcagcctcctgagtacctgggactataggcgtgcaccatgcctggctaatttttaaaattttgtagagacagaatttcgctgtgttgcccaggctggtctggaattcctgggctcaagtgatctgccggtgagccaccgcgcccagcctgtctttaaaaattttaaaaagaacatcccactcagaccagcgttaacaataacatactttaggtggtcaaaaataataaattttgttgggtatatttcatcacaatttttaaaaagacaaatggagcatgccccgccctcccccccaaaaaagatgaatagcaacacaaacaggatacgggaaaataacattttggggtctatactcaaggtttttggagacttctattacagagacctagcaggggtcatcagttaggccctagacgtcctcacacccttgcaaaggggatgtgtggtcagctgccacgtcttgtccgtggccaaaggctgtagctcctccctgaagcctgagcacccctcccccgacacctcccagaggaagctccgtgatgcccctggggccctgagtgtctgcttataaccaaccctgtttaattttcctgtgaagaatggagacttttgctgtcggctccagagctgtgcgtctgtgtgagtagggggtggccgtccccccagggagggtgcagcttcatgtgtctggtggcctttccttccagacccccagaggagcccaccacctggaccgggtacttcgggaaagtgctcatggcctccaccagctacctgccttcccaagtgacagaaatgttcaaccagggcagagccttcgccacggtccgcctgccattctgcggccacaaaaacatctgctcgctagccacgtgagtagagccggcgcctccgtcccccaccccgtgtgcctcaggccgaggggcccagtcctggcggcttgtggccccttccgtgcttctgaacaggagcagcttcttagagccgacactccatcgagagttgtcggggatgggaggtcccctggcaggcactaggcttgccgctctgtgcgggggtccatttccagacgggctcccgttctgtttttgtggatagtctgcggtattaatgaaagacgttaagtcaaacctcgtgagtgtgccgtagttaaccctttggggccacagaaaccgcacttgccgagtctcaggcatccgtccggctccagggtctggcctcagaacacacacagggcctgtggaggttctgtgctgcgtgcgggaaagattgtcattacacccagtgatggcagggctttgggcttccgtgcgtctttaaacatcattttccagttttgttatctgactagcatcctggaaaacttctctgacgatgactacctataataatcccagaagccacaaaactggtttcatcccgctctcgtctcccgtgggcttcagggctcagcacacgagtgcagccttggccgtgtgagccgaggtcagtggggcgccagacacctgcagctgcccttgtgctcatcttgctggggtctctttcctcgcctgccaaaagtgaggccgccatgtagtaagaccgtttctgtgacagttgtctagaatttggctgctctttattctccctagaattcagaagatcccgcggttgttggtgggtgccgccgacgggtacctgtacatgtacaacctggacccccaggagggcggcgagtgtgccctgatgaagcagcaccggtgagtctgctccggccgcttcacggagctgctccgtgctggcggggggctttcggggcacctggcgaacgtttgtttatttccttgcaaaccagtgacatagaggggcagattccagcacagcggcccatgccgcgcaggtcgggagcttcgctttcccaggtgaaatcaatgccgccgcaagacagggagccccgggctgcggctggtggcgtcagggctccctcagggactgggcacagaggcgacgcaggggtggcgggagccgcatttgttcttaggtgggggagaggtgctgggaggccaggccttcctccccagggtggagtttcgcatttggaaaggaagggcgcagcgtggtggcctccacaattcagtgcacgtggctgagagcctcttgtctcactgtgaggtacaggtttgttcttggaaaacagggagttaacatttgttcattgggaagtaatgcattttcattctgtcttacatgttttttaatgatcaaaaagttctaacaacatataattttttattttagagatagggtctcaccctcgcccaggctggagagcagtggtgcagtcacagctcactgcagccttgacctcccaggttcaagggatccttccacctcagcctccctagtagctgggactacaggcacacagcacatccagctaattactttcttgtgcagggtcttgctaggttgtccaggctggtctggaactcctaggctcaagtgagcctcctgccttggcctccccaagtgttggggtaacaggagtgagccgctgcacctagctttttgtgtgtgtgtgtgaaatggagtctcactctgtcacccaggctggagtacagtggcgcgatctcggctcactgcaatctccgcctcccaggttcaagcgattctcctgcctcagcctcccgagtagctgggatgacaggtgcatgccaccatgccctgctaattttttgtatttttagtagagacggggtttcactgtgttagccaggatggtctccgtctcctgacctcgtgatccgcccgcctcagcctcccaaagtgctgggattacaggcgtgagccactgcacccgggctagcctgactttttttgtaaatagtgaatcctcgttattagttagttcttccattgtaaaagtgaaatattgtcttgttaggtataactccctctttagactttccatgtaaaactcttcatgtaaaaacgtgtgcagatagacgagattaaagttgccacggcgtgatgaatgcctggcgtcctgtgtggtgagtggtgtgctggctctgttgccgcagggcagccagtgtgtactgcccgcagggctgccctgtgtggagacgctgagctgtgtcgctttcttccctccaggctggacggcagtctggaaacgaccaatgagatcttggactctgcctctcacgactgccccttagtcactcagacatacggcgcagctgcaggaaaaggtacttacgtgccttcatccccaacgagacttggtaaggggcgtgacgcaaacctggaaggtaattagccccacagccccgagtgctactgccttctgctggctccggagccaccccaccagctcctcactgggaaagatggggactggttctgagaacataagcgaggttggtaaatgggtgttcccaaggcctctctcaaggctgaattcagtttcgtttccttttttttttttttttttaaaggagagatggggtttccctatgttgcccagggtggtctcaaactcctcctgggctcaagtgattctcccgcctcagcctcccacagtgctgggattataggcatgagccaccgtaccaggctcattttctccgtttttaaagaaaatgtcatcctggctcaggtgactctggggtcacgtgacttgggcccagactggccacctctcagccaagataccaccctgaaaagtactgccaagggttttgcctcagtcttttccctcccacctttttcgtccttcagcaaatctgcatcgagtactgccttcatgctgggcctgtgaagtgcagaagctgtaggggaatgaggccaatgggctcccctccggcggcagcactaagacccatgcatgagatcctccagccacagccttggctatgtgagccaccttcttaaaaaagccaactcgcactccagtgggagagcctgtggttttgcacccacgcagggctgtgcctgctcgctgccactcccatctgtgaaccggcacttccagttcatgagcccaccctgagagtctcctagtgtcattttttttcctggtgttatttttgagctcttaaccagcttgagagagtttgtggcccgtccatgagggagcctctgtttactgtgcaggcatcattttgacatttatgaatgtcagagaacaaatgacttcatctcgagctgcctaaggctgcaaagagttcattagaaagcaatcagaattcagaacgtcttagtacaggcttcagtttataaatatacaccagtgtttccaaaacacagtcctcagtgtgtgtcatggggtctgtggtgtgtccccagcctttgaagggtgacttcgtcgtctctttgcagcctacacagacgacctgggtgctgtgggtggcgcctgcctggaggacgaggccagcgccctgcgcctggatgaggacagcgagcacccgcccatgattcttcggactgactgaacttgacctgtgacctctgacccggggagcagagaacactggcttcacagaggactttgtgcattgctgctatgaactttgacctgagtcgggggagaggatggcagagactttattaaaaaaaaaaaaagattgtagtggtagtctaactccataacgctgaggaaatacatcattttcacttcagtggcttttaaatcctgcttatgaattttagctttttgtttgtttgttttctctttttgccaaaattaactgtttggtgaagcccgcaaaacctcctcgctttgcatgcatgaacgtgccaagccagcataggggagctagaagccactttccagccacctgccgttgggttttttcatatctgtacataatgccgagtgcgtaaggaaaccgtggcgtcgcgcacagtgggtctgcttgtcaaggccagttctgcagtgacaggcccaggggctgcccaccaggtgtgctgggcagacttcagctgggacagaagtccgatctccctagggccccacctggaccattttccctccgttttattttgttaattaaattctttccaaattggatcgctctgggatttcttccatggtggacttttgtttctgatcttgttttccctgtggatattggaggacagcgaggttctttctgatactaaaaacctttctttcaggcagcaaatgaacttgaaaggttgcctggactcgctggagcaaaggaaagcgattttgtttgtataattaaatgatctgttcttctacttcactcttcctgttgaaaaactgtgtgatttttttttttttttaagtaaagtttgtagctcctcccatgcccaggaaagcacagaactcaagtgtggtggccgtctgagctgtcctttcgctggccccgctgtccgcaggggcttcctacctgtgtgagaggtcgtagcgggagacagcaacagagagtaggcggctgggccacgtccttcacagggcgtcatgtgcctttctattttcatcttagaaaatttcctcagcaaaccgatgagagattgtggttgcaagcttcagtatttgcctcgcttcccttcccttttcatatttacagaattaaaacaacctcaagtacctcagactctgcattccaaaccaaggcacccagcagccaaagtgtcgagggcatttaagtggcattaatggcaggagagatggttttagaatctatggagtggtggaagttacggatagaagggaaaaggcaaaaactatttaccctgcctttgcaggctggggtttttgaaccgaggaaggctgggacgcctgtttccagatggttgtcatggtcacgctgggcgaagagctggaggggagttgtcccctcagctgagcggctgcggtgaaatgccccagtgttcctgggttggctttacggcaaactaaatgcaggggacgctggagtccgactcacctacaccggcttcctcccagccgctggtgtgcggcacacacaacatctgcattaggcagaggtgcaagtgggctgattgaacttttccttcaaaacctgcttgtctgtcctggacctttgatgaaatgggatcccggtcacgcaggctgagacagtggggaccgccgaggccagagtgggctatgcttgagcagggatgagaagggccgcggcagcacgcagccttgacccacgcctgcgtcttgtggtgcaaggccagagggctctctctagaacctgaccgtgcactccatctcctgggagccacttttggcaagagtgagtgtggggggaaaaagtgtgcacaagagatacggaaccctgagctagggtttcctgtcaccaaagagtgagctgcatttccagttctgcgttaaagtatcgtttgttctggtgcctgcctgtggtggtgatttggagactcaaatttcctttgccaggtctcttttgtctttctttgggattggtagtatagaagatgctgggaattgtcttcctcgctcagcctcggcttcccgcactgtaagatgaggcagttgcagaggaggcctcggacgtcctgtgaccctcggcccacactcccccttgggtggccctggcagggctggctaggtgcgttccctgcagaccacgggaagccctgtgcttgcctgggtcagggctaagctgtgcgccctagaggagggaggaggactgcagattcttggtcgagaagaatgaagaggatttctgtgtttgctgagcagccattgtggagggttacccgcctccactttcccgttgcccatttcactgccaccagctcctcttcctctgctcgaacctatgagtcccagcctcactggcggcctcagacatgctcaggagtgacggggacagagggaggccgctgagttgcccgttagaactcttactgctgcgccagtgacccaggtggagagggaccctgaaccaaacagaacgtgtgctaattttccgaactccaaactgtacactcatattcatttttaaattgtatttttccaaacttcaaaaaggacgatgagcgtgggggataggaaacaaaacctgtaaacgttgtgaatgggctcagtggactctgggaccaaaccttctgtaatctctaaaacaatgggaccaagagctggatggaacctggagtcaaaaagaactgcttcagtccccgctgtaccgcctgcctagctgtgggagcaggcagggcgcctgggagcctgcgttttctggaccgttccatgggactcatccctacctcacagggctgttgtgaggtgttgtgtgactgcgtgtcctgcaaacgcccagctcggtgcccagccagcggtgggcacccaataaacgctacaacataaatgtgtcttctgcaattaaacacgatttttattca

SEQ ID NO: 743 - DNA, 117079 bp, Homo sapiens
gacgcgcgccgggagccgcgggccgggccagccgggccgccggggcccagtgcgccgcgctcgcagccggtagcgcgccagcgccgtaggcgctcgctcggcagccgcggggccctaggccgtgccggggagggggcgagggcggcgcccaggcgcctgccgccccggaggcaggatgagcatcgagatcccggcgggactgacggagctgctgcagggcttcacggtggaggtgctgaggcaccagcccgcggacctgctggagttcgcgctgcagcacttcacccgcctgcagcaggagaacgagcgcaaaggcaccgcgcgcttcggccatgagggcaggacctggggggacctgggcgccgctgccgggggcggcacccccagcaagggggtcaacttcgccgaggagcccatgcagtccgactccgaggacggggaggaggaggaggcggcgcccgcggacgcaggggcgttcaatggtgaggaccagaccccccacttcgcgcccccggatcccctcgctgccccccaccgctccccgctgtgctctcggatcttgccgctttgcgcacccacctctccccgcattctccacctttccctaccttcccatctcgcccaccccctcagcatccatttctgtctctcccactcgcccaccttcctactccgctctctgtcataccctcttcccttcctctagaggtgggagagctgggatgttacgcttccctcttaccctttgccccctctgcctgggccggttggggtgggcatctgctagaaagacaactttcgctgtggttggaggtatttcgcttagaggataccattgtgcataaagaaactggcccgcttggcgtcttctttcagcccttgtatttattaatggaatgtcgaaagagaaaaggagaaccgtgtttaatatgattggctttactgttgttaggacggtagattcgctaaaagaagcatgaaattggactcactggggcagaacaaaatttatggccagtagctctgacattcttggaaataagagttatctattattttccaatttaccaataccgtgttgtgttatttttggacacgtaacaaaggattctatttagtctgaaacccacgggggtctttggaacgaggaaatgggttaatggtttgctttttatataaaagacatattgaatgatttggtgctttatttttttaaaagtgtatgagaaaaacactgtaggaagttctgaaagcttgttggttgtctttagaatgaaaagccagtgagtaattgtaaggattgtgccagacagtagagctagaaagaatgaatgggaaagaaaaaggaattttctcaaatagctgctcctggcaagtcccaccccttctgcttacaaccctctttccctaacacacccagacacacaccctcatttacagccccttgtattacacaacatgcccaaatctcatttttatggcaacccaagctaaaataccatggagtgcagtgtgcaagtgttttctctttgtggtgtaaggcaaacatgcatgcagcattgcaccagcttttatttatttacactgcttgtggtttgtgtgtccgcagtgtatttcataaaatgaaaacatttaaaagtgtcatttcatttccttgtgtatgctcctaggaagatgtttcttttctttgcaggattacatgttgaaatggattataaaattagtgtatttttagtttctccaaaagaatcccagaaaccctggaaattagtgcgctgtgaagataaaagtgaagcttgttacttacaattttaattttggacttctaaatgtttccccaagaggataaacatagtcttaataattctttttgcacaagaatcgaatcaaaagcttttcctaccagaaacgagaaagagaaaagaatgcatgttttaaataggtaagaagcagcagccagtaacggatgacagaaagggcagagatatctaatacttcttttatgctcctgacatgttcgtgcacacacacaaaggggaaaaaaaggactcttttcccaggttggagaaaactaggaactaaggggcttggtaaagaccatatatatatatatattctgtatgatatgttgttaatataatcaaaatattttgtttgtataatgcatttgttgaagtactttgcattgatgattgcattttctccttataacaatatattgcgcacagaaaagattccattttcattttgtagtgaagaaataagccgttaacttctgaacagcaggggtcattttatatggctttatattctccaaggcacctttgctgtaaaaattgctcagtgtgacttaaacaagttaaacttgttaaacaattgcactatttactccctagcctcacccccaaggactttaaaactttttgactgcaaccaaatacaatttgatcattatccaggaggcacatacatctgtataacagaaactttggcaatagtacaggtacttccttctgtcagatgcagtgctttttgatatttcctatttgaatcagttatttctccctattttaaattgtattgagacctccagttgaaaaacatttaattataggctacaaagtgattggcaaggtttcttgtaaagggccggttagtaagtgttttagacttagggcaacatgtggtcttgatcacttcttcttcagtttttttttttaaacacatacaccttctgagggttgcggttgtacaaaattagctgcagatcaaggccatagcttgccgacccctggttagaagaaaaaaaaaaaagtcaaaatagtaccattgggggaaaaaacaggagtgatcctaaaaagtatgagcctatcagtttgacatctatgtccagaaatgtgtctcattagaaaagaaccccagatactgggcaattctggcatagtaaagaataaggattggaaaacaagtcttaatttactatgacacagcacaagacctgctgggtcagtaattctgaaattttcatagatatctcaaggaagtttgattcagaaatgaccattaccctgtaccatttttggagagcttttttaaataggttgagatgggacatgatatccttttcttccccctcagtagacatcccacccaggtcattctgatatcaatagttccatgactgtactttggaaaacattaacagatagtgataatactatattcttcttaacatttaaaacataattgccgttagttgacaattgctgtgtgctgtctaaatgctttaatttttttgtctcagctttatgagaacgataaggccatcacttgcccagtgtttcacgtgagctgcaaaatcaagattgggatacaggtggacctggcttcatccctgtgctcttgactgcccgattctatctccagatggggctggggctagcataacctgagtatcccttatatgtcaagctctatttgggacccttaatgtgttttattgttaaagctctgaaaaattaacttgtccaaggtcacacataaaacgagtaagtagggaagcctgatttcttactcttatgtatctaaccttgaagcccaggatgatcagggagttcttaaatggaatttgttctgtgggctgactcacaagtcaggttttcctgtttttttttcttttagtaatgctgatggatttgcattgttggttcatatcctctcttgtgaatgtctttaacgtaagtgatggtatttatgagaggttggagttaaaaggcaagtttttgaccatgcaacttgtgcccattgacaaacgtaggacaaacgtagggatcaagcatgtgaccttgaccttataatgtggtggtttaatcaaataagccaggcacctgcagttagctggaaaaaatgttgtctggccaggggtcggtgatttttgagggtcaggtggtgtggctgtaggtggcgctagagcaaacagtcagatgggtgaaggtcatcttctttcctacctttccaaaggatcccttcctcttctaatagctttcttttccctctcctattctcttccagtcttataaattctaattgttactttccatttgctatcaattctggtcgaaagagcaagctttagatgttagaatgatagtggcttatggtgaccctttctagggaaactctcaaaggccagaaagaagccataatggaaacctcttggcatctactctgtctccctcttccccgtcctagagaaagcaaatacagtttgacatgtcatgtctgaaagggtagcatccctaggccttgaatttcttagaaggtttacggtaggctatagcattgcatcagtactagtttggagtaaaatctgtggtaattcatgattttatataggcatcatcaagagatcttgtgttgccccataatttcttcagtggaattgctgaaacaaaaaatgaagtaaataccattcagattactctgataaatggacaagtggtcagaaacaaaattaactacacatgggcacatgcagagcagtcaacctgggagaaaaaataactaccgtgatagaaaataaagagctgattttctgagttatagaagaaaaagatctagagttcaaagtagatacacataccaaaaatatagactcataccccataagacaagcatatcaaaagtaataaatagaaatttaccatgtaataactgtggcttaatcctcttaactctgtcccatgtccagtcttgttggaatcttacctaccttttggtttttacagttcaaagggaatttggagaatttacaaaacatccttaaggtcaagcaaaatattgtaaagtttatatcattgatataaaatcttacagagttatatacttttttttttgcagaatagcaatttcattgtgttttatggaaatgaatccagtattgcacttcttggcgaggtgaagcagggaatgagcttatgtggcagttttacttaggatttaatgttatacagtaataaaatccatatcttttcagctcataatttgtagctaagagctccaggattttgtaattaatgagactttatagtttttggctattagagatttacatggtggttttaaatcctcctgaaatggattaaatcattcatgacaatggctaaaatattgaagccattattttagttatgagcataaaacaatagtgtcagaaaagataataaaaattattttgagttagagatagtgattgtgattttcaaagcagaagttaagaacattattcattttactagtaatagtaggtggattgctttaggggttgaaattgggaaaccaaaaaaccccttctcttaccatctattactttgggctttggaagaagggtggtagagggagaaagataatgaagtcagaagggaaagggggagggagagagcaagagagaagtaaaaccagttgtgaaggcttgcttgagtaacttacactttgaagacatacaatggaaacacctaaacagaaattgaagcattagtactttaatttttctatcaaaaaccaaaccatttagctattattttagataagacagttaccagctttttttttttttttttttttttttttttgtggatgcacataaattgatgtgctgtgtctgggtagaacaggagtgaatattgaatggttattttattgttgcaaatctcattccatggattccagtaaatttccagccgtcaagattttgttaacagctatgttgaaaaacaattgtgtttctttttcagttgtgcaaatacaaacaggggacctatgaatccatcaatttggggtttatttttgacccattaagaaaatcgtttgtcagtagtagtagtaataaagtcctacagtggaggttggggaatgatggaatattttaaggtgagagattcagtgaagaagactgaagtgactaactgcagggtctactttagaagtgtggagaatcacagaaagtgctgagatctgggatggcctattagaaacaatgtgtgaaacttggaaggtaggatagttcttattttaagaaaaaagaaatgattcgtcttacatttactctctttagacttcatttttttctgtttttgtttgttttttggtagagatgggtcttcctttcttgcccaggctggtcttgaactcctggcttcaagcagtccttttgcctcagcttccgaaagtgttggaattagaggcgtgagccactgctccctgcctagacttaagacaccatccttttgtcagagatggcctcatagatagtatgtatgatcaattttgttaatagatggggcaggtgagagacagagaagttccttatccaaatttggtaggttttggccttataaatttgagtttgttcatacaactgttgccaacattttgtgcgctatttatattaacttacatcatatgaattttttctgtcttccatcaagttgattgataaggtttaaaaggatgggctaaagaaaagtacttttgtcttcagaatttccaggtttttttgttctttgattctttttcaatgaagtgaaatctaatattagactatattttcctatcacttgcttaagaagagacaatggaaaagaaacaagaatgcagtgatttttctgaattgaatgaattgttactgtgttcttgatcctgttcttgtccttcctgtcttatctatatcatctagttgtggttgggacagtcacaaaatcctactctaaaaacctcactatgatgcttatcattattttatgagagcgaattttgtgcttcacaaattcaaaatgactcagacggtttcattatgtaattttatggaaagaatttgagctaaaattttcaggtcatggcttacatgacaacaaaacaatcaaataagaaaatcagaactataaacagttggtgtaacatttataaatgtttcagcaataggctctgccatgtgtagcttaatatgtttggaaactaaaaaaaaaagtctttccagttgctgctgtttaaaaatgtttcttaattaaaaaaaagacaaaaggtcaaaatgtaaacacatgttccacataaaagtgaagccaagaagatatactgtatacagttattcctgtatctgtttgactaaggatgacattgtttaatttacattagctgttccaagacaaaatagtccatgggagtgatgttgaggggaatttggggggtaaaaagagaaggaaaaaagccgtttgttccatttgttctaatatatttcagttacacccaaagagcatctttttcaaaggtcatgttgaattaaaacatgattcggctgtttcgttctcattattatagaaaactaatgtcttttaaatggtgtccttttaggccgggcacggtggctcatgtctataattcccagcactctgggaggccgatgcgggcggatcacctgaggtcaggaataggacaccagcctggccaacatggtgaaaccccatctctactaaaaatacaaaaattagctgggcgtggtggcgggcgccttaatcccagctgcttgggaggctgaagcaggagaatcgcttgaaccctggagacggaggttgcagtgagccgagattgcgccactgcactccagcttgggcaacagaggtatactctgtctcaaaaaaataaataaatggtgtcctttttatttaatactagttattattaacatttttgactactgatgtatcagatgtggaacagtgctttacacattgtcatctgaacagatgctttacacatatgtgatttagtcttccccagagtaattggtggaatcaaggtttgaacctggtaatctgacttcagggtcttcctcttcaaccacggtttatacacttcatttcagtaattcttttagcagtaacgtggttgaaaataagcacatatcaaaaaataagctacctacttttccctctaaaagtttgcaggctagccctgcattgatctctcccttttacaatttgcattctctgtctattcaacccaaattagcatttcatgtaccttagaaactcagtacatttgtttattttattttattttgtttttgacagagtcttgctctgttgcccaggctggagtgcagtggtgccatcttggctcactgcagcctctgcctctgggttcaagtgattctcctgcctcagcttcctgagtagctgggattacaggtgtgtgccaccatgtctgcctaatttttgtatttttggtagagacaaggtttttccatgttggcaaggctggtctggaactcctggcctcaagtgatcccacctgcctcagcctcccaaaatactgggattataggcaagagccaccacacccagcctacatttatttattttagaaataatcacctcatgtactgagctgcttaattctctaaatttattttattatatacctttattagcaaaatatatttgagtgtacaccccaatatatgttgataaattttatacatgtgacaatatattgacttatatgtatgataaagcttcctacaatataaattttgaaaggagaaagtaaaaagcaattctaagcaagttgtaattttctcctacatcccaacatatagccttatacactgttttggcatacatgaaccccgttttggagactacagctgtaaacaataccacttaaattgatactctagtaatatataaagtagccatgatcaattttggttccctgattcaagcttctagattataaagagtgtgtgtgtgtgtgtgtgtgtgtgtgtgtgtgtgtgtgtgtgtcttttttaaaagacagtcactcggtaagttaattgactcaacagaagttggcagaatacagaggaaaattctatcttataaaaaggaagtaaaactacgttacctgaaggggaaaatccaggctttttcttttaaaacctgttttcctgtatataccttgaattccaattgtatagtggtaatgtttttggtgcaacatttgtggatgggacaaagagaatcgtattatagttttctggttaggaatcagtaaattatggaaataccagtcagaattagaagaaagtctaaagtttagaatagttgaaaagaaatgcaatttcatagagtatttcaggttattttgttaggagagagatcgttcactatttgctttcttgtaacttttgaaaaatgtttagcatgtgcttggattacctattaaataagtgtaaaaatacatgaaagaaaggcaattcttttgtaaatatgcattaagtagtaaataaaacacagtaggccgtgtgtggtggctcacagcctgtaatcccagcactttgggaggccgaggcgggcgaatcatgaggtcaggaaatcgagaccatcctgactaacttggtgaaaccccgtctctactaaaaatacacacaaaaaaattagcctggcgtggtggcagttgcctgtagtcccagctactcgggaggctgaggcaggagaatggcgtgaacccgagaggcagagcttgcagtgagctgagatcgcagcactgcttgacagagtgagactccatctcaaaacaaaacaaaacaacaaaacaaacaaaaaccacggtatatagcggcacatgacatgattctaaattgatatagccaaatattcttgtcttaagtcattctcttggtcctgaattctcactcccctctccctgtctttctgctaaatctcactcttttcccaaaggtttagtttatattttaccctaccaaatatttttgcaagtttccctccttgacgttaatactatcaatatggtaggatgaatatggcctccatcagtcaactttgcagatgtcaagggtcctcagtctaggtaggcaagaatgtgcaggaatataccctctctttctaagtctttcctgtatgtgttgtgctttgctcacagtaggtgtgcaaatgttttttaaaatattgaacactgtctaatggtaaatgtgtatgaatgtaaaatgattgaaaacttcttaggcatgtaaatattttaaatagacttttttttattatactttaagttttagggtacatgtacacaacgtgcaggtttgttacatatgtatacatgtgccatgttggtgtgctacacccattaactcttcatttaacattaggtatatctcctaatgccatccctcccccatcccccaaccccacaacaggccccagtgtgtgatgttccccttcctgtgtccatgtgttctcattgttcatttcccacctatgagtgagaacatgcggtgtttggttttttgtccttgtgatagtttgctgagaatgatggtttccagcttcatccatgtccctgcaaaggacatgaactgatccttttttatggctgcatagtattccatggtgtatatgtgccacattttcttaatccagtctatcattgttggacatttgggttggttccaagtctttgctattgtgaataatgccacaataaatacatgtgtgcatgtgtctttatagcagtgtgttttataatcctttgggtatatacccagtaatgggatggctgggtcaaatggtatttctagttctagatccctgaggaatctccacactgacttccacaatggttgaactagcttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgtttatatcctttgccccctttttgatggggttggttgattttttcttgtaaatttgtttgagttcattgtagattctggatattagccctttgtcagatgagtagattgcaaaaattttctcccattctgtaggttgcctgttcactctgatggtagtttctcttttgctgtgcagaagctctttagtttaattacatctcatttgtcaattttggcttttgttgccactgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagcttcctacatatggctagccagtttttccagcaccatttattaaatagggaatcctttccccattgcttgtttttgtcaggtttgtcaaagatcagatagttgtagatatgcggcattgtttctgagggctctgttctgttccattggtctgtatctctgttgtggtaccagtaccatgctgttttggttaccatagccttgtagtatagtttgaagtcaggtagcatgatgcctccagctttgttcttttggcttaggattgacttggcaatttgggctcttttttggttccatatgaactttaaagtagttgtttcgaattctgtgaagaaggtcattggtagcttgatggggatggcattgaatctataaattaccttgggcagtatggccattttcacgatattgattcttcctatccatgagcatggaatgttcttccatttgtttgtatcctcttttatttcattgagcagtggtttgtagttctccttgaagaggtccttcacatcccttgtaagttgattcctaggtattttattctctttgaagcaattgtgaatgggagttcactcatgatttggctctgtgtttgtctgttattggtgtaagaatgcttgtgattttttcacactgattttgtatcctgagactttgctgaagttgcctgtcagcttaaggacattttgggctgagacgatgttaaatagacttttaataatagtctcctagtaatgttttacattactgtattttaagatgtttcataaaatataaaagctttagcctatcttcagttcagtctcatagatttggacttcgttgtattaaaaatacaacgtgaggcttgggcctgacatttgaacactacaaaatgcacagaacgcacgtgcacaggcttcttttgcctgtaggatttcatattgtaattgaggtgacattctggccccccacaaaccactaatgctgtatgtcattgcatctgcttatgtgaactctgtgcttaatctaaaactgatctattgccctgaacctgctttgtccatttccatctttttgcgtttcctcatcattcctgccactctgcaaggcaagctgccttcctccctctgttgcttgaattctgctgacccctcaagacccacttgctgtttggactcctccagtttttcctctagctccagcacagacctgtctctttaagattgaaatggacatatccacccgcttaccaaatacctttgcttgcatgttcttcagccacctccatacaattttatcctaaactgaatgtgttctctcgttcctcagttcttctctcctgtactgtgatgtcattcttttttttttttcccactccactaattttcataaacgtggtcactagagctccttttcctttgcctcatactttttaaacctggcaatttgcttttatggaaaaaagcaaaaataaaccagattgcttttagttgccaaaaatttaagagtaattatgtgaaacatctgaaatagtggaagcttttttaagagtgtgatttcattttggtatagactctagatttgaagcctgactctgccatttataacttttgggaacttgaataagttacgtattttatgatgagtgcctcattttcctcatctatgaaatgggaataaagatagtacctatctcagagggatgttttgagaattaaatgaattaacagtacctggcatacgctaagcattaatgtgtgttaaaaaaaaacacaacaaaaccaaaaggaaacaaacaaatacaagttttagaattcaatgagaacacgacagtttaaaaaaaatgaaatttgattagaaatataagctagagattgctctcaagccagtatagtaatagtacttttaaaaagttattaatgaaaaatatgaaagtaaagtctttaaatcttttagttaagtgtttcaaatttttaaaaacttgcagttctttaaatcttatgtcctcctttaattccatttgaaatttgaggtaaatagtccgacttggaaaaaaaagtaaaaaaaaaaaaaagatgggataaagctttgctttgttttcataccatcctttcccctgagaaacagtgtttaactgatagagtaaatagatgtgtgtgtacacagtctccaagtttatggtcttaaatttaaggtttagcaggtaatttttgaacaatttaggaacctgtaggtagaagtattgaaaattgttactttatttaaatgaggcagatgcttgtagaaaaacaaaactgtgtgcctgaaatacaaattaattggcaaacaattagttggcattaaattgacagcttgttgccctttcctcatgtcataatatttataaaagtaagctcatggtgggacaaattaatacatctccaagtcttacattagtatgtgtttttattctgaaaacttataattctgtacttattcaactacaaattgctaataatttatttttagaagaaaataaagacaatcttttgagatctttgtttttacatgaagtttgttcatacgtctttgatttttttatttgactgttaacagcagtttaccagccaagcaatattaggacttttgatgcataataattccttgaaatacctttcttgtaattccttaaatggaatccaaaaggtattttagtgtttgaattttaacaaaaacccgtttgtaaaaagaatattttatgaaaaatattttaggagcacattttacattaaagtacattttgaactaatttggttgggctgatagtatcggagcatagtgagagatttttatctgccaaaactgagtagagcagaattttttttctcttttacttgttgtgacgtattttcaatatagagaaagacacagataaatgaggaacactcatataagcagtcctctagctctgacagattttaacattttggcacccttcaaggttttttattttttttcctggccacgcacggtggctcacgcctgtattcccagccctttgggggagaccaagacgggcagatcacctgaggtcaggagttcgagaccaccctggccaacatgatgaaaccccatctctactaaaaatacaaaaattagccggatgtaatggcacatgcctgtaatcccagcttcttgggaggctgaggcaggagaatcgcttgaacccaggaggccaaggttgcagtgaactccagcgtgggtgacagagtaagactctgtctcaaaaaaagaaaaaaagttatttttttttcttttaaaatataccacatgtgcagtaggaggaggcccctcgtgtactctctcctgtcccattccatcaacttctctctccggagataaccaccaccatgatgcatttagtgtttgtgtttctggtatgtggttttgtagtattactacataggcattaggttagaaatttgtataaattttgcacttataaaagtttcttttatgtaaattattatccatcaacttgtttttgagaagggcatttgagatgttacattgattcatgtagttctagttctctagttcatttattttaacattacttctatgtagtatacccttgtataaatatacactttatccattctttggtaaatattttggttgttcccaattttttgttatagtgctgtagtgaatgtgtgtgtgtgtgtgtgtgtgtatgtgtgttaggcaaatgtagtttttaaagatagttttcagtgtgtggtctggatacctctgggggaccatttccctctcttcccagaccttgcaagagtccataggatgaaaattataataatacttctaagattttctttgcctttttttctctcatgctctcagcgtgatagcttacggtggagttttccagagggtatatgatgtatgatattgcgacagattgaatgcaggagcaaatacgagaacccagccatcttctatcataccagatttgcaaaaatgtaaaacaaagtcattctaaattttactaagttttgtttgttttggaaaatatagtttttttaatcaaaatatgttattagtaacgtgtaagttcctttaaattcatattttaagtatttatcagttttaatttataatacaataaatatcaatggatataaccatatacacaaataatttttgagagtatatagagattttgagatcgaaaagtttgtggactgctgctatagggtatgtacctaagtgtggaaaggttgattgtaggggtgcacagctttgacttcacctcacattgtcatatctgctttataaaggtgttgcaccagtttgtactgtcatcagcagtatgagtccctgattttcacattgaagcgaacattcaatattgtcagatttcaacaagctttgacagtaggatggatgtcaggtagcatcttactgtgaattgaatttgttttcctcttattgctagtgacattgaacatcttttcctgttcattgactgtatttgtagtttattttctttgaaaattttttgccatttttcccatctggctgattgtgtttttcttactgatttgtagaaggatttccctccttccctcccgccctcccttcctctcttccttccttccttccttcctttaatgttctggctaccaaccctatgttggcaatagtcattgaaaaaaatctcccaatcttaggtttgtcttttcattttgtttacaataactttgaacataatttttaattttaatgtaggctaatgttaatcattccttttgcttgtgattttttttgccttgtttaaggatttcatcactaacccaaattaaaaaggtaatctctttattttcctgcaaaaatttgtaagtcttgagtttcatctttaaggctttaatctataatttattcttatatatggtatgaattagggaatctcatttcattattttagtatgcatcatgtattgactcattttttcccccactgatttttaaatgttaaatttccatttatctgtgaatgtacaaatttccacatacatgtgaatgtacttcaagcttctgttctgttctattgggtttgctgtcctttcctcaatgcctctttcccttaattaatgtgactttaaaatggtcttgatatatggtatggtaactctcacttttttttttgctttaaaatgatttaatcatttgtaggcttttattagtccataaaacttttaggatatgcttcttcagttttgtagaaaatctttattggtagttttattggaattgcttgaatttataaacaaagttggagatgacagatattttaatgatactgagtcttcctatccatgaacatgatatatctccctttattcagtcttcctttcatattcttcaataatgttttataattttctccataaggattttgctatcttttcttaggtttattcctatgtaacttatcacaactgggatttttaaaattatacattttaatttgctgttgctgagaatatataacaggaactggtaaagttcaataataagaagaccctaatcaaactgagcaaagacttgaacacgtcaataaagaagacctaagaatggctgggtgcagtagctcatgcctgtaatcccagcactttgggaggcctaggcaggcagatcacttgaggtcagcagtttgagaccagcctggccaacatgatgaaaccctgtctccactaaaaatacagaaattagtggtggcacatgcctttaatcccagctacttgggaggctgaggtaggagaatcggttgaaccgggatggcgaaggttgcagtgaaccaagactgtgccactgcactccaacctgggcgacagagtgagactctgtctcggaaaaaaaagaagacataagaatggccaataagcacgtggaatagtgctcaatatttttagttatcaggatagtgaaaaaaccactgtaagacaccattaaacacacacatcattaaacacacacaagaatggctaaaataagacataccttatgttggctggaactcctatatggtcctggagggcataaagtgatataaacacttaggaaaactgtgggtatgttataaagttaagcattcacccacctatgaccaagcaatcccactcctaggtatttaagagaaataaaagtaacatttacaaaatggttgtaaacatatgcttttattcaaccaaagttattgtaaacaaaatgaaaagacaagcacaagactggaagttttttcaatgaatattaccaacaaagggttgaatatttagaagaatattaaagaatatttataaaagctttattcaaaatagctcaaactggaaactgaaatgtccatcaacaggagaatggagatatatatattgtggtatattcatataagggaatactactcatcaataaaaaagaacagtacgaattaatcttatgtttgcatgaagttcaaagacaggcaaagctaaactacagtggtagaaatcctaacaagtaattgcctatgagatagtgggaattgacagtaagggggttcaaggaaactttccaaggtgttgaaaatgttttatatcttgattggagtgttggttgtggatgtatatgtttatcaaaactcattgaattgtacattttattgtatgtcaatttcacatctttttttaaaaaaaattggaaatgtggacactcttgaaatcttttttttccacattttattgagaaatgccattgccttctgctctgattatcttgtgaaatctttcattattcttgttagagactaaaaccaggttacattttcataattgtggggcataaatggtactgcttttaataatactacttgaaaaaaagccaaagactagtcaagctctagtgttaaaagtctattttatgtttttagccagtactatatattttaatttatgggtttcagaaactcaatacttgtatacataacatttgctgtttttttttgaaactgtgtctcactctgtcaccaagactggagtgcggtggtacgatctgagctcactgcaacttctgcctcccaggtttgagcgattctcatgcctcagcctcccaagtatctgggactacaggtgtgcaccaccatgcctggctaatttttgtatttttaatagagacgggttttaccatgttggccaggctgaactcctggcctcatgtgatctgcccacctgggcctcccaaagtgccaggattacaggcatgagcctccatgcctggccaaatgatctttaggtgccacccctattatattatttttcattagcactattgcttcagcatttttgaacctaatatatattgtagccagcagtgttctaagccttggggatacagtaatgaagcagacagacaaggaaagaccctgccctcatggagcttataatgtagcgaaggaggagacagacaataaacataaaacaggtctcttttgccagctctggagaaaaggaaacgggatgataccatggaaaggaacaagaggggcaactttaaactgggtgttcagggaaaagcttcctgagagggggttatttgagctgagactggaatggcaggaatatcttcattctgggagttgtatgaggaaggctttgaatatgggtattttctataaccgtactcttattagtaggccaaccttaatcacatccctgattattctctcagttgctcttcatttcaaagtctccctcctgccttttcccatttgtttctcccaaattacccttctctggagctgttttgttgtgactttatagacatgtagcaatttgaactctttgcagcttccagcttttccggtgttcttagcctagtttggattgtttactcttacaagcagaacattggtctccataaatctgctctttgcatgaatctgaccgtacagacttaaaagagacagttttgtgtatggagaagcagaaagtgaatttatatcgtcttgacagtggcgtttcccactcctttctacttaactctgagcccacatttaaaatcctgaaagtatttgggaacgtttttcttgacattgttactgcctcaaatctctgtgtagttttataaaaacttagtcattttaggatttttctagctgaaactgtatttttctctctttttctaagagggcattgttggtaaaatcctcatgaattaagaactggagactcatgttcattcacaagcaaaaatatgtttttttctaatttaatcattctattactttcatgttctaaagtgtcagttatattttgaggaattcggttagtaaatataaagaaagtctttgaagttggcactttgtaaaagcagaaggagcatcgatatttcgtcttactctgccccacctccagccgtaatccacgtgtctgagtgggttggacacctgatctctgtgcttctttgctgtataatcaaaaaggaagaagaaaagtggtctcccaagtgctggcttctcaaacagctcccgttatgtctcataagaagtgccttgaggtacatggttcataatctgtgtctccttgagaccaagaccatgaagccttggagggtacccgccaactattattctgtccttgtacctttgagccccttcacaggctgaatctcaacaaattcctaggcactgtgtatctagaaatacatagtatttcaagggcttacaagacagtgatgagtaaagtatctctgagtattaataattgtggtcaaggttcagtaccttttaacaaaaatgtagaaaataagtggtccttttcaataccagaaattatgtatgtattaaaagtttgcaagttgtgtgtgttaggttaatcagaaaaattttcaagttttgttgtttatttgcctgtttgctgttgaccttttaaaaaagttaattattccttggttcaagggtgagccttacttcactttaatttttgaagcacaggcataagagaaattcatttattctgcactaaatatttactctgtcaaaaataattatcttacatggtttcaatttacacagtttctagaatattttatttagacagttaacagattcagaaagtgtttgttgctagaaaaggtgattaatgggcggataaggatgctaaaattattcagctgaatccaagattattgtgtatatttcacttagggtatacgaacacttttctgcaaaaggctaatttaactaacacagctccagtgtagatagggtagtttgttttttatttttgtttgctcggggtgtgtgtatgtgtgtgtgtgtgtgtgtgtgtgtgtgtgtgtgtgtgtgtgtgtgtgtgtgtgtttatgactgcagatcacagctcagggctcttgtttctttaacttggagtttccctcccaggagtatgctcagagatgcaaactgtgtgtactgctatcaaccttttagtttcatagattatcttaggttttttagtcttctactggatttctctttcacctgcggtatttctaaattaggtagctacttgcagggtgtaagtctttgaagccattgtatttgaaaatacaactagacttaataagctcttcaagggcagggactctcttacaattccagtgcccagcatccacactcaatacagcaacaaaattaatggggagagggagacttgctctgtttccttgcagagtttattgatgcattctgcaggtatttactcagcacctttatctgccaggcactgtgataggcattgggcatgaagaggtgagcagataagcagttcctgctggcctggtgcagaactccgtccagcaggtatgggaggctgttttcactgctgagatagagacttcttcggtttatccaaagtaatggaggatttttcttgtaaggacacggaaggattaaagaagacttgaatcagttacacttctgggtctcttgggagcgtaggaactaaacgaatctagtggaatatagtttggcaacagaagatatctctggttatacaagcacgaagatattcataggaacataggactcagtgttccactgcagtagtgttggggagaaagtcaaaccttatataaatatttttgtcttttttccttggggattcactaagatcttaggttatattctcttaaaaatgctaggattttactctgttcttaaatcatattgtttgtttctccaggcatacaatatgtttcctattttttcgttctatcctagtctctagttttctctctatgtggggtgtgtgtgtgtgtgtgtgtgtgtgtgtgtgtattcaccaaatatccacagaataagaaaatctaaaggtaaaaaccaaaagtctgagaaaatttaatttgacttgtcacattttaagataccttcatctgttaacattttttgggaatttgtattgctgtgtattttttatatttaaaaagtggtaatattagtttacactaaataagcgtcagtctcttacatttgaataggaatttatagttgacaggtacatccaaagatgtttaggttttttttgtttttgagatggagtaccgctctgttgcccaggctggagtgcagtggcaggatctccactcactgcaacctctgacttctgggttcaagcaattctcttgcctcagccttccgagtagctgggattacaggtgctcaccaccacgcccggctaattttttttttaatttttagtatagagatggggtttctcttatgttggcccggctggtcttgaactcctgacttcaggtgatctgcctacctcggcctccctaagtgctgggattacaggcgtgggccaccgtgcctggccaggtttttttcttcagaaaaaccccctgaaagaaggagggcagattttactctccatatatcacaagttgaaaatttaagtcaaggttacatggttcatctacgccatcagaaggcaatgtggccagtattagagcccaaggctcctgtctgccacttgggtggtctgtccatgccccatgcttcaccccctccctgccagtgatgtggaaggtcgggatgttggcggtgcccatcgtcaccttcctgctccccttccctgacttactttcctgagagagaggaccaggcatagcttggccagatgcacatttctttatttccagcaaggcctccaccctgaatcccagccttcttctctattttggtaattagactaaaaagcttagaaaaatgatgaaggtgaccgttaacttgctgaaagtttgtacaggaaacatttgtgtttcatccctgcaagtggaaatggagggatatgggcatgagagattggatttttggtgattgttctcaaaacccagtatttaccttaattactgcataccacttgcttggtgcacccatcttcttaactgtccaatcctatgccccatttactgtcagaaaatgaaaatcatagacttacaacctgtctactcacgatttagaaattgatagaatgtctagcaaaaatatcaaggagaaataaattaaaataatttatagcaagtaaaatgtatttcagtaggtatgtgtttcagcatgtactcaagaagacagtgtagttagattgtcccacctagatgtggaggctctatgaatataaaagctgcaaacggagtctgatcaaaaagcattgtactaggaatccaaataccataaggagcattgtagtagtcgcatggttttctgaaatgatgaacatctattagtaaaattccaaacaaagcaagaaacaaaacccaaatttgatgttgtcattgtgttgtagaaaatttgatgtatattaaaactgcataaatgaatcaagtgtatataaagagctgtattaggatttaggcccagatggttataaatggacttttttttgccaatgtgaatgcccagtgggatgttttaaaagttatgcaggacaaaagttgaaggttgcaggacagttctttgttgtgcaggattgttgtggagtttgcctgacaaaagccaaggaagggtgtcctctgaattaccgtgacaatcaaaattgcccccacaaatttagaaaacatcttctagatagcgatgccacctttgtggaaaacctttaccttaaacacttcagaaagacacagaaacctaaggaccccaggaaaacaaagacttcccgaccttttaaaccaggagctcatagtcctgtggcttcatcgtctaaagaggctggagggggcaggggggcagagaatgtctactatatttttgccccaaggctgagagaagtttttaaccttcatcttgcctatatctgcttgcactctccgttctgcattcctgtggttgcatttttttgcattttgtttccattcactgtccttgtagcttgctggggtggcactctttagactaactttaatagttgcaaaaaaggggtttgaaaactgatgggcctttgtgtgtatgtgtagtaaaatatatataacacaatttatctgatgcaagtttttaataagtaatttgtgactgtgcaagtatatgactaaagtattgtggtatataaatagtaaatattgtatgtctttcagtcactttggaggatataattttgttataaatgataatatcttgataattgggtttatgaattatttcacaaagttaatctttaatcataatgaagatcatgaaggaagataatattcacctcttattgtatgatttcaggaatctgtattttcactttctgttctctctgaggcagcgttttgatgcaagatactcgtaaattcagattctccagctgtgatgaagagtgactgtgtgatctaaaacaaattaataattttctctgagacttactgtaaaatgtactcatcagttgtttgaagatgctgattttttttttgtttgagactgagtttcattgtgtcacccaggctggagtgcagtggcgtgatcttggctcactgcaacctctgcctcctgggttcaagcgattctcctgccccagcctcccaagtagctgggattagaggcacctgtcaccatgcccggctaatttttgtagtttttagtagaaatggggtttcctcatgttggccatgctggtctcaaactcctcacctcaggtgatctgcccaccttggcctcccaaagtgttgggattacaggcgtgagccactgtgcctggccgaaggtgctgatatttgatagcatgattgtaaggattaatgcactacacatctgacatagttttattatagtacttgttcctgtgcatacatatttttcatgcagtgcaatcatactgctgataaaaattttgtcttctctttttacttgacctagtgtttccatagtgtaaacaaatttcataattactcttctaaaagtattgaagtagactcatgacattctgttaccaaaatactgcatagtacattgtgtcctttctttatataacatgagccagaaatgtacctgcttctcttgagaaaggcatgtttttaaaaacctcagttcttgagataacgatgtcatcaaaaccaagaagatacagagctgagttgagtcggaggagtgggcagatggtaggcttgccagctgagtggtgcgcacaccaggatgagattgcagctttcagtggacagatttgcgtgttatggacatttggattgcacaaaaactgtcagaactataaatctgagactttcaaggatatactatccttcagctaaagatgatttcaacatacatgagcaatttctgttctgttttctaattttatcatttaagaaatgatgctgctgaatagatttattcatacattgctctttccttcactagtagtacttctttaggttaaatctctagtagatttaccctattaagtgacacaagtcttttatagtacttgatgtaattgccaaattgttgtttaaaggtattgtattgctttatatggttcccagttaagtagttttagctgtctgtaactagggatttttcttttaatttaaagtgctaatttaataggtaaaatactgatttcaatttatatttatttgattattaatgaatttcagcatttaatttttgtatattcatggtatttcctcttatttattcatctttttctttagttaaattataagatggtttaccaatttgagccttttcagggttttgggaaaattagacttttaatctaatcatattattctgctttttcttttagctccagtaataaaccgattcacaaggcgtgcctcaggtaagtctgattatattatggattttgtttattaatggtgacatttaaaaaatgataatattggacaagaaggtacaaagaataattgctgtatagtaaacctttatttgtcagttatttttcccagaaaacacaactatctgatataatcactatctaggaagcaattgaaaatgccctacctaggaagcaatttcaaatgcaattgaaaatgtgagtggctacactgaaagtcacactgtgtactaaactggtgggcctttttaaatggagactctcagcccagggtgttattcttgctcttgatagaattacgatctgtatggttgtctgatttaccagccataatctagaaacagtgatttagcagatgggtaaaggacaccttagaaacagtgataattgagtgagtgtttttttgtttgtttgtttgtttgttttcataagagggtttttaataagggacaggagaactcttaaaatgcaggtataagaacttgtcattatgggaccatttagaataggagcaaattgctttacatttgtttgtgcccctgaggctattgctggtttaaatatactacagtaccctaatgtagtcagcatgataggccttagccattaacaagggcgtacgttaacttcaatatactgtgtactatttaaactgctggggaagtatgagacagaattaagagcatttctgtccaaaatggcttaagttaaatgagtttgggcattgagataaactattatttagaaaattcaccatatggcttatcttctctgtgtaagaggacaaatgaagtgagggtaatatttgatttgagaaaattactctttaagtatacctggaaattttttgttaaacccaagataaacatttcacacagatcatctttggagttgatataatacaaatgggtcatttatttcacaaaattaccttatttccacctgtgctataatattaaagacattttaatgttgaattttatttttgatttgtcagcagttactggtataatttactcttgttatgtagtgaccaggtctataaggataatatgctatattggaataacatctactttatcattctgagctttttgtaatctcaaggcgtgtttattttaaatggtgaaaacaagtgtagattgtaatgccttttgtggaatgagacattatgtttatgtcagtaaggcgtcgaattttatcccaaagaactatcaagtgtgatcatattctagtgtagtagtcctttatgagcagtggtgggaataggggaggaagaagagagaatcagtattgtgatgccttgtcttcatgaggtgaaattctttcaatagaaacacagttaagagtcatagaataaataatcaccatttctacctcaaaccgtatgacatgtgacatttatttctgggcacgttccattagtatttgttgtacattatacgtatcattggctgggcgaggtggctcacgcctgtaatcccaacactttgggaggctgaggcgggcagatcacgaggtcaggagatcaaggccatcctggctaacatggtgaaaccccgtctctgctaaaaatacaaaaacaaaatgagccgggcgtggtggcgggcacctgtagtcccagctactcgggaggctgaggcaggagaatggcgtgaacccggaaggcggagcttgcagtgagccaagattgcaccactgcactccagcctgggtgacagggtgagaccgcatctcaaaaaaaaaaaataataaaaaataaaaataaaaaataaatatatatatatataattgtagagatgatgtaataccacaaagaaatacacattaaaatcaaatgttgcatttattcccagaatgacaggtaataagaaatgtcagtgaaaacaacaggaaacagtttggtataaataagatgataccaagttcaggagtcacgctgtatacagcagtaagccttaaaaggagtaaaattgttatcccaataatataatatgctggaaaccatcaggagaatgaatcttgacattaattataagaaagaaaagagaactaatttatggagtaccactgatggatcaggcactgtgctaagcattttatatacatttttagtctttcaggcaaggcaaataaaattatttaatactttgaataaaaaatgtggtataagaaaaaagggaagaggatttatttaatcatctacttctctgtattttatttgagactttcttaattcttataaaagtttgtgtaaaatgtttttgacaaagaatatagaaacagtcttaagacatcctgaggaggaaatgctacagtttttttgttaatttaatttagtgctaacatgaagtttagtaatagagatgtacattaacttttttaaaaagtaacatttcctgaaaataaaaaagaaatgattattttctcaaaatgcagtcaattgtatttgataattaaaaagatttcttatgataccttttctgattgagttttcagagatactttttcttttcataacccataaaactttaatgtaagaatggtaatttaggggaagaaagtaagtcaggtaaaatcaactggaagtctgtacgacgtaagagtttgttttttattcatctgtttttaaattaaagttacaacagtaaatgctatatgtatatattacaacaataaatacaaaatgtgtagtgctatgtgttctatcattgttgattgaaaagaaaaaattactatgaattataattaataactcattaactgactttcctaaatcttttgaatttttggcttttgatattcatactgcatctatcaaacataaatatttcaaacctgaataatttaaacaaaacatttcccctttggatacctttttcttttgttatgaaggtgagaggaatatttatgcttaacaaatacattctttaggattatttttacacttttaagaacactatttgtgctatagtctctcgtcttcctcatgtgttcagtgctggcccacaaacgtgtcagtttttatttttgtaagtgaaaggaatcagtttcactcattattttcaaacagaattcctagcatcttaagagtttatagaggcttcagggttgtataagccagcatcttacttggtacaggagtggaaggcatgtagaaagcatgactaacgaagagaagcgtagatgggcaccagaagaataggacccaattttactgattagattggatgagttccacaaaacatgatgaaaaactgtcagatgtcttctgaaatccagatatatctctgatagcatcctgacagcaccccataaccttatttttaaacagtacctcatggtcccatttttaaacaaaagaaaaagaaatactgcttttgatctcttaaaatgctcttcagctcttaataatcccttcttatcagtacatccttaagacagagaggcctggtgtggtggctcacacctgtaatcccagcactttgggaggccgtggtgggcggatcactagaggtcaggagttcgagaccagcctggccaacttggtgaaatcccttctctaccaaaaaatacaaaaattagtcaggcatggtggcgcgtgcctatagtcccagttactcgggaggctgaggcaggagattcacttgaaccctggaggtggaggttacagtgggctgagattgtgccactcactccaacctgggcaacagagtgagaccctgtctcaaaaaataaaataaaataaaataaagtaacagagaaatcattatccataatccattttattttatttgtatttgagatggagccttgctctgttgcccaggctggagtgcagtggcacgatcttggctcactgcaacctccaccctcccaagttcaagcaattctctcaagtagctgggactacaggtgtacgccaccatgcctggctaatttttgtatttttagtagagacgaggtttcaccatgttggccaggctggtctccaactcctgacctcaggtgatctgcccgccttggcctcccaaagtgctgggattataggtgtgagccactgcgcccggccacataatccattttacaatatgggctttttgttttttggaagattattctttttggtggaaaatggaaataatatatcatttgttgttgtgagtattaaaaattagtggtggtggctgggcgctgtggtacacacttgtaattttgccactttgggaggctgaggtgagcggattacctgagattgggagttccacaccagcctggccaacatggtgaaacgctgtctctactaaaaatacaaaaattagctgggtttggtggcgggcgcctgtaatccagctacttgggaagctgaggcgggagaatcgcttgaacctgggagacggaggttgcagtgagctgagattgcgccaccgtactccagcctgagcgacagagggggagactgcgtttaaaataaataaataaataaataaaaatttagtggtggtagtagtagtagcagctcagtaaatattttaagagtaaagctttaatcaagaaataatcctgttgcttcactgttcacctaatatatagaaaagatcctagggtttgaagttgtactgactagagttttcccattttctctgtgaatttgtatgtaagttgtttacttctttgagtttaattttatttattttcttttctttcagcttgggatcttaatagctatattcaagcttgtgagggttaaattggatgatttttattatttttaaattttttttttttttgagatggagtctcgctctgtcaccaggccggagtgcaatgacatgatcttggctcactgcaacctctgcctcttgggttcaagcgattcttctgcctcagcctcctgagtagctgggactacagctgcacaccaccatgcctggctaattttttgtattttaatagagacagggtttcaccatgttggccaggatggtctcaatctcctgacctcgtgatccgcccaccttggcctcccaaaatgctgggattataggtgtaagccaccacacctggcaattttttttttttttttaagacaggatttcactctgtcacccaggctgtagtgcagtggcatgatcttggctcactgcagcctccaccttccaggttgaagtgatccttccacctcaccctccctagtaactgggagaacaggtgtgcaccacaatgcctagctaatttttgtatgttttatagagacagggtttcgccatgttgcccaggctcatcttgaactctcgagctctagggatccacctgcctcagcctcccaaagtgctgtgattataggtgttggatgagtttaaggaagcccccagcagagagtctaggcttttcaaaacgttcgctctcagccttcttcttatgaacgtggtttaaaacaaagccataaacccctcagctttttgccttagcctgtcagaataaagccttagagagtcataatactgtttgatagtaatcctttaatatgggcatctttttattgtttatacattataggttttctaaaaaattgtaatggttttcctctgtggttttgtctctgaattggggaggggctagaaatgtccagttaatcttaagacagtgccttgcatcatgaagttggaactctgaattttttttttaatcctaagatactgttttgaaaaagttacccttctagaacagtttaaagagttcagtgagcgcctttatctaggctccccagatgttgatattttgccacatttgcatgctctctcctctccatctttacacagacacacactcttttttattgaaacttttaggaatcttaaatacttcagcctgtatctcctaagaaaaagggcattcttctaggtaatataacactgaaggaatttaacatcgatacgatactattatctcatacagagtttagagtcagatttcctccactgtcctatcatgtttttttctctctctcttttaaattcaagctaattcaaggattttttattgcatttaattgtcatgactcagtttttcttgcctttcataaattgactccctgaagtttttgaaatttgctttttcagagttttgaaggttattcctaaccataagacagttccctataccgcctgttatgcattcatagatggcattagcacagctgctgtttgttcagtatgccccaccgacgtccatgaaatctttgcattgacatttactattgctttcaaggactacttgaaagcaattacttgttctaataagtaattatttcttataatagaaggattttcttttctcatgtagttaaccactctttaattttttgccatagtatgaacatataattttgtggtatatttttaacagaactaaaattttataattttctgtaaactatgatgtagaataattcacaggtgaaattaatctttaaatttcaatctcacacacctactgtgtaaaatgtgatattacaaatctcagtgaaatcaccctgaacagaaatgattattccccaagaaattagtgaaatagcagaagttcacatcttgtcttgaatctgattcaaggaacatatgcttccttgattcacggaacatatgcttccttttgttttgtttgggaaatatcttgtagccttggtgttcattgtttctactttaaggttatttgacgataacagcttttaacccccaaactatttttttccagaggtcatttctatattgtcaaaccaatttgctggtataattatagttacattcatattttgttttttgaaattagcttcatttttaataagcctgttaatcaccaatacttgggaatacatattgggagaatactactttaattaatatactagtttattcagcaaacatttaccgagtccctcttgtgtgtcaggtacagtgctggggatgccacgaataataagatacagttcttacgaagtgcgcagtctagcagggaagctgatgatgactcatagtgtagtaaatgccgtaatatcctcaaagtgaaaaggagaaaacatacagtttttccagggcctgcctcacaggaagggtactatttgtgctgtctttaaggtttataacataggttttacgaggactataaggagagagactattctaggtatttctattcagtattactgtaaaaagtccattttcaccatatgttgctatgcagtttgcctctgccatcaagcacctatggcatggagtgagcagatgcccactggctatggatagcagggacttaaggccaggagttatttcatcctttaatttaccattgcttcaaaatgttaacatctgccttaccaggagaggctgtataggctctggaatcagaccagggttagagtactagctctgttactcacctatctacgtattaaaagtgtctctgtgtgtgtgtatccttagttacctttctaaggcttagtttctctgggtataaaatggggataatacctaactcacaagatgattgttgtaatgaaacagtagataacccatgaagaacagattcttgaggccgggcatggtggctcacgcctgtgttcccagcactttgggaggccaaggcaggtggatcacctgaggtcaggagttcaagaccagcctggccaacatgacaaaaccctgtctctgctaaaaatataaaaattagctgggcgttgtggcgtgtgcctgtagtctcagctacttgggaggccgaggcggaggaatcacttgaaccagggacgcaaagttgcggtgagccaagattgcaccactgtacactccaagcctggatgacagagtgatactccatcaaaaaaaaaaaaaaaagaaaaaagaaaagaaaagaaatggcttcaggactgcagagcttgacatgaagagttagtcagaaggatgacacccagggtgaggctgaaatcaagggtcagaaagagaatttgactgaggcaacaggatgaaacgagaggtgtcagtcttgagcaagggaggtgggaagacaggatggaaggtgggactgggacctaaggaggttctctgagatgccagggcacaggcctgggggcttttgtccaggcttgttccttgggtgggatggaagccatttagggggcctccaagtcacttcatgcacctgttatctctcagtgcccacactagtattataataaaatgggttcttccctgtgattcattatgaataatccaagtgaacagagcaagtactgctcctggctcatttccagccacttgcccctcctgctctacactctagcagcgcttgtttactgatacttaagcaaccttgggaattggaacccagtggaatctgtggcattgttgagtctctggttcttttttgttaggccctggaatgctgataagctacctcaaggctaatgagaaattagattatctcttgaacttaattgcattttcccagagttctcttagagccccccagggaaaggagaaaggaagatagtgaaagcagctgttcaggttggggcatggtgggaagggaggatctttctgcgcctatagtgtcctcagactcttcacactggtggttttgccagtcgatgtggaagggcttggaagataacatgggaattatgtaacccaccaaaccccgtgtgccttaattacaggaacactgccactgttggggaaaggggtcggggagttagatctataagatagtataaaataggtatgagtagatagaatagacatttagatgtagtgcaaccattctttaattacaagcggagtttaggtcactacttcaccagctctgtgtgaaggatcagtttttcgtttttgttttcccagtgcactgcagaccagcacttttgagaaatataaatttgccacagcaatatcaaattgctataattgtatctaaacactgttttactctctgtacttatcttattgcagattgccatggcttaggtgatacaaccgtggtgtgtgctacatgagataagaaacttctcacaaaaagcttttataaaggaagattgcacatttatctaaaagaagcgattattaaaaaaaaaaaaacaaacataccttattttgctaacttggcattttgtcaggacagcctgcatgaatgaatggtgcccttgagttgtcgaatggtggcgtgtggcagccctgcttcaggcccgtggcgtgcctgcgttctgcctccatgtatgcctgctcatattcagagcatgccatgggctctcttatctaggccttgctatagctcaccacattccctgccatcagcttccttcctctctccctccctcccttccttccttccgataccgttactgttacacatcgtttgatgttgtagttgcttgttcacatgtctttttccctatgcttaacagtgaggttcataattaatggactgagaaacaaggacactctggatgaggtcaaagaaaaaatagaatgtgaagtaaagaaatgagaatgcaaggaggatgggaagatttctccaggcatgtgtgtagagcggtgtgagattcctgagtagtgtgtgctggggtaaggaccagtgtgaatatagttacagggtgagcctgctaaagggcaggctgagtgacattttattggaattaaggaagccaaaataagttgaggatgggctctcaaatgggttttcaacttggacattgactgcctacgatggtggcacattggagtgaaatgaaaactgtgagccaggtaccagtcaggaaggggcatctgtatgccgtggctctcggaggagcacagaggtttcagtgggagcaccatggagtggtccagatgccagtgtggggagccacagcgtgccctcactatctttcagatcccactgtgtgcaggaagtggtaccgtctaagagaaggagtgttcttggagaagaatcaagtttcaaccaaggcagagaaaagtcagtaatgttttataaaagaatgtgagggtgtggggaatgtgttgggaaggagggtagtaatggacagaaggaagccacagagcagcaattcatttgaggaaatatttgcaagcaattaccattgccagggactacactaggcacagcagtgaacacattatgcccttgaagtacttgcagtctagggaagcttaaggcatggggagatgaaattagggaaaagatggtggtctggagggtcttacatcttgtggatgaccaagggtgacagagcaaagaggacatagttggattgatagtttttagattataatttattcactgtaaatacttgtttaactaaactttccttaaggctaactctgttagcttcctaatgagagcgctgtaaccgtctgatacttatcttaggtacagaaggcaatatgatgtagaagtaagaggctggatttggagctgtttttaaatttaacagtcaaatattcaatgagggcctacaatgtgttgggcactgggctggacccagggcaggcagatacagtttaggatcttaggtacatcatttattagctgtgtgaccttgggcaacttacttaaatgaccttctgtaaaaccagattgtggttattctggaagagaatgcaggcaaagcttttagcatagtgtctgacacattttgagtgcaaaataaacttttatatattattagactggatttttcaaattttaacctgataaaaacaccataattttagtgtctcttctttcctcttgtaacttatcccacctaatattaattggccaaagtgcataattttgtgtatgtattacaactaactcccctaccccaaatttgggttaacttaacattgtattgttatttgtgggggagagcaaagatttctctgaaatgtaacatcctttagctttttagatgaaaacagaaaagcaacctcagtccctcatcataaactgtatttgtagactgtagttttgaaagcaaattgatccaccttttaaaaatctaaactgatattttaaacaggtgtgtgcaaatgcagtccctcccacccccaccccatcagcatcttgacccagctacttctttggagctgactactagagaatgttagtctcatctctgagagcccagcaatatattatatactaggtaatcattggataatgttttctgatattttaaaagttaatattgcaactaaaaaccaaaatacctattcaggtcttgtcttccctttaccagtaagaatcagggtcttccccttccctgcacctccccggattagttttctactttttcatgagttactaaaaccagagaacactgattttaatgttgttttacagaaaacggtaccataaaattgacaacaaattaaaatatacattaatggtacagtatattgttttcagaatagtggaaagaaggggcctttcacttgaaagacggaacagcttaaatgatagtgttgttagacgtgtttcaaggaattacaaaatgttgtgtttattgaccatcaaaaaaggtacagctgaccttttccttagatattttaaaacagaattccaagttatagctcccctttaaaaacaggtatggatactttaatatatgcattgcctaacagagtatataggctacaaatacagcaaatgcacatagcttttattcaatttttgaacagcagcttaccagacgtgctgagttttagcaggttgctgagtggtaatctgcaggagaaatggaaaacaggtttgccttaactactcttgtggctttctaaaaataaattgctactttcaagttacctatttggtattttcactttatttagattttgtggatctcaaaattttctttttataatgttgatacattaccacttacaatttacttctgaattctgtaccataaaaataatgtattttattttcatgttactttaaaaatgatattgcttcttacttgcttatatttatcattccccccatttgtgtccttagaaacatttgttttaattgctctgcttttcttaagtacatttatatgaagagagctatttaatgtattttaaatacatttcttagaattgaaagctcttcttagaataatgaaaaaatttgtaattcagaattatattttattgactaataaataagcattcatgttatattacatagacaattaattagaagttaagtgaaattaaaattttcctgtagttaaattatttttatttttatttttatttttttgagatggagtctcgctctgtcgcccaggctggagtgcagcggtgcagttggctcactgcaacctctgcctcccaggctcgagtgatcctccctctgcagcctcttgagtagttgggaccacagatgcgtgccaccaagctcagctaattttttttgtatttttggtagagacagagtttgaccatgttgtcaaggttggtcttgaactcctgagctcaaagaatccagtgcccgccttggtctcccaaagtgttgggattacagctgtgagccaccgtgcctggcataatgattgttttagaagggatcttggtgttagactgtatagttggtgagactgaagtgtcttagatggaggttgtacctgcaggagagtcacaatgtgtgtctcatctataacagagattctgaggcagaggtcattataagttttgaaggtaacctgtgagtctcaaaatgttttttatgaatttgtaattccgaggctgggtatggtggctcatgcttgtaatcccagcaatttgggaggctgaggtgagacgatcccttgaggggattgtgctactacgctccagcctgggcaacagagcgagactgtctcaaaaaaaaaaaaaaaatagagtttataattcccaaagccttccctcccctctgagggaattttatcaaggaatacatttctctaataagggaagtagctcaaatttttgaataaagattattttgattatgagtcttagtagtctaatttgcaaaaatagatgatggtgatgatgacaacaatactaattaaaatttatgcacggtcaactgtgtgtcgagtgctgtttctcaactttgctttccctgagacgacctatgagaatcactagtgcaatatttgaagggagttttcttattatctccattttacaggtatggaaactgaggcacagtttactttttatttttaatattattaatttattccttagtactgagtcaagcctagttttttcttgttgttgttgttgttttgagacagaatcttgctctgtcacccaggctggagtgcagtggcatgatctcggctcactgcaacctccgcctcctgggttcaagtgactgtcctgcctcagcgtcccaagtagctgggattacaggcgcccacaaccatgcctggctaatttttgtatatttagtggaaatggagtttcaccatattggccaggctggtctcaaactcctgacgttgtgatccacctgcctcagcctcccaaagtgctgggattacaggcgtgagccaccacgtctggccaaacctagtttttagctattttattaaatggaattatagactagtaggaccgtcacagtcttgattactttaagaccagatcatgcaagtgtttttgactattctgcaggaaatgaaatcaaaccacttctacctattttctcctgttatagtttttatcctgagtctggaagttatgttaaatatttttttgcactaaattccaataaagcagagaaaagacaattgttaggcaatttgtagtaccagcattgtttttctatacatactgttataggtgaagcatttaaattattgtgcttttttggtaacaagttttttacattttaaagttgttctttatattttaatcaattcatcattcaaagttctgtgccccaaattataaaatagttcacattttaatgcttttagcagtcaatctgagtgattcagattagttttgatctaaatttaaatgttatgttattatcttttcagctagaaatctgaaaatatcttgttgccaaccatattagtggatatatatctagaaatatgtaaagcgtagtattcatttatacaaataggaaacttatacatttttgggagtgatttgcttacagtttagttcggtttattattgctctttgtttctccctggatcagggagaaaacccttaatactgggaaaatcaatttaattcctattataatgactaccatctatatactttttttttttttttgagatggagtcttgctctgtcacccacactggagtgcagtggcgcgatcatggctcactgcaagctccgcctcccgggttcacgccattctcctgcctcaacctccccagtagctgggactacagtgcctgccaccatgcctggctaattttttttttgtattttgttagcagagacggggtttcaccgtgttagccaggatggtctcgatctcctgacctggtgatccacccgcctcggcctcccaaagtgctgggattacaggtgtgagccaccacgcccggcctatatacttttgaagtatctgcaaatcaaacagaagattaatagtacaggtatatacgtaagggagatgctaacaactgaggaagtcatgtttgcttggtttgcagaattgtgattattaaatatcatattcctttgtaattatggatcctatgaaaaataaaagatctacttgtctctgtttgtataacttggaatggatgagacctgccctctcagccatctataagcaataatgttagatgctctgtgatgatttggaagaaggtgaggagagggaggaatatacaagggaggtgggcatggatggagtgaagagtggaaggtgatgattgtaccaattttctgtgttttaatttgaaatcatctccaacttccatatattcagcaagagtaagtcaaaatacttttttggcctttttaatgatgaggtcatgtttctcactgtaaggttcaattatcaaaatttttccaaaatgtaatatttatgaatcaatctttttttatagttgtgattagtatatgcatatatgttacatcattaaaaaacttttattataaaattgataaatgcttatggtaaaaaagtgaagtagtacagaagagtataaaatgaaaacaaagggttgtgtctctacagtgttcccagtcccagtcctaaaaaatagccatacctaatagtttgttgtgtatttccttgggtgtttttatgcacatacatatttagttgaaattaaacttatatccaattttttgaacattgtctttttcacttaatagtgtattgtgttctattttccatgaccttacctctaaagctacctcttgctttttaatgacttaaagccacctcttgcttcttaatacttcttaatggtgtcctattatatgtgtgtattgaaatgtatataacaagggtatttagtttttaggtacaaatacctgcatagttttgcaagtacatctacaggatatattttttagaagtggaattgcttaatcaaagaagcatgaaatttgagcatgtgaaatttgtataggcattgtcaaattgccctctaaaacagtatgctgattcatattccaatcttaggttcaacacagtgtaaaacacttgatattacaaaattttgaaatgtctgttaatttgctagctcagttatatttcagttggcatttccttatttatgagtgaagcatagctccttttaattattgttgaccgtttatattttcttgtgtgaatttcctgttaaatttttttttctctgatttgtaagtgtacagatctgaggttcaatggctttgagttcggatttgggctttactactaactagttgtttgaccttgagagggttatttagtctgaacttcagttcattatccgtaaaatgtggtagtaagactgcccagctcataaggtatggttaattaatgagataatgaatagaaaatacttaaccgatttcttaaagtacagtgagaatatatgcttgctagtagcattactaatattagtagggtttttttttaaattaaaagtagaaattttcagaaatgtcttttttttttaagacaaactctctgttgccgaggctggagtgcagtggcatgatctcagctcacccctaggctcaagtgatgctcccacctcagcctcccacaagctgggactacaggtgtgcgccaccatgcctgggtcatttttgcatttttttgtagatatggggctttgccacattggccaggctggtcttgaactcctggggctcaagtgatctgccaagcttggcctcccagagtgctgggattaggcatgcgccccctcaccggacgaaaatgtctttatagcatccatatgataatttggtttacttcgtaaacataatgatatggtaagtttcaatagattatctaatatcgaactatccttatattcctggaatgaactctgcttggtcatagcatattgattattaattatattcttaaaatataactaacgtataacaactattgtttaacacaaattaaaacacttttaagattatgtatacttcatggctttaaaataattacagaatagttttataaaattgcagtgaaactttttcacacataggaaaatgttatatgttctattatgtgccttttaagaatgtatgcccctctgaaatagtatattattttgacagtctaagtcctcttacttaagattgattttagattgagaatctagcagaaaagtgaaataaatacatagagaacatttatgtaattcacatttaatgttttttttttcctaaaagcattttcatccatcaaatatggacttttttcttatttcctccttttaaacttgaaaagtactatattaagggcattagaaacgtggtgctgcataacataaagatatttcattttgaaaaagaacttgggttccattttgcatacaaactttaatataaatagaacctggaattccagtaagaaccactttaaataatcataatagctaccatttatttagagcttactgtgagccaggagcttttctaagtgctttacatgtattaaatcattttattatttaagtgcagctctatatgacgggcactgttactgttctaatgttaccagtaaggaaactgatccagagaggttaagtcctttcccaagcttacacagtgactgatgggcagagactggattcaaattcaggcattctctctgtaatcccagtactttgggaggctgaggcaggcggattgcatgagctcaggagttcgagagcagcctgggcaacctggtgaaaccctgtctcttttccttactttctatttctattgccaccactccagttatcacacacttagattacttatctctcttgaattagtcttcctcttcttttctcactcacctagtacatctctgccctaacatcccacatatgataaagtttatacattttaatttaatttatatattttaactcagggtcctcaggaacctacagtctcagttactctgttaaccccattttctattacaccagccacaaatgctctcatataaccaagctgtggctgcctactgtatactaaacattcattgatttacagtatgtcgtgtaattctctcatcagcttttagatactattattatttccgttttaaagaaacgaaaactgaggcacagagaaattaactggtagaaggaacccacagcttatcaggagagcagtcagagtttgaatccagtgagccactcgttggaggtgggttcttcagcatggtctttcataggggcggaaacctcgttcaggtatcctatgcagttatcttgaatcagaatctgtggggtgatttatttatctagtgagtgatgcctagcacctatttacatggtcagagaatgcctctctcaggagctgacatttcagccaaggcctgggaagtacagggtggagggtgaggggaaaggagagcattccagggaaaggagatgttgtgtgtaaaggtctggagcttattccctcatttgtcagcagtgtgaatgtttatctttttgacatcattcttacgtcttttggcagcttaagccaaatatatcaatctattttttgagatttactcctcatgtgattctcatacagttggcttttattttattttatattttattttatttcgagacactcttgctctgtttcccaggctggagtgcagtggtgtgatcttggcttattgcagtctcctcttctcgggttcagatgatcctcctgcctcagcctcttgaggagttggggctacaggcgtgtgttaccacgcccggctaatttttgtagttttagtagacccgtggttttgccatgttggccaggctggtcttgaactcctggcctcaagtgatccacctgagttggcctcccaaagtgctgggattacaggcatgagccactgcacccagccggaggtaggttttaataatcatattttgggaggccgaggtgggtggatcacctaaggtcaggagtgcgagactagcctgggcaacatggtaaaaccccgtctctactaaaaatagaaaaattacctgggcacggtggcctgtgcctgtaatctctgctactcggtaggctgaggcaggagaattgcttgaacctgggaggtggaggtttcagtgagccaagatttgccactgcactccagcctgggaaacagagcgagactccatctcaaaaacaaacaaacaaaaaaatagtcacattttacacatgagaaaaattgagattcataatacttagcaatgtgtaaaggtcatataataagtggcaggaaaaaaatggcagagatgggattatgcttcaggctctctgaattctgcgctctttcctcatactgttgatcagtcattctacatgtaaccatggataataatttatactcctcccataacagatggatttatcttcctaaccaggttctacattagtagagtttagggaccctgtttagtacttgtctccctcataaacaccaactactgcgttatatataaatggtcagtaaataaaagttgtttccatgtatcagttttgctaaagccagaggcatttcagaccatttttcctatggtaaaataaaattttgatagttaaaaagttatttgcagggtacatgcatcatttttctaaaaacaataaagctatttataaagaaataccaggcagtggttctgaaatacatggaacataaaaactaaattaaagatctaaggccaaccttacttgttttgcagatttattcatttgctcagcacaattggttggaagagaataacttcagttttgcagactatcatttacattctctactagcacagataagcagataaaacagtcatggacactcctttcagaaccacacatgatccctgagttatgtatcacccattttgtggttgtaattctattgactagtcactagcatttgaatctgtcatcttgcaaatacaactttcttatcaatgactgccctatggttttattcttagttacttttggtaactggttggattgtcttgttttccttgtcatgatctttttaaacacgtattcttaacatctgaattctctttggttgcaagtgactgcaatgtgcaaacacctttaattcaatcaagtgaaaagggggtttattgagatggcaggggtgtggttcacagaatcaccaagtcacagcaagggtaggggtgcagttggatttcagaagcaactggaacctggttttgagccctgttaggaatctctccatctcttgcctctgattctctcttgcggccagctacttgctccatatggtgaggagcatcgccactgcagttccacattttacagctgcagcaagaaagaggtggacctgacatcccctctcattcaaggcttccccaaaatcccaggaaagcattctaattagcccagctatcctggattgacctggaaattgtctcatttgcccctatggggtctgctatggcacagggctcagaaaccctgacctcacctggagctaattttgactgacccatgtcagcttatgagaactgtatctgccagctgatttttagtttagactggctgccctgaagaagccctctgtctttctttgccaaaggcagtgtctctgttggctcgctgagcttcctttccagcctaaggggacatctgcagtttactcagcatgtttgcaaatctgagaaaactgacaatccctgagcttcttctgtgagggaagctcaagtcacctgtttcaccacctgctgtgcaactgcaggtgacccgtttggatgtgtctttttctgttgagaaacattactgtttataacagaataatacttaacatagaatgacaggaaataacaatactagacaaatgtttctctttaaaagaatgggaccgttatcttgcatatcagttcttctagctactaaaggaaaaggtcccaaaaaagaaataatactttacatttacaccacaagtttttcaaagagataaagtgggaggctaaaggtcactgtcatctttcatcttatgaactgttttttgatgttattttcttcagaacattaagagcagccaaccacctggttccctcattatgcaaaattattgcattttaagatcagattggatgttatttccagaactgtaagcatttctaatttgtaagagcactggttttttttggtgcaaaaaggatcgtttttggaatgattatactgtaataactgtagaagagatagttttatatgtggttggttgtgctgtcactttagttaaattcaaaggcatttataattattcaccatttgcaagacattcatatgtgcattctatgagactgctaaaggtaagtaaggtatagcttgtgcttgagtcctagaggagctaaatgggtatgatgactctcctcccagaggagggtgcatcatgacaaatgtcacctaccctgattctactaaacctatgccacagagagcacaagcacaaaggagctgcgtgcacattccactcagtgagtctgtgccctgcagtaggtggacagtgagagcctgtgaatgtgaatctgccattcctgcaggctcacttggttcctgcatgcctcccagagcatgaacatttctagggcttaaaggtatccattttgcatataacatggcgtctaaatacaagtcagcagtaacttctagtgcttacaaggaaaaggcaatcagttttaatggtggaaatgccactattttggacttcttgtagggctatgtgacagtctccagcagtggcttcctatgggattttcaagaataacctggacgatagaagatttttgcctcatatgttgtttagaatttatcacccatgtaagatgcgaatctactgaaacagaaacataaataaggtgcgttctgtgtttctatgtagaagagagtatttaatcctaactcatgtatttattttggggaaaagtgtcagggaggatgtggcatttgagcagagatttgagggaagagaaggatttttataggtgggaatgggtagtggaaggaataaatttccaattcagcaaaccatgtaagttaatatgatgttcagggaatagtgaatagtctaataaggtttggaatatgtgggctttattataggaagaagaggccctaaatataggtttggatcagattgtgggggagggtagccttgaaagccactgtcactgtaagagtttggattttattctgtatgtgatggggaaccattaagttgtgtgtgtgtgtgtgtgtgtgtgcgtgtgtctgtgtgtgtgtgtgtgtcacagaatgaaattagcagatgtatcattaccagaaatggtcaggatagaatcctgaagtttcaaaataggtctttatagtcctacctattcctttcatggtggtcattatccaggaagcagctgaaaggagatgatgtctttcaggggatagcggtgtttaaggattaaacactcttattgaagtgtgtgtggactaagaggaaatgagggacatagactatcagcccattgtgctgctattgcctgtatattatatatgttataaacctactaacaattcagtgttatagttgttgctttatgaaatgtgatgtcttaaggaaattaagagaagagcaaaaatttatgtttactcttttctgtttactcacatacttatttaaaatttaaaaaatttatctatgtatttttattacaattttaaacataacataaaattcacgatttttaccattcttaggtgtatggttctgtggtattaagtacattcacattgctgtgcacccattatcaccatccatccacagaactgtttaatcttcacaaactgaaactccgtacctgttaaatacttaactcctcattcccttctgttcccagccctggcagccaacattctttctgtctctttgaatttcagtactctaggtacctcatagatgaggactcatgcaatatttatcctttggtgactggcttctttcacttcgtgtaatgttttcaaggttcattcatgttgtagcgtgggtcagaatttccttcctttttaagatgatataattttctattatatgtaaatatcacatttgtttattcattcatctgttgatggacacttgggttgcttctacctttggctattgtgaataatgctgatgtgaatatggacgtacagatatctgtttgtgtctctgctttcagttcttttaggtatgtacccagaagtggacttgttgaatcatgtggtgattctgtttatttttttgaggaactgctgtgctgttttccatggtgctgcaccattttacattcccactaacagttcacaagggttccagtttctccagatctttaccaatacctgttattttggttttttgataatagccaacctaatgggtatgaagtatcttactgtgatttttacttgtctttttctaatgactttgtgatattggagaaatgtctacttaagtccagtgcccacttttttttcttttttttttttattatactttaagttctagggtacatgtgtacaacgtgcagatttgttacatatgtatacatgtgccatgttggtgtgctgcacccgttaactcatcatttacattaggtatatctcctaatgctatctctcgcccctccccccaccccatgacaggccccggtgtgtgatgttttgcactctgtgtccaagtgttctcattgttcaattcccacctatgagtgagaacatgcggtgtttggttttctgtccttgcgatagtttgctcagaatgatggattccagcttcatccatgtccctacaaagggcatgaactcatccttttttatggctgcatagtattccatggtatatatgtgccacatttccttaatccagtctattactgatggacatttgggttggttccaagtctttgctattgtgaatagtgccgcaataaacatacgtgtgcatgtgtctttatagcagcatgatttataatcctttgggtatatacccagtaatgggatggctgggtcaaatggtatttctggttctagatccttgaggaatcgccacactgtcttccacaacagttgaactagtttacagtcccaccaacagtgtaaaagtgttcctatttcttcacatcctctccagcacctgttgtttcctgactttttaatgatcgccattctaactggtgtgagatggtatctcattgtggttttgatttgcatttctctgatggccagtgatgatgaacattttttcacgtctgttggctgcataaatgtcttcttttgagaagtgtctgttcatatcctttgcctttttgatggggttttttgattttttcttgtaaatgtgtttaaattctttgtagattctggatattagccctttgtcagatgggtaggttataaaaattttctcccattctgtaggttgcctgttcactctgatggtagtttcttttgctgtgcagaagctctttagtttacttagatggcacttgtttgttttggcttttgttgccattgcttttggtgttttagtcatgaaatctttgcccatgcctatgtcctgaatggtactggctaggttttcttctaggttttttatggttttaggtctaacatgtaagtctttaatccatcttgaattaatttttgtataaggtgtaaggaagggatccactttcagctttctgcatatggctaaccagtttccccagcaccatttattaaatagggaatcctttccccatttcttgtttttctcaggtttgtcaaagatcagatggttgtagatgtgtggtattatttctgagggctctgttctgttccattgatctatatctgttttggtaacagtaccatgctgttttggttactgtggccttgtaggatagtttgaagtcaggtagcatgatgcctccagctttgttcttttgacttaggattgtcttggcaatacgggctcttttttggctccacatgaactttaaagtagttttttccaattctgtgaaggaagtcattggtagcttgattgggatggcgttgagtctgtgaattaccttgggcagtatggccattttcatgatattgattcttcctatccatgagcatgaaatgttcttccatttgcttgtgtcctcttttatttcgttgagcagtggtttgtagttctccttgaagaagtccttcacatcccttgtaagttggattcctaggtattttattctctttgaagcaattgtgaatgggagttcactcatgatttggctctctgtatgttattggtgtgtaagaatgcttgtgatttttgcacattgattttgtatcctgagagtttgctgaagttgcttatcagcttaaggagattttgggctgagacgatgtggttttctaaatataaaatcatgtcatctgcaaacagggacaatttgacttcctcttttcctaattgaataccctttatttctttctcctgcctgattgccctggccagaacttccaacactatattgaataggagtggtgagagagggcatccctgtcttgtgccagttttcaaagggaatgcttccagtttttgcccattcagtatgatattgactgtgggtttgtcctagatagctcttattattttgagatatgtcccatcagtacctagtttattgagagtttttagcacgaagggctgttaaattttgttgaaggctttttctgcatctattgagataatcatgtggtttttgtatttggttctgttcatatgatggattacgtttattgatttgcgtatgttgaaccagccttgcatcccagggatgaagcccacttgatcatggtggataagtttcttgatgtgctgctggattcagtttgcgagtatttcattgaggatttttgcatcgatgttcatcagggatattggtctaaaattccctttttttgttgtgtctctgccaggctttggtatgaggatgatgctggcctcataaaatgagttagggaggattccctcttgttctattgtttggaatagtttcagaaggaatggtaccagctcctctttgtacctctggtagaatttggctgtgaatccgtctggtcctggactctttttggttagtaggctattaattgttgcctcaatttcagagcctgttattggtctatttagggattcgactttttcctcgtttagtcctgggaggatgtatgtgtccaggaatttatccatttcttctaggttttttagttgatttgcatagaggtgtttatagtattctctgatggtagtttgtatttctgtgggatcggtggtgatatcccctttatcattttttattgcatctatttgattcttctctcttttattctttgttagtcttgctagcggtctgtcaattttgttgatcttttcaaaaaaccagctcctggattcattgattttttttttttgaagggtttttttgtgtctttatctccttcagttctgctctgatcttagttatttcttgcattctgctagcttttgaatgtgtttggtcttgcttctctagttcttttaattgtgatgttagggtgtcaattttagatctttcctgctttctcttgtgggcatgtagtgctataaatttccctctacacactgctttaaatgtgtcccagagattctggtatgtttctttgttctcattggtttcaaagaacatctttatttttgcctccatttcgttatgtgtacccagtagtcattcaggagcaggttgttcggtttccatgtagttgagtggttttgagtgagtttcttaatcctgaattctagtttgattgcactgtggtctgagagacagtttgttagaatttcagttcttttacacttgctgaggggtgctttacttgcaactatatggtcagttttgcattaagtgtgatgtggtgctgagaagaatgtatgttctgttgatttggggtggagagttctgtagatgtctactaggtctgcttggtgcagagctgagttcaattcctggatatctttgttaactttctgtctcattgatctgtctaatgttgacagtggggtgttaaagtctcccattattattgtgtgggagtctaagtctctttgtaggtcactaaggacttgctttatgaatctgggtgctcctgtattgggtgcatatacatttaggatagttagctcttgttgaattgatccctttaccattatgtaatggccttctttgtctcttttgatctttgttggtttaaagtctgttttatcagacactaggcttgcaaccccggctttttttttgttttccatttgcttggtagatcttcctccatccctttattatgaagctatgtgtatctctgcacgtgagatgggtcttgtgaatacaggacactgatgaatcttgactctttatccactttgtcagtctgtgtcttttaattggagcatttagcccatttacatttaaggttaataatgttatgtgtaaatttgatcctgtcattatgatgttagctggttattttgctcattagttgatgttagttccttcctagcgtggatggtctttacaatttggcatgtttttgcagtggctggtaccagttgttcctttccatgtttagtgcttccttcaggagctcttttagggcaggcctggtggtgacaaaatctctcagcatttgcttgtctgtaaaggattttatttctcctccacttatgaagcttagtttggctggatatgaaattctgggttgaaaattcttttctttaagaatgttgaatattggcccccattctcttctggcttgtagagtttctgccgagagatccactgttagtctgatgggcttccctttgtgggtaacccgacctttctctctggctgcccttaacattttttccttcatttcaactttggtgaatctgacagttatgtgtcttggagttgcttttctcgaggagtatctttgtggcattctctgtatttcctgaatttgagtgttagcctgccttgctaggttagggaagttctcctggataatatcctgaagagtgttttccaacttggttcctttctccccgtcactttcaggtacaacaatcagacgcagatttggtctttcacatagtcccatatttcttggaggctttgttcatttcttttcactcttttttctctaaacttgtcttctcgcttcatttcattcatttgatcttcagtcactgataccctttcttccacttgatcaaattggctactgaatcttgtgcatgcatcacgtagttcttgtgccatggttttcagctccatcaggtcatttaaggtcttgtctgtactgtttattctagttagccatttgtctaatcttttttgaaggtttttagcttctttgcagtgggttcgaacatcctcctttagcttggagaagtttgttattactgattgtctgaagccgccttctctcaactcgtcaaagtcattctctttcctgctttgttctgttggtggcgaggagctgtgttcttttggaggagaagaggcgctctgatttttagaatcgttagcttttctgctctggtttctccccatctttgtggtttatctacctttggtctttgatgatggtgacgtacaaatggggttttggtgtggatgtcctttctgtttgttagttttccttctaacagtcaggaccctcagctgcaggtctgttgtagtttgctggaggtccactccagaccctgttttcctgggtatcaccagcagaggctacagaacagcaaatattgcagaacggcaaatgttgctgcctgatcctttctctggaagctttgtctcataggggcacccagctgtatgaggtgtcagttggcccctactgggaggtgtctcccagttaggctactcggggttcagggacccacttgaggaggcagtctgtccattctcagatctcaaactccgtgcccagagaaccactactctcttcaaagctgtcagacagggacatttaagtctgcagaagtttttggtgccttttgttcagctatgccctgctgccagaggtggagtctacagaggcaggcaggcctccttgagctgcggtgggctccacccagtttgagcttccaggctgctttgtttacctactcaagcctcagtaatggtggatgccccttccctagcctcgctgccgccttgcagtttgatctcagacttctgtgctagcagtgattgaggctgtgtgggtgttggaccctcctaaccaggcgcgggatataatctcctggtgtgccgtttgctaagactgttggaaaagcgcagtattagggtgggagtgtcccgattttccagatactgtctgtcatggcttcctttagctaggaatgggaattccctgaccccttgtgcttcccagttgaggcgatgccccgccctgcaccgtgggccgcacccactgtccgacaagcccaagtgagttgaacccagtacctcagttggaaatgcagaaatcacccgtcttctgcgttgctcaccctgggagctgtagactggagctgttcctattcggccatcttgcatgagaaatctttttttttttttttttgagacggagtctcactctgttgcccaggctggagtgcagtggcgcaatctcagctcactccaacctccgcctcctgggttcatgccattctccttagcctcctgagtagctgggactacaggcccccaccaccatgcctggctaattttttgtatttttagtagagacggggtttcaccatgttagccaggatggtcttgatctcctgacctcgtgatccgcccgccttggcctccgtaagtgttgggattacaggcgtgagccaccgtgcccggccagtcctgtgcccacttttaaattgggttgcttgtttttgttgttgttgttgttgagttgtaggagttctttatatagtctagatattaatcccttgtcagatacatggtttataaatattttatatcattctgtgggtcacatatttaccttttctggtgctctttatttcttcctgtagatttgagttactatctagtatcatttccttttagcctgaaagagttcctttaattccttgttaggtgcatttgctagctgcaaatactcctagtcagtgttatctatctggacatgagttcatttcactgtcctcattaaaagatagtttggctaaatagagaattcttgggcaatagttttttctattagcacttggaatataccatctcactaccttctgacttccattgtttctgatgagcagttagtaattgttttgttgttcccctgtatgaaataaatcatttctctcttactgctttgacaattttctctggttttgagtttaacagtttgattaaaatgtgtgtgggtatggatttcattgtgtttattctgtgctgaggttcattgaacttctagaatctacataaatgtttttgtaaaatttggaaagttggccattttattgtaacatttttctttgcttctctctctgtttccattttttatggaacttctattatacttaggctagtatacttgatgtctcacagatatctacgactgtctatttttattcattctttttttccgtttttcaaattgaataatttcccttaatctgtcatcaggttcctgattctttcttttgccacttcaaatctcttgagcccacctaatgagtttttcatctcagttattgtgctttttaactccagaacttgctttttttttttttagaatttctctctttattgagattctttattgagtcgtttttactctttgattgattaaacctgatttcctttagctctgtgaacatatttataatagctgccttgaaattgaaatctttgctaagtctaacaactggcccaattgtagatcatatctgttgactgcttttttctggaatatgtatcacacttcctgtttctctgcatatcttacaagtttgctgaggactggacattttagattatacattgtagcagttctggattctgatttcctccctctccaggttgttgcttatttttttttttttttttttttttgtagcttgtctactaaatctgtatgctctgtctttgccatggtatgtggctgctaatgtttctgcttttcgtttgtttgtttttatttttaaccctggcctctcaaggttagcccctgtatcttcgtgatgcagtgaccagtggttggtcagattataagggcaatgggacttgtgtgagtttgggggcatatccaaattttaggcagttttcaagtatactagcttttactttctgccaagctaactcatacctcctctaagtgcgctgtagccacctcgacagcctagagatatgtagagggctagggcactgcccagtttctccgtcctacccacactgccttccaggcagccacggatgcttggagaatttatcaagtgcctccgtgtctgcctcattttctgttaaatttctggttagttcactgcatccaggaccaagcgtcaggctctctaagcttctacccttcctgcttgtttgtcggttttttggttttgttttgtttttgcttttcttgtattctctcaatcaagttagcctcttcctgcaaagctggtagaaccaccatgctgaccaacctggtgggtgagggattgcagccctaggcaggaatgccatgggctaccactgtcctaactcaaaatcagtagctatttttatgaataaattcttaatttgttgtatgcctttggttgatttccagagccctgatcctttttttttttttttttttttttccagttttgtttagtttcctcattgccttttgagatgaggactggccatgctcctcattctgctgtattgtgcttctaaagatagttttcaagtaaccaaggtgagacaggagatcaacaagactcaccagtctgctgatcagaacacgatacaaaaaattagccgggcatggtggcacgtgcctgtaatcccagctactctggaggctgaggcagagaattgcttaaacctggaggggcagaggttgcagtgagctgagattgcaccactgcactccagcctgggtgacagagcgagactccgtctcaaaaagaaaaaaataacagctagaactaggaattataatatatttgcataagatactccaaccagcaccaagacagtttacaaatgatgccatggcaatgatctggaagttaccttatatggttctgggaactccccaccccttttctagaaagtttgtgaataatttagcatataattaagagtgggtataaatacagctatccttgcaggttgctttgggccactctgcctgtgggatggccctgctctgtctatggagcagccatttggctatacgctgttgctctaataaatttggtttctttcactgtcagcttgctcttgaattgtttcttgagcaaagccaagagccctcccagagtttcttgagcaaagccaagaaccccccaattttggggttcaccagcattattaggttttcctcattttcatcaagaatatatttataaaggaagaaaagatttttttgtttgtttgtttgagacagagcctcgctctgtcacccaggctggaatgcagtggcaccatctcagctcattgcaacctctgcctccggggttcaggtgattctctggcctcagcctcctgagtagctgggattacaggcgcccgccaccatgcctagctaatttttgtatttttagtggagatggggtttcaccatgttgcccaggtgggtcttgaacttctgacctcaggtgatctgcccgcctcagcctcccaaagtgttgggattacaggtgtgagccaccatgctcagctgaaagaaatagtttttcaaaatatattactgcatagctcccttaaacattcatatctccaaaaaagagataattataaaattctctgaaatgttcatatttcaaacataagaagggattaaaacaaaaatgttttcttgctaataatcagtcttttaaatgtatctaatcgcttttcaaaattttaaaatttaatactttctaaaaatatgcaacttctgtaattatcagaatcaaggcactaaaatttcttgggaaataggaaaaaatttcattaacaatgttatagtaaaactgagaaccttatttctaataaaaattaaaacattcacttaaaaaggaatattgagccaacgtctacctcactcttgtaataatatagtttcctctatacctttgatgtaggcaaaccccagggttctaccagttttgctgcaagaggaaactgatttgattgagagaacacaagaaaagcacacacatacacacaaatacagcccctgcccagcagcaccattggttacagtgacctgggtgacggacatgcaggaagtctagaagctcagatagcctgaggctgggtcctggctgccgcaaacagaccagcaaactaaccagaaatttaacaggaagtgagacagtcacagaggcacttgataaactctacaagcctccatgacgtgtaattgttatgacatgtaattgtcccaaggtagacttactggctttttctatcggtagagtggtggtggccataggttgcaagcatcctggcctcccagctgccacctggtctagctgtttaaagaagtaagccagtggtctaggattcttcctgaatctttcagttagaacacccaaagctattccttgtttttcagccacataaagattgctggatcaatccattaggaatgcctgttagcaggttctgtctcaatttaaaggctcctgattattcccttttagagcttcatagagtggttttgctatgagcccaaacctgggaatccaaatctggcagaatccagccattttccccacaatgtttttttcttttttttttcttctctttttttgagacggagtctcgcacttttggtccaggctggagtgcagtggcacgatctcggcttactgcaacctccgcctcctgggctcaagcagttctcctgcctcagcctcccaagtagctaggactacagctgcatgccaccatgcccggcaaatttttttttgtattttagtagagatggggtttcactgtgttgtccaggctggcctcgaactcctgagctcaggcagttcacctgcctctgcctcccaaagtgctgggattacaggcatgagccactatgcctgccctcctcgcctcaaaaaaattcctaattgtttcttagtttcaaggggctggagtgccagaatgaattcttttcattcctgggctaagtccttgtcccaagggtgagaatgtatcccatgtatttaactttttgaacagaaatttgggcctcgttgggggggtatactcaataccctcatttccccacaaaattaaggacctgtattgtatttttttcagagtcctccctagtaacgctgaaaattaatatggtcattcacatgttgtaggaaggatccatttattaagctgtagttaccttatttcttttgccaatgcattttcaaataaatgaggattatccctaaaaccttgagggaggacagtccaggtaaactgaaatgtagcaagagtgtctgcattagtccattcaaaagcaaaagtatactggaaatatagtgggagtctgggtgcaaatgtgtgctaaagaaagtaccccttaagtctaataccacgaatcagttatcattttcaggggtcaatattgtgtaagaattaggagctattggagctattaggagctagtaggagtccttgtataaggactgggagtactgcttcattaactgccctcagttcctaaattaatctctgttccccatttgatttacttatgggcaaaatagggatgttacgtgggtactgacagggccagttagtactttaaagtctatactttaaaagctttactgtcatgggttgtgggccccattgtgtttctggtctcaaaaattattgtttttttccgtggtaaccaacattgagttttaaacaaaactggactggggttacattagcagctctaccgggaacttccatgtctgaaacagaggactacttgagaagtgatatgcagtggaagagaggtcttttctttacctgtatgaaggcaagcacttagagctagaagtagtattcctgcctggcctattgcatttttatgaggctctcctaattgaactgtggcctgtaagtgggaacataagtctcttcccagtaaaggaataggacacttaggcataagcaagaacctgtggaaaaatgtgtggtcccgcatggtacaaccaaaggagtatgtgaatctcctaatttttggctggttgtcaatcccagttatggtacaagactgtaaagacagtatccctgagaaatgggtcagcactgagaaggctgctcccttgtctagtaagaactcagtatccttgcctgctacatcaagggctatctgaggctcctctgtggagatggtaaggtgtcattgggagctctggggaaccttggggcctatcagtcctctattctcttggccattatgggtttgggtggcctttggagcctggggtagtcccttttccagtggccctcttagtgacagtaggcacactgattctggttacaggaccagcaagtcaggggctcttgtctgggcattccagacactgatcttgcaacacttcctcgagatggataaccctgaggcagaagagtgcttaaggcagttgtgaacgattgtactttttggctatttcttttgtgtgtgttttttctgcctgctttgcctgtccctatttttgtaaactccaaaggccatgtttaagagttagctcatggggggttgaggtcctatttttgcctattgtagcttcctcctaatgtcaggagcagattgagtgataaaatgcataccagggatagctcaccctttcggggaatctgggtctacattagtgtatttcctgagtgcctcaaccaaacagccctggaacagagagggattttattcttctcctgagttacttctctaaccttgtcataatttactagcctaaccacacacttttccataccttttgttaaacaagttgccacgtgatttctgcatttaaggtcttgggaacccctctggtaatcccactgaaggtctggatctggaactgcatcgcaccccacaagaaaaatggctcggccttggttatgagtggccactccatctacatattcatggacagtacccagaatcatttgtttatcctctaccatacatcagatggacaataatatttgcaactcatgtcaagttaagtcgaaagacttggccaacttaataaactcctatataaacttctctggatcctccaaaaactgaccaaatttctcctttgcataaagccaaatcacacatagaaaaaggtacatgtttgtggactctccctccatctccatcagctacctcctgcaagggatgcaggtttgatttggggggctgatgtgaggtcccactcctggtggcactggttggattcacttccttgggcagtcgggggtataggctgaggctagctgtaaaagccggaggggtgtttggtgactttgggggtagaatcttacactggagacctggcaggacccccctcagaatcaagggaccgagggggctcccaggggagagagtgtggcccttctaggtggagtggctagaaggagataatctaggatatctggtgtggcttcttggtgcctggaagtaacatgagctagacacatcctacagttgtcccttaagtcaagatcctgataaaatgccataaaagcctgcacataaggggcctctcctcatttttcctcctttttacagaataagtccaattgtaaaatagtatcataatgtaaagaaccatttttaggttgggtgcggtggctcacgcctgtaatcccatcattttgggaggccgaggtgggtggatcacctgaggtcaggagttcgagaccagcctggccaacatggtgaaaccccgtctctactaaacatacaaaaattagccaggcatggtggtgggcacctgtaatcccagctactcgggaggctgaggcaggagaatcacttgaacctgggaggtggaggttgtagtgagccgacatggcgccattgcgctccagcctgggcgacagagtgagactccatctcaaaaaaaaaaagccatttttaggccaaatttcttggtttcccaatttgtattggacccaagtggtgttgctaaactaaagaaaattagtttctttttaagcgatttaatttgactttgcttcagttgcctaaaaagcaccctagcaatgagtcctctgggatgcttcccgttgtccccctaacagggatctctgctagacagtagtacaaatgccatcaattcctgagagcctaagtacagttagggtgtgaagaaactcaattatgaggtatgaatgggtagtgaagtgatcactctatccagcagcaagcagaatatgacaaaagaggtgttttttttaagacagagtctcgctctgtcaccaggctggagtgcagtggtgcgatcttggctcactgtagcctctgcctcctgggttcaagcaattctccggcctcagcctcctgagtagctgggactataggtgcgcgccaccatgcccagctaatttttgtattcttagtagagacggggttttaccacgttggccaggatggtctccatctcttgacctcgggatctgcctgccttggcctcccaaagtgttgggattacaggcgtgagatgctgtgcccggccaagagatgttttaataagcaaagtgtagaaggataggtaaagtagggtgacaggattctcatagtctgaattccaaaaaaagcacagaaagaggaggctgaaaatgatcagtatgacaaagaccaacaaccctaacagggtgccaaatgctgaaaaacctggaacatgaaatgccaaaaaacccagagcatccaggagttggcccatcatgaaccccaaaggcacgagacctaacacagttggggccactggacaacgtgactctggcatcccaaagttagcacaacagaggacttctgaaaattaccaaaagaggattcaaaacagactaggaaagtgtcccgacttacatagaatagaaacagttgctcagatagccaaagcaaagacaacagatgtgaaagaaaacaaaataagcattagaataaaacagccatttattagagactaaagagacaaaaagatttgagagaaagcgtgacaaggacatggcaggcgtgctcctgtctgggacacccaaatgataggggataatgaactaccaagccagaggccttgttccctcttcttggttcacccaaaaagatcaatgtcaagggggaacagaggggagactcacctgtccttcgaagccatatggtgttgattggtcttaaattggcatctgggtgaaggtttccctcagttttgcttagattattagtcaccaggaatgatgattggctctaaaaagagcctttggctcctgtacagctctacagccttatagagttagagctccatagtgttatagctccagagccccaatttttactgagcccctttgtcatgttcatcttgttcagtgttgtttattccttcatggttgccaggctgatacaagtgaaccccagaattggggctcaccctgggagagttcttggctttgctcaggaaacaattcaagaaaagcaagttcttacagcaacagtgtccagccaaatgactgctccatagacagagcagagctatcccagagcagagtgggcagagtggctcatagcagcccttgtggattgctggctagctatatttatacccacttttaattacatgctaaataaggggtgagttattcatgaactttctagaaaaggggtgaggagttcccagaaccatgtaaggtaacctccaggtcattgctgtggcatcatttgtaaactgttgtggtgctggtgggaatgtcttatgcaaatgaactataattcctagtcctagctggtttgggctggtctctttactacatcatagtttttgtttttgttttcattttgtttttttaagagacaggttttcactttgttgcccaggctggtgtgcagtgacatgatcttggctcactgcagccttgacctcctgggctcaagcagtcttcccacctcaggctcccaagtagctgggactacaggcaggcaccaccacactcagctaattttttttttttttttttaagagatgaggtctcactatgttgcctagactggtctcaaacacctggactcaagcagtccttccacctcagcctcctaaattgtggaactacagacatgagccactgtgcttggcctacattctgttttgatcagcagtgtcatgaaaacaagccctgttaatctcctatcttactagcaaggtgaagaaatagaaaaataagaatatcataatcatactaccgaggaatagctaccatacaaactttggtgtctatcctaccagaattttttcatggatattttctgtaggttcaaactatgcatctatattgaaactctcttaaaaaaaatagtaaaagttggtgaacaatttccaatgtcattagatactcctgtaaaacataatttttaggaggggcagagcaagatgactgaatagaagcctcaaccagttgttcctcccccaccccacggaaggacattattgaacaactatccaaaagaaacaccttcataagaaccaaaatcaggtgagcactcacagtacctgttttaactctatagaactgaaatggccactgaggagggtaggagacagtcttgggttaccagcaccacccctccaccatcctccagcagtggccgcatggtgcagagagataatccatgtgcttgggagacagagagagtgtagcagttgtgagacattatatcgcactcagtaatgccctgtcacagcaagaagcaaaagcaaactaactcagctgatgcctgcccacagaaggaatatttaaaccagccctagctagaggagaattgcccatcccaacagttggaaagttccggcaagcctcaccaccttgggctaaagtgctctggggccgtaaataaacttgaaaaacagtctaggccacaaagacttgaactcctaggcaaatcctagtgctgatgtgggctcagagccattggactggagaggcacgcgagttactgagacactgggatggctaagggaatgctggcatcaccctttccacaaccccaggcttcatagcttgcagctccaattgagacccttttcttctgcttgaagagaggagagggaaaagtaaagaggactttgtcttgcatctttgatgccagctcagccacagtagggtagggtggtacccgttagagccacgaggccctcttcccaggccctcattcctggacgatacttctagacatacccagggccagaagggaacctactgccttgaagggaaggacccagtactggcaggacccatcacctgcagactaaagagctttgggccctgaataaccagcagcaatactcaggtagtacactgtggaccttgggtgagtctttgagacttgctggcttcaggtgagactttacacattaccagctgtggtggctacagggagagacttccttttgcttgcgaaaagcagagggaaaagtaaaggggactggatcttgcaccttaggtactagctcagccacagaggggtagaggactaagtgggcttttggggtccccaattctaggacttgactcattgatgacttttctggacttgccctaggccagaggggagcccactgcccaaagggagcatcccacgctaggcacccttcatcataagcgactgaagagccctccctaagggaacatcagcagtagcctggcagtacgccccataggtctatagtggtggtggccacagggtgaggttcctctgcttaaggaaaggggagagaagagtgggaaggactgtctcagtgccagctcagccacagtacagtagaacaccaagtagacttctaagatttttgactgtagtccctggcttgctgatggcacctctggatctgcctggggcttgggagctcgccaccatgaagggaaggacacaagcctggctgacttcacttcctgctgattgtagagccccagggccttgagtgaacataggccatagccaggtggtagtcacagcaggccttgggtgagatcccagtgccagcttctggtctgaccaagtgcagtcccagtggtggtggtcacatctccaggcagctcaaaacacagagagagtctctgtgtttgtttgggagaaaataggggaagagaacaagagtctctgcctggtaatccagatagttcttccagatcttatctaaaacataatttttaaatgactacatagatatcagtagtatatatgaatatttattttaatttttttgttgggaatttagatatctctttttaaactgtcatttattcagatcaaattacttgatgagcacttacggaattgggcatgaagaatttcaagacttttaataacatttctaaactgacccctctgttcccacttccacccccaatttagaatttcaccagtagtatgtaaaaaagtctattctaaactctgcatcctggccaggtgaggtggctcatgccagtaatcgtagcatgtttggaggtcaaggcaggaggattgcttgagccgaggaattcatgaccagcctaagcaatatagcaagagcctcctctaccaaaaaaaaaaaaaaaaaaaaaaaagccaggaacagtcgtgtgctcctgtagtcctagttacttgggaggctaaggcaggaggacagcctgagcccaggagtttgaggctgcagtgagctatgattgcaccattgcactccaccctgggtgacagagcaagactgtgtctctaaaaaaaaaaaaaaaaaaaaaaaaaagaaccaaaaaccaaactaggcatcctctctaattaatactgacttttatcaagaaacaagtaagtttgctaatttaatagacttaaaatgcttaattattagtttatatttcttgtctgttattgtctttatatcacatcatttttctttttaatttaaaggttcatttaaatttatcatttatcatctcacaaatcttgatttaagtcttgatctgaagaaatgaaagttaaaaaagaagaaatctaaatttccaacaaaaaaacacaaattaaaataaatatccatatattattactgattcctatgcagccacttaaaaattgttttacaggagtacctaataatataggaaaatgtttaccaaatcttatttttatttttttaaagcagactttataagacaaatgtgtagtttgaactcacagaaaataacgcgtgaaaaaaaggctgatgagttcccctttacaaaatggaaatggaacttttcaagaagaaatgcttattacgttttttacatggatttatttcttttgcctttaattaatgaaaaaaaccagtctgaattgtattgttttgtaaatatgtgttctatattttgaatctttggatattgatttgcattgctgtatcacaatttgcttatatttaatagcatcaataatttttttagacttctgataatcagtagagaggcttgattgaaatatgttcccctaaagcccatatttgatagttttattactaaatttagaagccagtaattaaactattttcttataattatggctatattttagttcaaattgctcatcctaaagccatcaggtcaaatgatacttgttctgaaaatatattaataaattgggaaggattccgtaatatttctgttcctataattctctgatacgtgtatgctaggcagcattcatctcaaaaacagtaaataaaactactcagaagctttaagtaactttagctttactatatctgaaagacaaaattgtattctggtaaatgtagctatatcattcattatcagttagtatttatatttagatgaatgtgattcaaggtctcaggccaaaataaatgccaagagatgatcgtattatctaaacaattagagcattggcacaaattcttgggaagctgttgactttttaaccaaagtgttaggattctgtttttatttcaccttggcattttaatttcttaaaattcataatgttcatcaactgcaatgcttagaaatccttaccagaccattttcagcaaagtacaaatatagtttctattacagttctgtcctctagtacaagttgatccacttactctctgctgcttgatagttctagagaacagcattgaggaattctgatgattagtcgcaaacaacattgactttaaaaaatggatagtttcccaaacatattatcctccgaattattcttctcgctctttttattatatctgtttatcttattcttagtcatttgtgaggttttattttttgtcttaaagaaaatttactttaaatagagaatttgtaaaataccgtggattacatgcacctgtcttttcttgggttagtcttgtatctttatctaaggaacactgggagctagaggggaccactgttccattgtgaaagagtgaaggtttgtatggtgtttcctctattgtcagaatcgcacgggctactcatgatgtatgaacagtagaattaagtagaatatttgagcctatcctgttctggactcatcctcttagaaacgttctttgttgataggattcctttgataaaccgattgaatgctctgtcctcttaattgtgccatgctataaataagtcagttattaaaagaaatggttgatgttttatagactgaatgcatacttgtagagcatgttgtagaaagatactttattgaggttagttccagtgattgagtacacatacttaagtttttaactctttggaacccaagagtagaataaaaaattatttacaaaacgtatgtgggttctgacatagggtattgtttttcctttggaggcatttttgaagaaaaaaaaattacacattacaaaaaccagattaaagagtttggcatgtacagctgtgtgtgtgtgtgtgtgtgtgtgtgtgtgtgtgtgtgtgtgtgtgtgtgtgtttgagactaagtcttgctctgttgcccaggctggagtgcagtggcaccatctcggctcactgcaacctccgcttcctgggttcaagtgattcttgtgccttagcctcctaagtagctgggattacaggcacgcaccaccatgcccggttaatttttttttttttttttttttcttggagagggcatttcgccatattggccaggctggtcttgaactcctgactttaggtgatacacctgccttggcctcctaaagtgctgggattactgacgtgagccaccatgcctggccagcatgtacagttttaataagaggaaaataccaaatgaagagcaaatttttatttgtttgaaggtctcaattgctgcttatttatgtatttcagcaatacccttcccaatagtgtcctgaacttgatgtttacttgtggggtgtgaatgttaattaattatacagtcccttaaagagtagtggtatacatgtaaaggaaaatctttttagaaacataaaaacataaaaaggaattagtaaatttggagttttattctaaatactgctgttaaagggctacaaaaaataatgggcttataatgaatcatggcaatttagtcaaatatttaaaatatctaaaatgtttatgagacagcagaatattttatagtagaagtaataggaaaaaaattttacagaaattttttaggaatagtaattacatgtctgggatggtttagaacctacctaaataaaggtaaaaaatacagttttatagagaactagaaagtggtttgtgaatggctaattcttaaagctccattgataaccttggggagaggcagaacatcctagattaaatagaaattgtgtttctgttatttcatcaagacagggttatacagttaagtatcttggctaaaatctttatagtaaaattttgctgacatgaacatcgctggtctgggaattaaatattcacttaagtactatttcatgaacagtgccagaatttctgccagaaaggtaaaagatatatttatattgcgttttttatagctgaaatgtagcctgtaaccgagtggattatagtaacttaatattttgatgcaggaagtaggaaaatattaaaaattgaaaggtggttttaaggaaattgtaatggttctgttcagagtttatgagacagccttattctgtagacttttaaattatgaacttcccacctatttttatgtaaatggtgatgtcagtttcagcctttcctccatttgccttaagccagagaaagagagagggagagagagaataagagagagagaaacaccttgtgttggggccatcaaatggtttttttgatagtcatcagtggtattcacaaaattctggttttcttgccttctgaggttgtagtaacacttgcacttccccatcttgctgaagttaggactgaccatataacttgtctaatgcaatgtgatatatattccttattggcagaagagacatctgtcacttctaggcagaagctttagggactggtggccttccaaattgcagaggctccattagcctgcagccttcagtaaggaagtggaaccaagtactcactctcctgaggtggacatattatgtgaccaagaaatacactcatgttattttgagtcactgagattatggcagtgtttgtaactgttgtgtaagccagtctaatctgacatatgcagtatgcaatttctttatgcctaaggttaaggaagaagataataacgtttctcaccgactaaagtgaccatttatttcttcggtcatttttgttaacatttactgtgtgccagtcactgttctaggtgctaggaaaatagagggaacaaaacaaagcaatctcttcttcccactctttgttaattctttagggaacctcctttgctgtgaagcctttccctgccctctgagctaccggttgctcctttctcgtctgtgttcctccggcactttgtagatatcgtcattgtggcactgatgttatcatgatcattctatttctgtcttgatttctagactgtttctataaatgttttaaatatagtacatatataatattgaaagtaatataaaatgtgtaggcaaaacaagttacacattatataaaatgtataacagaagaatatgtatacatacacatagatgctttgcattatccctttattccctttatgtcatcccccacatttcaaaaaaatattttttgaatgaataaataaggcttcctgtgggtcttttaggcaaatgtgatttgggaacaaaatgtgaacttctatattttgggcatgttcttccaatgcctttgctctgtgaattcaaatttaagagcattactaatggatgagaacaggtctataccaaattacctgggcagaaatgtgaatgaacaggggcgggggaagcctattaacttgtcattgtgcctcttccctttacttagctatatatatacatatatatatatacacacatatatatatatgtgtgtgtgtgtatatatatgtgtatatgtatgtgtgtatatatatgtgtgtgtgtgtgtatatatatatatatgtgtatatatataattgttatacccttttaccagtgtttctcaatcttttttccattatcatcccctacccccagtctttttggactgttgccccctaaatgcccccaatgagattttactgccacagaaataccgtatatctgtttatgtattgaacgtatatctgtgctttataaaaaaatacagtaagtctttttgccccctaagaacgagttttcttggttgatgcatgccttcaactaatatttgaaaaaggtaatttttttttcctttgtaggagggcgtttccccttcaataagctaagtttaactctactgagtcacaactctgttatttaatacacctgtgcttttgtaacagctttattttaagctaattattatttaaataagtatgctaaaatcttagtttattgagaacattggcaaattaacttttatatattttatggaagtcaatttttctagattgaaggcctctaaaccacgcattctgtgcaaactgtatttgccttttattccttcagcatatacttactgagcgtctagagtgtgcaagactctgccagagctgaggacccagtgaatcgtggagttcagtctgcttcctttaactccttgctagccaggatgcgaatatgggtcatgtatacttgtctagtgcagagtcgttttgaccatactgatttttaaaacatcaacaacaaaatgttgtgggcttttagtgaaaaatcctggaagttgaataatccctcatctatcattctttatgtatagcacatgaaaaggttgagggccaagtcccacaatatgcgaagtcagtatagttggtattttcctgttctgtcctgcaagttgtgaccattgtctggctacaccagtgcacattactctatctgcaatgtgggaatctgcttaaattcttgggccattctgtataaccagtgtagtatatacatatatgcacaacaaaacagggaaacctcaatataagattcacttaaagaataagattctggttctcaccactgttgaattgccaaacaaaaaggatgaagtatatagtttcaagctaaatttcagattgcgtaggaggcatggggcaaatatgtttcagaaagaacacaagggagtacaggttatctggaggctttggtttgagtgcccatccagagatagagccattcattcatttatttgttacagaaatatttactgacctcctaatctttgtgccaggaattttggtgagtaagacaaaaggctctcattttcactcatcctctctgtccccatttcttggacaaattgtgtaggacattttaacattgagcaagttttcattcattcattcattcattcattcattcaatgtgtgtttgagtgtgtataatacaagtacattattgtgagatatttaaaaaagacatctctgccctcaaggaccttgcaagcttgtttgttcatcaaccagtcatttatttaaaaaaaaaaaaagcattgagctagtaggcaatgtgccaagtcagtgctagggaaatacagagatgaacaagagcacacagtcggttcctggagggctgcgtctcagcctggagaggcaaacagcttgtaacatctttggaagcatgcagtgtggtaaatgacaataatgagctcgtcccactgtattgcgagagtgcaaaggatgagcacagaagtggagtttccagaattagttctgtgtgggtgaaaggtcaagatgtgactctccatctgactttttagttgaggctggagagaagggttggcttggaaaggagattggagggagttcaatcagaagaaacagtttaagtgttgataaggagctttataaggcacgatgacagctttacagaactgcaaatactttattttgatttggctgcagaaggtgggggtagatgaattctaatgtagtgaaacaattgcaacaggaatgccaagaactaagtccttgtagtactggcacaatgtatagttcagtgaaacagcccagaaacagacaaacacactatgtgataaagtgggtatcacaaatcaacagggtgttaagtaataatattgagacaattgataaactctttggaaaaatagtagattcttactccagatgatttttaattaggacttaggggctaggcacttagaaatttgagaattaggattgatttctgtgaattaaaatttaagatcaacagtaatggatcagagggtgggggtgtgtgtatgtgtaaaacaagttaatcttaaccaaatatcttgcctactgcctactgcctactgcaccacctcgttgaatgtgtcaatcctgtgaacatggccagcttcatgggccctgcactcacgagggccgtgcatttggtttaatgctctgctcttgttgtcctttggaaagtcttaatttttgaagatggggcccatatatggtggtttttgtttcgttttgttttgttttgtttttgcactgggccatacaaattatgtagcattcctgcctatgaagttggccatctctggggacagaaagttagagagccaagctttagaagtagatatccttgtgttctctggagagtcgcagccaacccagttaaagtgtcccagacacattggcagggccatccctattgagtgcctcaggctatccagcctgattccctgaaacattcaatttatttaacaaagtttcctacttcccatttcctgctcaccaagcaatctttcaatagtgacttggctgcttctttggttttccagcagggagagatctagctagttgtgctggtcccatccttcattcaggaaggtagttactaaattggcaatctggtttcatatgtcagtgaggttctttaatgtgagcctgcttctgcatgactggtccattcctgttacgtttctgagactgaaggctgaagtccaggaattacgcgggtaaattcaccaaagcagtcatgtgtagaatagtggttaagagcaagagctttggagtcaagacacacaatcctggataaaacgtgggtcctgtcacttactaggatgtatgtatgatcttggctttcctgtgccctagtctttcatctgtcaagtgatgacattaacacctaccttaaggttgttgtgaggttgaatgagatgatgtactttagatcagggtttctcagcctcggtactgttgacattttgggccaggtaattctttctgttcagggcggggtgttcggtgcatcatagaatgcttccagcatccctggcctgtacccagtagatgctagtggcatccctctaaccccctatagttgtgacaattaaaatgtcacagaggtggaatcacctctggttagtacttggttaagagtcactggttaagagtctcttggttaagagtcactggttcaggtgtttagagtggtgcctgggggaaagaaaatgttttatgatataataataataatgggaatagtggtaccaaagatgatactacttttgatgccaccctgagggacctaggaagacattcgtcagcctttcatttattctttgtccttaaatttttatatctatgccagaataaactccatgtagattaaatagtacatgtaaaaagctctacctttaaacaactgaatgaaaaagaagtaaatcttcagatttgcaaataaggaaagggttttcaaggtcaaaagcagtgatacttctgtgatgtttaatgttgggtttaaaacacattggggaattttctttcctcatagatatcatgacattaaaaataaatatgcataatctataaaaactttgtagttacaattgaaaagcaaattggataaaatgattgtgagtaatatgacagataaagtggtatgaaaaaactaatttaagtcaaaaagaaaaccaaatatttcctatagataaggacaaaggaggaaatacaaccatcctataaacatttgctatggcttaaaatctttgtcaatttaaataaataatttaaaatttttttaaatattattaaattcaaactatttaataattttttaaaaaattttaaattatttatttaaattgacaaagattttaagcaatagcatccaattctgttgtacagttaggggggtcttattacatattttttgtcggacaatcgataggtacaatccttctagaaagaaacatggtgataaatgtgccctaaaaatggtcatacaatttagcccctgcaaataactttgggaataatgcttacagcataatctgaaatatagacaaatatcgatgcatgaaggtgtttactgcaaagttgttttaatataagccagctaaatgttcagtattagagaaatagttatttacggcatataataatctgcaatccttaaatgataatctttacacagtgtttctaatgacatgcaaaattcttacagtgttaaatgaaaaaagtaggtttttaagttgcatatgcaatgtaaactcaacccagaaaaaagactggaaggaaatacccaaaacgttaatatttgtcgctgaagtacgcaaaatgttaatatttgttccataatatttagattatggataatttgtgaaagttagtcacaactatatgattaaattcatcatttcatggcagacagccttttcttttgtttctgttcctttaggtaatgtttagatatcatgccttggaaatgaaaatgaaaaggtttaagctatgtttctctaaataggagaaataaaaaagaaagtgtcaatgccctaaaatacagctttatttttaagtaaattataaattgcaatatgaaaccaattttggggggtagactgcttctcctggttgaggtgaattaatggttttttataccgtggtactctttttgttcattaagtgttaacgatgtactcattgtagtatggtttttgatgaaacaatctttaagatgttcatttttgtttttatagtatgtgcagaagcttataatcctgatgaagaagaagatgatgcagagtccagggtatgtaatttactgaatgaatgaattttaaattgatgcccttgtcatatataaggaaaataatcatagaaaagatttaacaggcatgtaggttaacaggagacataatggaattattttgactgtttcttttcctagtctcatctccaatagcctactcctgctgtgagtcttgcagaattatttttatccagagagtatttctctttacaaaatgtatcctggtgatgaaaagtgttttcagctgtctttctcatagtgataatattatttttcttagacagtgtttctagtaaacaaaaatactgggaaagaccttctacgcctattaatttataacaacggaaagttactctgaaacaaacaaatcacggtaaaatcacatccagtgtgtcagtacagcagttaggattattttttaaatctgtgagtcttcatagtttgctcagcagctgacttcttgcaggccctaatgtttttgtaagaatttgtccactgtgatttcagcagtttttaagctatgtctttcagctcagttctactatttatttagtaaaaagtaaactaaaagatgactatgcctggaaatggaaagtagtaatttctgcgtcaccctccccccctttttttgagtacatgtgttgcaaaagtgcctcttgtttctttggccttaaacagtataaacaaaaacttatttttgtagctctgaaaagtacataagtaagattgaggtttcatgtggagaagcagctactacgtccctaagtcgttacatcattaagctccttgaaacttatgtaaaatccagtggtatcaggaggcttacaacgtggaagatcttgaaatctcattttattcctggacccatggggattcccactaccagggttgtggaagctcatttctcactattagaacttcagttcttttcatgaagtttataaatcctagcctggaaatgatgttgttttaggattaaggtatttttactaatctgtgatgtgctgttacccctctgtatagtctgaaaaactagaccttgcctaccgtatactttatgtatctagcagaaacaataccgggtggcaatgaagacaacatgcttctttatatttgtgtataaatgagtatgataaaatttagtaattgagatcagagcaatcgagatgagctggtttaaattaataaaaacctaaattaatgaacatttgcaatacagtttaaaaacaatatgcagtatctcattgattcaaaagctgttaggccttgaattttagctgccatttaattgatgaggtaaataaagtgttttggcaggttcactccagctaatttctaatagttttgttggggaggctataccagttaagattcatttgactgtgtaaaacctcaccctatggagacaaatgtgaaaaagaaaacactggggagagattatcagacaaatgcttggagatcatattgaactgcagaaagcgttcaaaggccaagctgtaggcctggcaggcaggagccagcccgcctctggtgtccatcaagagcaagagtgtaagacttagcgtagtgtctttgaaacgggttcagctacccatctctattactgtgtctctcagttcaaaattccaatttccaaagagtttctgatggacccagctttggcccagggtagggccagggtcaaaaagtccaacctacttgggaaccacttctgtaaataagggcagttactagaggaggaggaatctttgtggggtgtgtatttaccctaagatctgtcccctgtaacaccttttaaagttatatttaatagtttttttgttaatgtattatatgtttgattatagcaaagtacttttaggttatcaattaggttgagtattctctcctctaaatgtgttactaaaaactatacttactttagtctcaacaactatgaagcaaaccataccacatgcttgggaatgattattacagatttcaaaattatttagatgtagaaggatattgggaaatatctatgaggaaaatgtatactatattgtgataaaattacatttcatttggacattttgtattacttctgagactcaccaaatcagtaagtctgtagtataaacagaaatttatcgtctgatatgaattcaaagaaaatgtaaatacttaagactcattttggaaaataacagattttagttggaatgcctttaataaatgaaaatgtaagggttatctagatctagcatgtagaaactggtagagaagagctaataagggtagagtatttcttatgtttctccacaaaaattttttggagttccacctgtatatctggcctggtgctaggtgtaaagtggtgagcaaatggacaagtctctgccctcttggagcttacagtctagtggcagaagcagacaagtgaataaattagtgaaaagttaaaaaacatgaagtgctaaagaaacagtgaaacagtgtaggaatcaaaacacagcccccaagcctctgggtcaagtgattctcatgcctcagcctcccgagtagctgggactacaggcatgcaccaccacatacctggctaatttctgtatttttagtagagatggggtttcgccctgttggccaggctggtcttgaactcctggcctcaagtgatccactcaccttggcctcccaaactgttaggattactggcgtgagccactgtgcctgaccgatatacagtgttctttaaagaaaatgtctaagttaaaaccttacttgttaactgtttttctaattttttttttttaatggaaaggcagcagaaatttagagcagaagttggcaaactttttttggtaaatttttttttaactgaaaaatgcactattttcagagagtaaatattttaggctttggggagtcatggggtctcctttgcaactactcagttctgctatagtagcttgaaagcagctgtaggtaatacatcaatgaaaggcatgtctgttgggttacattaaaactttatgacgcttgaatttgaatttaatatagattttatgtgtcaggaaatattatcatttgtttgattttttttcccccagtcattaaaaaaatgtaaaattattcttagcctagaggccatacatacaaaaacagctttgcctgcaggtgtagtttgctgatccctggtttagaatatagactctgtagctggcctggctggcatgaattctggctctgcaccttgtggactggatgacattggacaagtgatttgggcaagttgatttccttaactctaaatttcttaacctgcttcatgggatctgtcactaggataaaatgagttaatattagtaaagcccttagaatagtacctggcatgtatttatgctatgtttgtttaacaaataaaatttttatctgaaatcaggaatgaattttaatgaaaaccaaagtggcctctagtacactaaaatcacactttgggtgtattgctgaggcctcagtgatccagagagagatcccttaggtgggatcatgctaagccccagaggaaaaatgtaggagagcatcttcagagcaggtggctgcagtacagaggagctggagtgtcagagaccacacccgctttctggctgtttactttccccagtgaagagggattttaccgacgaggttaattacagagagtggactctgagtgctgaggagtaatggcagggtgagggaaaagggaaacaggaggagagcagtagaccatagtgatggaggtggggctgagaaaaaaaatactacttagaaatggtgattgggctgggtgcagcggctcatgcctgtaatcttagcagtttgggaggccaaggcgggtggatcatgaggtcaggagtttgagaccagcctggccaagatggtgaaaccctgtctctaataaaaatacaaaaattagctgggcacagtggcaggcacttgtaatcccagctactcaggaggctgaggcaggagagtcgcttgaacccaggaggcaaaggttgtagggaaccgagtgcaccaccactgcactttagcctgggtgacagagcaagactgtgtcttaaaaaaaaaaaaaaaaaaaaaagaggccaggcgcgctggctcacgcctgtaatcccagtactttgggaggctgaactgggcaaatcacgaggtcaggacatcaagaccatcctggctaacatggtgaaaacccgtctctactaaaaatacaaaatacaaaatacaaaaaaaaaaaaaaaaaaccaaagccaggcgtggtggcaggcacctgtagtcccagctactcaggaggctgaggcaggagaatggcgtgaacccgggaggcggagattgcagtgagctgagatcgcaccactacactccagcctgggcaacagagtgagaatctgtctcaaaaaaaaaaaaaaaaaaaaaaagtcgtcattggtacgagaggtagcaggaagaagagagaagaggaaaaagctggatttctgtgtgaaggcttataggaattgaatgggttggagagaaagacataaagttgaccagagcgaagcaggtgcacgatactgatgcctgatgcactctcctctcccccctttcctttctgagaacagcttctcagcaggcagacatctcggttgctttggtttgaagttctagatggattttgtgaagtgagaaatgactttctgttttgttttagtgtgttagccttccttatttgaagtaggaggaagtgaagtttggttggtgtggtttggttaatacctgaattttaaaggtttcttatgcagcagtgaatgagaagtccctgggatctactttgtctgtgtttgtgtgtcatcttagaatctagtttgagatgaatattgggcagatagtaaacaaaggtttacatctaccttacccttagaggggaaagtgcagtgaccctttctcttactagctagtagttctttcatgtagtctttacataatgcaaataaatggtatatatatcaatagtttacatataaatagtttagcaatactataagtttccccaattcttttcaggcttataattttcattaatttttagccatctgatgtggtttgaaatgctgatttaaatttcccattgtgagttttgatgtttgtggctataaactccactgctgcctgattctgtgagctctgatgctctgatggtagggcaggctgcctgaagaggcaaggtacctgcccatcagctcttgtggtcactctttgagtgagcattggaataggaaagggtggtgtgtaggtcttcaggaaaaccaactccgtgtctgctgcttttaggactaccccttgcccctctaactcattttatagttacaaactgttcatgttcacaaaagagtggaccttttggtccaagtcagttgagcctcctgctagtgaaaagggactcgagagatagcaagccacacttacacacacggcattctgccactcttcacactctagaatacaagtttagtgagaatatagcacactagtttccttgagttccttctgaaatcagtgcaccagccagcctccttggactctttttccctggaacacatattctcttggagtggcagtgcatgattgtttgctcccttctaaaaatcacttgctcgctgtggggcaggtacataccacatgtgtaaaaatatattcggcatctaatgccatatacatttaaacattttacttctttccagggaccttatcaagattcaaaagaaagaattacatcctgaaagagtattaaactcagtagaaacagaatgacagcagtccaaattttcagtgtagctgctggcacctgttgtccttttgtacgggtccccactggctgggagctttggaatcttcctagccagtcacagttgtgtgcataatgaacttgctaacctaggggaaaatatgcttttgaaaaacatttcagtgctatattgatgaatggataccaacctcccccgaacaaggtgaattatgttcccctacttggtaggctcataagttaccagtcaccaaaagtgaatctcagcaccaacctgaagcaaacttgagcgctaacagttcttctttctaatgttggttctgatttttgttagtttttaaaatctctttgagtgagatggtattggctaatgtctttgttttttaaatctgatgtccttttagattatacatccaaaaactgatgatcaaagaaataggttgcaagaggcttgcaaagacatcctgctgtttaagaatctggatccggtaagataaatcttaataatagaaatggctttgttttttcccccagtgacagtgtcaagaactgtacagggtcttgagttttgccctctttgtaagctgatcaccctggggtgatggtaaaggcccccttgcggatgcttgaatgcacagtaggttgaactgcaggagaggaatattgagtttgggggaatatactgctgttggagcaagaagtaaagaagcctgaggtgtttgtcctgtggaagatattctctcatctctcaagatgttatctcagggctacaaaaacagccctgagaaatggcacaggtaaaaagatggtaggaacttgccctcttcgtacccatcaggaatatgcagggatgctcagggcccatggaggattgtttctctttacagccagtggtagtaattatatttgaatgtgtataaactcattatctgtgtattatacagattaaaagtaatatttcacttggctttaaggtgaggttttttttttttttttttggtcctttataaggatttggaaatctctaatttttgggttcggtatttctagaatacccactcttggtatgagtgcacgtgctgttcagactttgtcttgcactgtgatgtacatattctgcttccttcatctcagattatgcttagtcattgctgtatagttatttaggagtgaacctctgctgccatattccaaatgtgaaaatagagtcaacttttgtaacttacctcgacttttttatttggtcaaactcaacatcttcaagtttttggtgatgccctagaggagaagcattaaatcaatacctgctctttttaaaatgaggtcttcttaaaaaggacgtttttataaagattcatgtactgcatcataccagttatatactgcgtcatatttacagtctgaaatattttaaaaatctcttttgtttctagtgtaatttatgtttatattacgtcttccagaacacagtacattgtgtgactttggagatttatgttaggcccacacattacgagtttgtatgtccatctctgagtctccattactggctttgataggcctaaatttgaccagacccaggatccatcagtcacttcatctgtccattgtctgagggcaggaactgtgtcttttgtatctttgcatcactctgtaagtagcagatggctcacggccctgtacgcgcactaggctctcaaaagaaaacatgggactgagacaagaatgctttaagttatccttttgttacaggaaagaggtcctcatccagaccccaagagagggttcttggatctcgcacaaaaatgaattcagggtgagtctgtaaagtgaaaacaagtttattaagaaagtgaaggaataaaacaatggctactccatagacagagcagccccgagagctgctggttgcccatttttatggttatttcttgatgatatgctaaacaaggggtggattattcatgcctcccctttttagatcatatagggtaacttcctgacattgccatggcatttgtaaactgtcatggttctggtgggagtgtggcagtgaggatgaccagaggtcactctcgtcaccatctcgactttggtgggttttggctggcttcttgactgcaacctgttttatcagcaagatctttatgacctgtatcttgtgctgaccttcagtctcatcctgtgacttagaatgccttaaccatctgggaatgcagcccagtaggtttcagccttattttacccagctcctattcaagatggagttgctctggttcatgcacctcggacacttttatagttatctaagtatacatatttaatcctaaataatagttttggatagatttgtaataaaatgatggtgtttaagtaatatctaattcaagtcttgttaaaagttatgccgggccgggcgtggtggctcatgcctgtaatcccagcactttgggaggccgaggtgggtggatcacgaggttaggagatcgagcccatcctggctaacatggtgaaacactgtctctactaaaaaaatacaaaaaagttagccgggcgtggtggcgggcgcctgtagtcccagctactagggaggctgaggcaggagaatggcatgaacccaggaggtggaggagtttgcagtgacctgagatcacaccactgcactccagcctgggcaacagagcgagactctgtctcaaaaaaaataaaaataaaataaaaaataaaaaaaagttatgccaaacccttgaacatagttacagtctcatggtatgaattcagtagttcagagtggccctgatagatccttgtccattcaagtttgtttgctcagttcattcaatccacgtttgccgagtaccatcacttaccagcagtgggagttagtgctgaggaagcaaagacctggttcagtaccctgagttgatatcaaagctagcctatggatcccatgttctctaaggcaaggaccaatgtagtatttaactcttttgctccggaggcacacagaaggcagtggtaaaattaatccttacttttacacttagaggtaggctttattcaagaagtctgtattttttgactagaactttacatgggagaatttcagaggtcaccaaaaacagtgctctcaagctttaatatgctgatgtatcatcaggggatcttgttaaaatgcagatttggattctcatggtctggagtggagcctgaaaagtctgcatttctcacaagctcccaggtaatgttgatgttcttggcccacaacatactttgaataccaaagactagagctagatgtgaaaatgttcaagttcagtatttggttactgttacatgtgttatgtttgcatgctttcctattcaatgaaccagtattttaatgcttcagcggggactaagtcgtgaaattctggtgtctgtagggttaagtgacacacaggcataaatcgttgctaattatgctttcctgggatgttgtctcttctgttctgtcttctaaattaattgatcttccttgccatttcaactttagctctttaaaagcattgtgaaaattttggttgcattttaaattattaatatttaagaaagcttttgctaatacagtctggcaaggagcatctttgcttagtgtgattattttgtaaacataagagttcttttagactttttttcactgctttgctgaaggtcaatatgtattttaaaaaccaacacatagagggaaaaaacatccagtttctgaattgtcatgatcgaatgttttatagagaagaagcaaatgtatatacatagtagttttcagaagaccttttttttgaatttgagctcagaccaccttgaatgactcccttactatttaaatccttccagagatgatataggatataagtaagtaaaatttatttttctcagcaaattaccacctggaataagacatttagcccaaaacatggcagattagaggttttagtttaagctcatattgtaaagtagctttctagttttttatgatacacattatttacaataacccaaatgtgttttaattgaattacatattcagcttatataatctgcttatcatgcagctcctttcattttaatttcttgactactatgtttcaagacctgtttaaagtgttggaggccacaaagatatttagagatggttgttgtccttttggaatttatagtttaatgagagtacaaacacatctgcaaagcatgttgggaaaacatgatatattgctgtaatatggtcagggcatggtgagaagatgtctgtctcttagcttaccctaacagttcagaaagctggaaaggtcactgagctgtgccctctgaaaatgaggagggaatcaccaggtgaggaaaagtacagaatgttatcactagagcctaaagtggcaaccatccagtgatggatggcctccatctagtgatgggagtgatggagctaagatgtggatgctttatcaggaaggcccattctttctcgaatgctatgctgtggcactggactgccttgtaggcagtgggcacagctgaagagttttagtcagagaatgtaactatcagatttatctaaggtcactttggtggtaatgtcgaagatggagttaaagaggggagaaaaacaggggaagcagacaagaacaaaagagtgaagcccagtaagaaaacgaggtcatgatctagggaagagaaatgggcctgaactccagggaagggggaaagggacagacagaaaagaatggtttcacaaaaaagggttaacagaacttggtacttggtgattgatttagttggggactgaaggaaagaatctaggatggctcccagtgtctagctggagtgactgcgaagttgccaccttttcctgaaatgggaaaacttgaaggaggaaggggaaactaattagtaattagcaagaagaatgatcttggctttgtgtctactatttcatttgaatttcccgaagtcattatttagcttgaaaatcttacacttcctagacttcagaaaatttttccttagagagctgtatattcatatgttgagcacagcatttataattattaatctctttgaagatattcttttcatgaatattttaatgctccactcagtaggccattttcctcctgaaatatttctaatttgaggctaactgaaataattttcttaggctatatgataggctctttcattaatgaagagtaaattgttatttcttaagtgagtcagagccctttactgagctcagtcttgaattggcattctgtaggagaattagatgtggatttcctacagtagttgtcagttatcatgataagcctctgcatattaaatatttcctaagttcttttcactctgtgcataattatggggaaattacattttgattgactagaacagacacctgtctgtattttatcaggaattgccttttcatatatccgtgtatgaattcttcagttttataatgttttcaaatgcagctaattccaacatcacaaaatagttactatagcaatttatttcatcttttttccccatttgacatttagagtcagaactaatcaataaagctgatgttcaccctctacctgccttaaaaaagtcaatatataaatagcaagcaaaacaatatattagtaaatcatttaatcaacctttagaattttgattggtgaccatatgttgcctgagttgatgaactcatttgggtagaatggtccctgtggggccaattagcactacatcacgaaagggctgtttcactgctaccttggcttcatcttcaaccttggctgctgttccacaaaaagatgccagagctcacacagggacccaaggaggggacgaaaactgcttcctgcaaacccatcaccatcattcttccaaaagtttttcttagcctatatgaagatgtaaaattatgttctcagtttaattagagtttttttagttaattaaaaaatataaatcagtatacatgtaaaattgacaaacattcaaaaagaacaaaagagtagtcagtgaaaggaaatctccttttcacctttgcctctcagaaacccagtttctcaggaactatgttcttttagtactatcttgtatatttttgcagggtcatgcaatgcacatacaaatatattctttttcaaattttggtggcagcagaatagacatactgttatgccctgtttttttttgttgttgttgttgttttttgagagtctcgctctgttgcccaggttggagtgtagtggcacgatcatggctcactgcaacctccgcctcctgggttcaagtgattcttgtacctcagccttctgagtagctgggactacaggtgtgcaccaccatggccagctaatttttgtatttttagtagacatggagtttgactatgttggccaggctggtctggaattcttggcctcaagtgatctgcctgcctcagcctcccaaagtgctgggattataggtgtgagctaccgtgcctggcctgccttgttcttttcaaatttaacaatatattagtatttatagaggttccatattctttttaaaaaatattttcatcagcattgtttatacaagtttaaactattagcttttatgtattataaagctaaatcatgataacacattaatgttttgctgttgccactatgttataattgtacatataacagcagattccaagtaatcaaaacaatatttaaaaagaagaacaaagttgcaggattcacatttcctaattttacaacttactgaaaagctatggtaatcaaaaccatatactgggctcgggtagacatatagaacaattgaatagaattgagaatctaaaaataaacctatatacttatggccaattgattttcccacaagagtgttaagaccattcaatagaaaaagaatagtttcttcaacaaatagtgctgaatccctggatatccacacacaaaacaacaaagctagactcctttgcatatacaagaattaattcagaagggatcaaaagccaaagatataagagcttaaaccataaaactcttggaagaaaacataggagtaagtctttatggtcttagatttagcattggactcttagacaccaaaagcataagcagaaaagaaaaaagataaataggacttcacacagatgtaacatttttgtacatcaaaggacattattttaaaaagtgaagacagtctgcagaagataaaattatttgccaatcatatatctgataaagatctagtatccaaaatatataaataacacaactcaacaataaaaagacaaaaattccaatttagaaatgggcaaagtgcttgaatatacaaatgactggcaatcaaaaaattttcaacgtggttagtcgttagagaaatacaaatcaaaactacaatgaaataccacttcatccccaccggggtagttacaattttaaaaaaggaaaataaagtgattaattttatgttatgtgaatttcacctcaacaaatttgtagttccctctcaccactccttttcaacatagtgctgaaagtcctggctaatgcaataagacaagaaagtgtagtaaaatgtattgagaaggaagaaatatacctgtctttgttcacagatgacatgattatctaagtagaaaatgggaaaggcttccagagctagtaagtgattataacaaggttgcaggatacaaggttaatatacaaaagttaatcactttcctttatatcagcagtgaacaagtggaatttgaaattaaaaatacaataccatttatattaacatccccccaaaatgaaatatttagatgtaaatctaacaaaaatatgtataagatcaatgtgaggaaaactatcaaattatgaaggaaatcagggaagaatttaataaatgaagagatttccatgttcatggataggaagacccactattgtcaagatgtcagtttttcccaagttgatctgtagattcaatgcagtcccaacaaacggatcctaaagtttggagaggcaaaagacctaggagagctaacacaatattgaaggaaaagaacaaagttaaagtactaatactaactgacttcaagacttagtataaagtgacaataatcaagacagtatagtattggcaaaagaatgtacaaattaatcagtggaacagaacagagaacccggtaacagccccacttaaatgcagttaactgatctttgacagaagagaaaaggtaacacaatgaagtaaagatggtcttttcaacaaatggtgctggaaaaactagatatctgaaaaatgaatctagaaatggacattttatttttcacaaaaattaactcaaaatagatcacagatataaatgtaaaacacaaaactgtaaaattcctaggcgataacatgggagaaaatctagatgaccttggatttggtgataactttttagatgtaacaccaaaggcacatccatgaaagaattgataagctggacttcattaaaattaaaaatttctttgctgcaaaagacactgtgagcagaatgaaaagacaggctcagactgggaggaaatatttgcaaaagacacagctgataaaggactgttatccaaaatatacaaagaactcaacagtagtaaaccatcagattaaaaaattggaccaaagatgttaacagacacctcactgaagaagatatacaaatggcacacaagcatatgaaaagatgctccacatcacatgtcatcagggaaatgcaacttaaaacagcaatgagatagtactacacatctattagaatggccaaaatttgaaacactgacaacaccaaatgctggtgaacataggtggttcaacaactcattgctgatgagaatgcaaaatgcaaaatggtacagccactttagaagattgtttagtggtgtcttttacaactaaacatactcttaccatcctctccagtagtcatgctccttggtatttacccaaaggagttgaaaacttaggtccacacagaaacctgtacacaggtatttgtagcagctttattcaaaattgccaaaacttggaagcaaccaagatgttgttcagtatgtgaatggataaataaactggtacatctagacagtggacaaaatgagtgatctagttatgaaaagacatggaagacatggaagaaccttaaatgcataatactaagtgaaagaagccaatgtggaaaggctatgtgctgcatgattccaactatttaacgttctggaaaaggcaaaattatttgcaaggcagcccttgtcaccgctagacagctctcattcctaggcaggtctttatattctgccaaaacctccatgaaacttccacccaacagtcccagttatggcctctagaactactgatgtcatggtttgaacagaagataactggtgtattctcatataggtcttttctgtcacctaaacgccttgtttcctgaaattccctcattgcaggttttcacatttcttgattacccttctttgagtgttctctcgctgccagtgactcctttgaaagacagatgtctgaaaatccctacatgcctacaacagcagagctttttggtgaatggatatatgacagcttatttatccagtgccctgttgataaactgttagtttgtttccagtcttctgctattgtgatgcaaagaaaaatggtgatgcattttataaatatctatatagtaacttcctagaaaaggaacagtgaggtggaagatcatgcatatctaaaattttattaaattttgacaaatggcttttttagagtttgttccattttaccttctcaccggaagtctgtgtgagaatgcctcttttcccacacggtctccaacacagtgtgatattctaacatttgtatctttttgaatctggcgagtgaaaagtggcatctcatttcgattttaatttggatttctcttcattttcagagaagttgagtaacttttcatgtttttaagaatcctcctttctcttttctggaagctttgcagatcttttatctttagtgttctaaaaatacattatttcatcctagtgtggggatttatggtcattgactgtgctgggcacttgagtgtgcccttttggtctgaaaacctgtgttttcagaccaaaattttctttgggtctagaaaattcatcctgtattgtttatatttcctcctttttgttttctcttttactgtctctggcactcctttcttttcatctctttattgactttttttgaggtgtttggttttaatttttttaactcttttatttacctttaaaaaaattgtaatggtggatacatgtctttacacatttgtcaaacccatagaatgtacaacaccaatagcaaaccctaatataaactatggactttgaatgataataatgtcagtatagattcagcagttgtaacaaatatgccactccagtggaggatgtttatcttgggggagtctgtgtcatgtgttggggtagaggatatgtggagtatgtctatactttctgattaatgttcctatgagcttaaaactgctctaaaaaattctattttattttttatttttgagacagagtctcattctgttgcccaggctggagtgcagtgtaacagtcatggctcactgcagcctcaacctcccaggctcaagcaatcctccaatcttggcctctcctgagtagctgagactactcatttttttgagacagagtctcactctgttgccaggctggagtgcagtggtgtgatcatggctcactgcagcctcaacctcccaggctcaagcaatcctccaatctcagcctctcctgagtagctgagactactcattttttttgagacagagtctcactctgttgcccaggctggagcgcagtggtgcgatcatggctcactgaagcctcaacctcccaggctcaagcagtcctccgacctcggcctcctgagtagctgagacgacaagtgtgcaccaccatgcccagcttattttttttggtagagacggggttttgccatgttgcccaggctggtctcacactcctgggctgaagcaatctgcctgccttggcctcccaaagtgctgggattacagccatgagccactgaaccctgccaaaaaaaatctattttaaagaaaaaaaaatgacaatcatatttttaatttccaagccacccatttttctctgatttgctcttttcctaacatcctatttttttttggtctcatggatataatatcatcttaaatgtctctgcaaaagctctctacagttcctgaaatatctatctcatgtgttgtcattttgctgtttatcttagtcttgtaggctaccaggggagcaacataaagctgatttagagctctgagtaagtagggcaggcctgtcaaccagtgcactgtttagcttgagctgacagggagccagctgttacattggggaacccctaagtcctaccaaatgaaggtttttgttctagggcaccagtgttcacagtatctgttctagttctaatttgtttagtttctctcgaatcttttgtctgggaggagttgagggtccacatttggctgctaggcattctgtattagggtagagggattttgaaggaaggtgtcaactaatctctgcaggactttaaatcagtccgcttgtctttagctttgtgtctcagtcccatgctggcagaaccagatgttacccactttggaccctcttggtgctctgcaaggcatgttggcccctccacactgcagtctcacctgtgcgacttggggcagctctctctgccacttgttacttaccttcgccctgaaactctctcatccatcagttgtcccttcctgtactctatactattgtagattcatatcttcatatgccttgtaacattttcatgcggtctcaaaagggagagaatcacatgtgatctgttatcctctttattcagaatatcttgtttcttcaacctgtgttttccacttgcatcttttttcccctttgaatctatcttcaactctttagtttatgtataatagtaattgattttggcatgggcagttagcattataccttctgtatgcccataaggagtgacctgaccaagggctcagagctaataagtagcagaacaaataaccctctaaatctttagacttttccattgtattgtattatttcctcatatccatttattctgtcttttcaaagttctttgaattattcctgtatttgttctgattaaagatttctttcacctcctagtttattctcatcagtttgaagtttatccttgagccttgtcaatcacactttgacagaataaaaattttacatagtttaattagttgttgaatagtatttttgatgtttctgacaaatctgccctagtgagctcagtggatgcagcttgaagccaaccttaatgacagtgaatagtgacagaatatttgccacagtcatttttgttttactttgttgtttttcttttttgttctgttttgattttggtgctaaaccaaaaagaagattggaatcaggatctaaattcaccaagtatttaggttatctgtacacaaattttagtgatgactaatataaggaagtttttaaaaatgggtatctttaaaagaaatttgaaataattccttactaacctgatcctttttagttgctaagattatatttcacaaggtatatggtggtttggtggttaaattttcattttaaagtggtgatagttgcaaatattctaaaatagactaattataattactttcattcaaatactgaatgtgagagtatataatcatcttatttgtatgtggtaagaaagactactatgtatttttctgacaacatttagtggtagttatgattatttccatttctttggacttgttcacagaaatataactgtggttacttaagaaaacatgttctagataaacataaagattatatcccatcttttttaaaaataggagcagatgtctcaagtattagatgccatgtttgaaaaattggtcaaagatggggagcatgtaattgatcaaggtgacgatggtgacaacttttatgtaattgataggtaagttttgcccaaccttactattgaaattgaaagaaccttttgtgtaaaatctcaaccattattacggcaactgacaggttaatataggatagttgttattgccgctactcttattattacataataggcactgtaaacctgttgtgagtacatgcagtgaaaccacagtggatcatgaaaagagacatagtttatagaggaactaatgacttttggttagtctaatctgtaaatgtcagtcatttaacatgagcatcttcatttgctgaattctaattgagagatattatgtagtagtattagtatgtactagatgcctgttacagtgagaacagcagtataatataacatctgagatattaattcacagtagacctcaattggtatttcttaaaaggttctttttttataaactgtgtaaaacatgctcatggtttaaaaaattcaaaattggcggagtgtggcggctcaggcctgcaatctcagcactttgggaagccgaggccagtggatcacttgaggtcaggagttcaagaccagcctgaccaacatggtgaaaccccgtctctactaaatacaaaaaaaattagccaggtgtggtggtgcacacctgtaatcccagctacttgggaggctgagacacgagaattgcttgaacccggcaggtggaggttgcagtgagccgatactgcaccatttgcactacaacctgggcaacaagagtgaaactctgtctcaaataataataacaataaataaataaaaataggaaatgcaaatatttcacaggggcataaggtgaaaagtctttcttcctactgctttaacatcatccagtccacataagtaagtagtttgtgcatccttccaagaattgtatattattatatttgtcttaaaaaaactctataattatttaaagaagtcttgcatttatgttgaaaatctgttttcaggaaatttaagttgtgctttacctcatcatagaacaatatgccttatgcaatagatgaatcctgaaatctaacagcagagcagcctgagctgagtccttatttcttcacttttgtaaaacaatgataagtgttcatgagacaattggcatccctgacccctccccttgtgtgtggaacgcaggtcctctcccagcctgacttactgggttacgtttgctctctgggctgggttgtgttcacctcagaggtcttggtgaaaatgacctctttggtctcctgaagcctcatttcgttattttggctctgtgggtggtatctttcatgcgtcagtcgagcatgctgtttaaatcaagagttgtcactgattctcccattccctcatcccaaattcctggtgacctgtggctgaagcactagccaggattttagaatagaataaaccagttatctatatgtgaatcaaagtaatgatttttatatcattaatagctatcatcactgaaacacctcagaaatgcacctaagtgtgtttaattgtagaggtgtatgagaagccctaaccctctatgatcttaaccatttagtggggatttttgactttcaaaactgccttacatttgtatatagtgtattcccttttcagttagatcctagtcacccatttggtagatgagaacatgcaggcccacagaagtgacagcacttggttcagatcacccaaatgactggcgtagagccaactccacagccaggtctcctgccctgttcatgttctttctggaggttcttgcctgccggaggccttgtattatcagagaagaagtctgtgtgaaaaaaacagcccaagattttttgtttgttttttttttttaaacagtcttgctctgttgcccaggctggagtgcagtggtgcgatctcgacccactgcaacctctgcctcccagtttcaagcgattctcctgcctcagcctgcggagtagctgggactacaggtacccgccaccacacccagctaatttttgtattttcagtagagacaaggtatcaccatgttggtcgggctggtctcgaactcctgccttcaggtaatccgcctgccttggcttcccaaagtggtgggtttacaggtgtaagtcagtgtgcctggcctagcctgcggtattttaacagattttagactgatgtgatttcaactggactgatagctcattttacttctcctcggcacatttggctttgttttaccctattcaaagtagccgagtgtagagaacagtttcagcgcaaaagtataaatagtgtaaatcgaagagtttaatctgtacagcattgctagtctgaaaatctgaaattctccaaactccaaagcattttgagcatcaacatgatggcacaagtggaaattccacacctgacctcatgtgatggtttacagtcaaaatgcaggcacacaacagcttattcagcatccccgaaggggttagtgtacgaggtacagtaactttaatcagaatatagcattgtaggtggagactgcaagcctgccattgtttgtggttgctcttgtttggcagctggtgcaggtattctggggatgctactatgctgcttagttgccccaaacacattagtttttactgtgttaatggtatgtcttattttttactgttaagtacttatgtgtgaatacaagtaaaaaatgatggcttattggtagcatataaattcagagtcaggaatgatggtaatgctgaacaaccacagattgtccacatgggtggttgagataatgacacctttgctttctggtggttcaatgtacacaaatttggtttcatgtacaaaattactcaaaatattaaataaaattatattgaggctgtgtgtataaggtatatatgaaacataaactgattttgtatttagacttgggtctcattcccaagatacctcattctatatatgcaaatattctaaaatctgaaaatatctaaaatctataacacttctggtcccaagaattttggatgagggaaactaaccctgtacttgaaaaatgattatccatgggacaaattctagtagtttcccttgaaacagtcattctatccgtgaatgacattgaaaaccaattcttttcttatttatttatttatttatttatttatttatttatttatttatttttgaggcggagtcttgctcttgttgcccaggctggagtgcagtggcgcaatctcagctcactgcacccactgtcctcctgggttcaggtgattcttcttcctcaacctcccgagtagctgggattacaggtgactgccaccacgcctggctaatttttttgtatttttagtagagacggggtttcaccatgttggccaggctggtctcaaactcctgaccttgtgatctgcccaccttggcctcctaaagttctgggattacaggcgtgaaccactgtgcctggccatgaaagccaattattttcttctgtctatcatgtttctgctgttattgcttctttattattaataatccttttctttcttttttggaggggcagggagagtgtctcactttcttgcctaggctcgagtgcagtggtgcagtcacagctcactgcagccttgaactcctgggcccaagcgatcctcttgcctcagccttccaagtagctaggagtacaggcatgtgccaccatacttgactaattttttggttttttgtagagacagagtcttgctatgttgcccaggctggtcttgaactcctggattcaaatcctcccaccttggcctcccaaaacattggaattacaggcatgaggtaccaggcctggcccataataattttctaatgttaaaagccactttttttttttttttttttttttttttagcagcacgtccccactctttgtctgtgttagggtttagtcaacagaataaagccaaagaattttttctatctgccctcacaggtgcaagccttgaaagcatgttctctgataaaatacagtatgcggaaagtcagtcatccacacaaagaatgcagtttacgtgaatatagggtctgggtaataggaagtgcagtgacatgcaaactgaaccttatttgcctagaaaaagaaccccagttaaaagataagcaccaaaaaactataaaaagaccagagttagatatctagtctgaatttctactttttaactttagaatgggggttgatctaaagtaaagggccagagagtaaatatttttggctttgcaggccaatatgttctctgttgtaactactcaactctgcagttgtagcataaaaccagccatagataacacataaacaaacaagagtgtttatattgcagtgaaactttatttacaaaagcagatagccagtttgtgggctatagtttgccaacgtctgctatagattataaaggaccctagtaagttttgtagagtagtggctaaccaaattgctatagctagattctttttaaaaagttattttcttctgatcacaaaagtaataatatgttcatgttacaaacagaaactcttaaattagatagcgaatatgcctagaatccctcactattcttatgcttttagataactacagtcagtgatttgataaatgtttcttcagatgattttctttctttttttaaggttaattttttatagagatgggatcttgctatgttgcccaggctggtcttgaactcctaggctcaagtgatcctcttaccttggacttccaaattgctggaattacagatgtaagtaagccaccacacccagcctcttcagatgatttttttttttttttttttttttgagttggagttttgctcttgtcacccaggctggagtgcagtggcacaatctcggctcactgcaacctccgtctcccaggttcaagtgattctcctgcctcagcctcccgagtagctgagattatgggatcccgccatcacacccggctaatattttgtatttttaatagagacagggtttcaccatgttggccaggctggtctcaaactcctaacctcaggtgatccacccgcctcagcctcccaaagtgctgtgattacaggtgtgagacccggcctctccagatggttttttatgcatatactatttggttgtagtctttagttatagttttatcattccttattccaaatttttattgtttagtcccatttttcccagcaggcacatggtctggaacagatggcacagattgattcccctttattgtcatcggaggggataacaggctggaaataagatttttatttcacagggctcttttctgaaataatgttttattttaatgatattttatttgaattaacctccaatctacatatgtccaacagaggcacatttgatatttatgtgaaatgtgatggtgttggaagatgtgttggtaactatgataatcgtgggagtttcggcgaactggccttaatgtacaatacacccagagcagctacaatcactgctacctctcctggtgctctgtggggtttggtgagtaaaatacttatttgacctgaatgttatgatttgtagcaattgctatgacggtgttacaaattgccgcatgtagtattttaatttaaagatcatcagtcatcaggtaatttattaagcagccactgaatgctgaactgtagggcactaagacttcactaagtcagatcctgatgtcattgcccccactcctccagtccagtcaggagcttgggacctggtggcccaggaaagacactcagattcagaatgctcctgtcttacccactcttagaaaataaccagccatacaaacacagccttaagtactttttctcagatagctttctgaggtaagtattataatctgataaagttgtggctcccagagtgtggtcccctgaacactggcagctgtatcacttgggaactttttagaaatgcccattctggggccccacccactgattctgacctactgcatcagaaattcggagtttgagaaaccagtataaaaggatgctcttggtgctataaattgattggtaactactctgcatttaaaagcagttgtgtagggaaaaaatgcttggtggctgtgctcatgtgccccacatcagaattacctggagtatttttttaaaatcctcttacctagccacgaggtcaggagatcgagaccacggtgaaaccccgtctctactaaaaatacaaaaaattagccgggcacggtcgtgggtgcctgtagtcccagctactcaggaggctgaggcaggagaatggcatgaacccgggaggcggagcttgcagtgaagctgagattgcaccactgcactccagcctgggcgacagagcgagactctgtctcaaaaaaaatcctcttacctagacctcaccatgggcaaattgatcagaatcttcagcactgggacctgagcattagtacttttaaatacatttcttaatgtggtattcccgcaagacttaaaagctggtttaaagatacattcgggcaatattttcacatatgataggatgcaaattattaggcactactaaagctccttctggaggattgtatttaaggtagtgattctcaaactttaatatgcttacaaatcacctgggaatccagttaaaatgcagattctgattcagtggttctggggtgaggcccgtgatttttgcatttctcatcagctcccaggagatggcagtactgcctgatgtcaggccaaaccttaaacagcatcgatttagggaaatgtttacagtatatgtattttcttttaaaattgttgaaaatagcccacccactagttttgacatgcatttattgggttatttctctcaaatccttttgtggaaagagaagaggttgaagtaaatatgaagtctgttaaaagtctcatttccaaggactactgtatatagcattgtggaagtcacacattatttagtcacagttcagcatttgactctgaagtcaattcagctgataaaaaatatctcttgatcaaagagacaagacattttacatttcttttaattggaaccagttattatatacttatttaaaaatgtgatgagtcacttttttaaggtttagaggaaaagctgaattgtctcaggaaaaggaaagaactgtcagtgatttgaatacccaaagccagcaaagaaaaaacttcaaaccaggacagtccttcacccacagaagtctttgtctgcctgtaattaaagtggtgggataaatctagcatctgccatgacctgttttattcaggaaggtttacttttcaaatgtagtcattccaatggggttgccgttcagattcagattgtcagattgtcacacagtgaggaaactgcctccttgcacatcttcagaataagatcaactgttttataggttggcctctttgaatactgatagtttttagcccttgtagaaactttaatggggtataaaagacccagaatttcctagtgcacgtactacttaagttcctaagataggattaagcattttcagagctttttagtagtctatacatgttattaaattttataaaaatgggcagtttgtgataatcctcctgacatataatagctttctaaaaaagttagaataattaacataattacttagtatttcaagcctactttttaagggtgacttgactaattataataactccttctcagggagagtcgagtagaaaataaatttttcttttaaggtcaacagactggaggtctgccttataaatacaggtgtgtaaagataagcaaaaaaagcccaagagaaaagtccattgcagaatagtctcactctgtaaataatatttggtcactattagccttagggctaacatgatctacgtgactatactgatgatttggaaaggtgatttttgaaatggcttcaggatgaaagtatttgaaattctggactttatatgtcacagtgggtgtgaagaggtaggttactaatggaaaattctttctgagagatataactgattatgattagtttctaaatcattaagctattttgagtcttctctgttttgcaataaccgctgtccatacaatggtgttatacctgatttccaaacctgattacatatcagaatcactttgggagcatttatgaattattgagccctacatgcagagatcttgagtcattaaggtctggtgtctcagaaatcttttttaatactatagcttattctgatgcagagccaggcttggaaataatttcaatatttgtgctaattatcttgtaaaattttcttttaaaaaaagtattaggagtaaaacaagtccaaattacagccaataccaaattgggaaacaagatgtttaatttcctagtgtcttagtccttttggggtgctatgacagactgttatagaatgggtggcttaagcagcatacatttatttctcatggtctggacgctgagaagtccaagatcaaggcaccagaagattcggtgtctggtgagggcttgttttcctgtttaacagacagcgtcttctacttgtgttctcacatggtggaaggggcaagggagctcattgggatctcttttataaggacattaatcccattcatgagggctccagcctcatgacctaaccatcttccaaaggctccaccacctaatactatcctgggtgattaggatttcaacagagggattttagagtgatagaaacattcagttgcagtccatcacacctagagactttcatctatactggcatttttctccattgcactagttcatttaaattcagccttattatgttggcataagaaagaatgaataagacctagtatttggtagcacaatagggtgaccatagtcaataataaaattgtatattttaaaataaatgtaattggattttttgtaactcaaaggatagatgcttgagggggcagataccccattctctatgatgtgcatatttcatgttgcatgcctgtatcagaacatctcatgtaccccataaatatacacctactatgtacccacaaaaattaaaaataaaagtaaaaaaaaattaaaatattggcatagtaatttattaaataatatatcccaatttttactttattaaaatggtataattgtttattaatgaatgccaatctaacataattattgaggcttttattaaagaattaaaatattttatgagaaattatttaaaataaaatttttaggaaaataatgttttgagctgtatccttaaaatttttactagttcttcaaccgagttctgtatctttgagggcatgatagtataaacaggaacattttagactgtgaacatggtaaacactggaattagatcttactcaaaaacatagttgtagtttctctgtgccttcacattaaataaaaattttttttatgagtacatattatgtgtatatatttacagggtacataagctatttcgataacagcatacaatatataatgatcacatcagggtaaatggagtagccatcactttaagcatttataatttctttgggcatccctccacatttttgacaagaaaattttgacataatgtggatatgaaaaagaacgtagagtacataacagagtaaaagaacagagtgctagtatacatatttaaaaatgctgtgacagcgcctccttgtgggcagaacccaacatattggtcagatttctgttatgtataaaaagtcaacagatgctttctttaaaaaaaaaaaaaaaaaaaaaaaagaaaacagtattttatgtggttctgtattatattttgtgcttgacgaaataaaaatatgaaatgagttgcattaaaagtataatgatgttaatcttttatttcagaatcttcaatcattgtttcttgtagggaataaaataaaactatttgtatagctttacccccataaaatttaccctttaactgttctgcctgtaggacagggtaaccttcaggagaataattgtgaaaaacaatgccaaaaagagaaaaatgtatgaaagctttattgagtcactgccattccttaaatctttggaggtaagtatatgtttatgcttttattttattttgctttaaaagtttctgttttgctaggaatatttagttctatagaaaaatttctttgaataaaaaaaaatctatccatgtttttatttgaaaagattaaatggtagtgctaatttttataactcattgtttcttctgctatctataatttcatttgttttgttatttgaaagtaatacattcctacccagcatctatagcaaatttatatgtggtctttatctgatagcagacttaatataatcacatagatgtagacaagagccactagttgtaactttacagtgaggcgttctctagatatagaatgtcctctctggcctcttcctctcagtcatctttgctgtttattcctcttttcttctcctcttaaaactggcattccaggcctctgtccttggcctcttctcttttcaggatacacttattcacttggtgaacatgtcgaatcccatggccttaaatacagatgtcccttgacttactatggggttaccttacgaataaacccattgtgagttgaaaatatcataaatagaaaatgtatttaatacacctaaactatggaacattcgagctcagcctagcctacctgaaacatgcttaggacactcacatcagcctacagctgggaacagtcacctggcagcacagtgcactggagagcatgggttgttcacctcattgtggtgaggctggctgggcgttgtggctctctgcctggcgttgtactgcatatcgctagcctgggagaagatcgaaactcaaaattagaagtatagtttctatcgctttcaaacaactgtaaggttgaaaaatcattaatcaagccactgtaagtcagggaccacctgtactgtccatatattgatgcttcttaaaattgatatcactgggcaaggcccctcccttgaaggtcagacttacttatccaactgcaaatgtaagatttcctctcagatgtctaatagacatctcaaacctagtatgtcccaaatctactccttttctctttccccgcagatggcaacatatccttccagtgtctcaggccaaaaaccttcgagttagcactgactcatatgaaccaccatcacctcttgcctggctaattgcagagtcatcttttaaaatccctggttgtggcactgctctatttaagctcctcctcacatggcctctaaggctctgcacagactgtcccattcccccacccattttccccaacctcatttcctactgctccacactcatcatctctctgttgacacatcagcttcttgccactcctcaaacacacctgtcccacacccacttcggggtctttgtacttgccgtctgtctggaatgtcttcctacacagctgcagggctccttcatttctcagcccagaggtcttctcaatgagaccagctcttaggtttttatctttgaaggtagagacttatgagagagagtaggttgttgttaccctaaaaattcagcttcattttccatacttcatcattaaattaaatgcttttctatttcactgtcatatttgaagtattttgagagtaattaaagacaggcatatatatgtacccacaacatcttataaaatggcaagtgtcaaaacagcagtgcttctccttttgaatgtctctgttggattatcagcttacatctggtaaaaattttgtccacatcacacagtgcgtggtagacagctgatcttttccagcagcatatttctttaaataagagtaggtcagggattggaaatctggtgccttcagagctaggcaggtaacacagagaagaaaaccaagccaggaagggactttggcagattggagaacatgtatttcattaaagaaacagctgctatcccaccatagttttattgttgccatgtggaaatatgggctatgtgatgctgatttttcaagagaagctggagattgaatttttatgaaaaattattttaaaatgctggctggtaattaatacaacaaacacatatacaacctacacactgctcgatttatttggcctataggctaccagttttttactcccgaactagataagcttacccagttaatttgtttctatttaatattgtttttctttctttgtagttttctgaacgcctgaaagtagtagatgtgataggcaccaaagtatacaacgatggagaacaaatcattgctcaggtatgatattttgaaatgtaattcagtttagggttatattccaaaaggttcctgtagtggtagatcttgataaacttttcatatttctaaaattagtatgcagtgatgggttaaataaatattacttctaccaaatgacctgttaaaaatggtttcatttatagtcattactctattgaatatttttgtttatgtaattaactcctaatgaaggtgtattaaaccatcaaatggttttctgcatcattgtagtcatttataagaggaaaaaacaggtgaatgttccatgacattaatgaggacccagaaagtacactggaaaattctatagagttttgcatgatcagttcatgatgaaaattcctgaggctgctccttgataaaattcaccaagaaaggaacacactgcaacatatactgttttggcttccaagactacatgtgggtcaacatgttatttaatccctaatacttttctaagatcccagctggaaccaataatattagatacctgggttggagtagggctaccaaaagtagaatttgtgaagactgttgaagttcacaggtaaagcatgcagatgatagtaccttgtttcctagttatatttttgaagcactaagcaaatgattaaaatggatttttaatagattctgtaatttttgtatcacagccttatactgttttgtgctctttatctgaaatgcagtcttttcctttatatgggaaacaagattcaaggtctttgagactgagaaaaagaattgttttagaagacaaatacataagtaaatctttcgatcaacacccctctcccattgctgagtgtgtgtgtgtgtatgtgtgtgttagagcagtcagggattgggaagaaatggagtcaagcaaggttaaagttctactgtataaactagtaaataacaaagcaaagagcatgttttaaatgattttttaaggttttattttgaaataattatagattcacaggaagttgcaaaaatagttttgagaggtcccgtgtactcttcacccagtttctcctaatgcgttttgcatcactgttaataacaatatcaaaactaggaaaatgacattggcataattcacagaccatattcagttttcaccagttttacatacacttagagcgtgctttaaaaatagttaaaaattactcagcagttaatagacctattatgattcagaacactcgaaaacttaatatgaagcttttatgaaaacctgatacaagaataagggaaaggagatatgctatacttagggtttattaaggatattcttacatatttgttgtcttttaagcatttataaatatacatatacaccctatattctaaaaatctaaattcaacatttatttttgtgatagaatcagatgctaaacttcttgaatttgtattaaggagttttgaaatattttaagtttctccagaatcactttgagaggcttagagaagtcagtgtctgtattattatcttccatattgtattgtttaattcagactgcatcattggagatcaaggcagagttcattaagaaacaaaagcaagaaagaacaggtatatgggtagagcaacacttttcttttagaagtccttccaaagccttgaaatggaatgtcagtaggctagcatgtcagagtttggtcctcagttgactgtagtgaaaatgtcaaggcccacatctgctgcttccggctccatctggatgctttctgctctttgcaagttgatggcttatcttgggtcaccacaccaatgcttgcgatgttaggatgacgcagggtgcatgtctcggcacttcctcaggagcacaggatccgcagacatgtttctgccaactaaggggacgctgctggcatacacagcagtgttgccatttccaactatgtatgctgttatctaggctgaaatttgggtgaaattcttaccccagtgttgccacattttcttggttttttagcagaaatacagtggtagagaatatattatttcaaggccaggcacagtggctcacgcctgtaatcccagcactttgggaggctgaggcaggtagatcacttcaaggtcaggagttcgagaccagcctggccaacatggtgaaaccccatctctaataaaaatacaaaaaaataaataaatacgggttctagatccctgaggaattgctacactgtcctccaaaatggttgaaccaatctacattcccaccaacagtgcaaaagcattcctatttctccacaacctcaccagcatctatcgttgcttgactttttaataattgccattctgactggcgtgagatggtttctcattatggttttgatttgcatttctctaatgatcagtaatgatctttttttcattttttttttggctgcataaatatcttcttttgattcttttgagaagtgtccgttcatatcctttgcccactttttaatggcagaaataccatttgacccagaaaacccattactgggtatatacccaaaggaatataaatcattctgctataaagacacatgcacacatatgtttattgcagcactatttacaataacaaagacatggaaccaacccaaatgcccatcagtgatagactggataaagaaaacgtggtacatatataccatggagtactatgcagccataaaaaagaatgagataatgtcctttgcaggacatggatgaagctggaagccatcattctcagcagactaacacaggagtagaaaactaaacaccgaatgttctcactcataagtgggagttgaacaataagaacacatggacacagggaggggaacatcacacaccggggcctgtcagggggtggggagtgaaggtagggagagtattaggacagatacctaatgcatgcggggcttaaaaccagacaggttgataggtatagcaaacctccatggcacatgtatacctgtgtaacaaacctgcatgttctccacatgtatccctgatttaaagtaaaattttaaaaaaaggaaaaaaaaattagctgggtgtggtagcacatgcctgtaatcccagctacttgggagggtgaggtgggagagtcgcctgaatccaggaggtggaggctgcagtgagctgagattgcaccactgcactccagcctgggtgacagagcgagactccatcttgggggggaaaaagaaagtattatttcaaataattttacaaatgaaatcattactacataattgtccatcaaaacctcttcatttagggccgggctcggtggctcacgcctgtaatcccagcactttgggaggccgacgcaggcagatctcgaggtcaggagatcaagaccatcctggctaacacgttgaaaccccgtctctactaaaaatacaaataaattagccgggcgtggtggcagacgcctgtagtcccagccacccaggaggctgaggcaggagaatggtgtgaacccgggaggtggagcttgtagtgagccgagatcgcgccactgcattccagtctgggcaacagagtgagactccgtctcaaaaaaaaaaaaaacctcttgatttagaaaccgagacagcttgttcccttaggatttcacttttcaggtgaatatgtgtactttggggttggatcaattttagggatatgaaaggtaacaagattgttgtcaattaatttgcattttcaccgtctgtttttgttattgattccaatagggagattcggctgattcttttttcattgtagaatctggagaagtgaaaattactatgaaaagaaaggtaagcattctaagtcctcagaacccacatactgttagcaaggaacacaacagatctactttttgatgtttagactgaggttaattttatttttcataagctgaggaaaagctcatctttttaattgccttgtcagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttaggtagggattgcaacagtgggcgtgcttctgctggttgaacttatgtctgcattttatgtattcatgttgagtgaatcattttattgggttcacaggttttgtggtccccacaaaaggtaacaagattaggactcattgccttataaaatcaatttgtggaagccattttttcttcgaaatttttacatccagatacattttgctcttcttgtgtatatatgaaataacatcccatattagtcattaaaataagagttccaagtaccacgttttatatggaatctctcaaataagcaacatgtgctatgttcctcaaaagagaaggctaaagtactatttttataaagtccgttattaagatctgcggggaatgctgagatgttgtgagaatccttactcattacagtattgggacacaaaggttcaggtttgtcaaagcacagtcaaatgttctttgctgttcagttgttattactattttaccagagtagcttggcagaaatgtcatcttcaggtgcaggcatctgtatatatctgagattatatatctgagaaatcacttactttgataagaaaatacagtttagaaggtggcaatatggagggtattttaagaaaattgatctcacagttattaccctctctgtgcttttcatccataattcaatagcataaacttaatgtttttaagatttgcaaggatccttagaattaacttcttagagaagtcattctttaaaagggtttaaataagtataatattaatcaagtgttaaatttggatggaagagaagacgattagaaactggcaggtaatttccctaagtagggctattagaaagagtaaaggtgagtgagtgaaagtctattagaaatagtaaaggtgagtgagtgaaagtctattacagtaaaggtgagtgagtgaaagtctattagaaagagtaaaggtgagtgagtgaaagtctgttaattttttttcaataatagattattatactcacatcaaagaaaacctgagaaatacagaaaatgtagaaaaaacataacaccgccactcagtgatttctgctattataattccttcttgtcctttttatttgtgtgggcttccagttgttaaacagttttccaaacaacttttaaagttcattatcgcttaggaatgttcttattttattacaccaaattttaaaattcttttaggtaaatatatacacgataaattaatcattccttagtggtaaatacttcgaaggttttggctccaacttttttgtggggagcaattttttgtgcatagaagacttttctgtattataggagttttccttagaaatggttttcaggagtgggtttttaaaaaattaacttttgacacatattgccagattacttgtatttgtacactactagcagtgccataatgcccattcaccctattcttgtaaacattgccttttttatctttttatctttagtgtaaaaggcaaagaagatctattttaatttgtacttttatgtatagagtatgatcatattttctatttatatattataaatccagttttaaaatccaggagacaggcaagcaaagtgatttctagcatgtacttatagaagtaaacaaaagcattatgtcagctgccatttttggattgcatagacatagtatggcagcaaaacttacaaaaggttaacacttggccttcacaacatggcattttaaaccctgagaagggaacacaggatagaaaacactcttgtgccacccttgaggagttcacattgctaaggtggagacagcacatttattttttaaaattctaaggtctttccatgatagtccctcattcttttctcagcttggaccaggaacctcccaccaacttagcattgctcatcatattgccgagggactgcagagtgtggtccaagagcgtggccctggctgcttcctttttcaagtggaacatttttatcattatgctttttcttgtattttatagtatttacctaaaatatcattgcactattgatatatatggagtcggtattgtaaatgacttagaaattctgcagatttgcaaagaatgttatttaaaaaaaaatcttctcttttctcagcaatggatgtgcaagcatttgaaaggcttctgggaccttgcatggaaattatgaaaaggaacatcgctacctatgaagaacagttagttgccctgtttggaacgaacatggatattgttgaacccactgcatgaagcaaaagtatggagcaagacctgtagtgacaaaattacacagtagtggttagtccactgagaatgtgtttgtgtagatgccaagcattttctgtgatttcaggttttttcctttttttacatttacaacgtatcaataaacagtagtgatttaatagtcaataggctttaacatcactttctaaagagtagttcataaaaaaatcaacatactgataaaatgactttgtactccacaaaattatgactgaaaggtttattaaaatgattgtaatatatagaaagtatctgtgtttaagaagataattaaaggatgttatcataggctatatgtgttttacttattcagactgataatcatattagtgactatccccatgtaagagggcacttggcaattaaacatgctacacagcatggcatcacttttttttataactcattaaacacagtaaaattttaatcatttttgttttaaagttttctagcttgataagttatgtgctggccttggcctattggtgaaatggtataaaatatcatatgcagttttaaaactttttatatttttgcaataaagtacattttgactttgttggcataatgtcagtaacatacatattccagtggttttatggacaggcaatttagtcattatgataataaggaaaacagtgttttagatgagagatcattaatgcatttttccctcatcaagcatatatctgcttttttttattttgcaattctctgtattctatgtctttaaaaatttgatcttgacatttaatgtcacaaagttttgtttttttaaaaagtgatttaaacttaagatccgacattttttgtattctttaagattttacacctaaaaaatctctcctatcccaaaaataatgtgggatccttatcagcatgcccacagtttatttctttgttcttcactaggcctgcataatacagtcctatgtagacatctgttcccttgggtttccgttctttcttaggatggttgccaacccacaatctcattgatcagcagccaatatgggtttgtttggtttttttaattcttaaaaacatcctctagaggaatagaaacaaatttttatgagcataaccctatataaagacaaaatgaatttctgaccttaccatatataccattaggccttgccattgctttaatgtagactcatagttgaaattagtgcagaaagaactcagatgtactagattttcattgttcattgatatgctcagtatgctgccacataagatgaatttaattatattcaaccaaagcaatatactcttacatgatttctaggccccatgacccagtgtctagagacattaattctaaccagttgtttgcttttaaatgagtgatttcattttgggaaacaggtttcaaatgaatatatatacatgggtaaaattactctgtgctagtgtagtcttactagagaatgtttatggtcccacttgtatatgaaaatgtggttagaatgttaattggataatgtatatataagaagttaaagtatgtaaagtataacttcagccacatttttagaacactgtttaacatttttgcaaaaccttcttgtaggaaaagagagctctctacatgaagatgacttgttttatatttcagattttattttaaaagccatgtctgttaaacaagaaaaaacacaaaagaactccagattcctggttcatcattctgtattcttactcactttttcaagttatctattttgttgcataaactaattgttaactattcatggaacagcaaacgcctgtttaataaagaactttgaccaaggctataaatgccacgtacattattttcagtattgttggttatatttaaattttccttacaataaagcacacttttataataaaatacatgaattattgtttttcatacttttttgcttgtttctttaaagttttctgacgtgcataatgcataattcattgaaaagcatgatagcaatgtggcatgtggaagcgaacccccagggcataacatagtaagaaagtatggttctgtatggcaataggtttttaaaattattagctattcatcatgtgtgggagaaataattgtggtgtgttgcagatttatttggccatttagaataaccaaatcaatctggctaactaggaatttatgtgtaaaattatctgattaaaacagctcaagtttga

SEQ ID NO: 744 - DNA, 90582 bp, Homo sapiens
aacagtgagatccacctttattgaaacatcacacggcagcatcagggctcccacacctcacagggcagcaggcagttcacaggacagcaggcagttcacagggctttgggggcctcacagggcagcaggtggttcacagggcttcggggggcctcacagggcttcggggggcctcacagggctgcagggggttcacagagcttcaggggcctcacagagcttcaggggcctcacaggactgcaggggggctcacagggccctgtatgcagggctgctggtacaaagaagaggcccagagaaccctaacacagcctggggccccggggaagtcagggcttccagcagggcaggtacagaggcccctaggacttggcaggagcctcagccttggggacagtcccacggaagacgctgcatccgggctctttagcagaggcctctacccgtcctggtcagaggagccctcagacagttttgggaaagccagactggggtgtcgatgccgcagtgaggactcgtcctcctgcaagcagaccgcatgttccaggtgaggaccaggcagggcaggggctctgcagcgctggtaacccggtgggaccacagggagggagtggccggcacagggccaggcaccaaggctcagctgtgggcaccaggtgggaccatgcccagctcctcaccaagtctgagccctgctgggctgaggtgctctggaagtctgcgtatgcatccctggggacgtccagcagctcctcctcgtactccgtctggtagtcagattcgtctggcaccgagggtagggctgcgtcagtcccctcccaaggaagggaccgtacccagcatagccacactcagaggcagaaccggccacagatgcccacccccgcctccaaggtggcccggggccctacacgcagccacctggtcccagggcagccctgcacaccacccctggttctgtctggctccagctttgccccagcacatcacttcgtgggtcttccacaaggacaaggagcgggcagacactcctccccttgtcagccaagcaccctgagggctccagcaccccagacctggcaactgtggataggggctgccttgcccagggccctctcggcctgcggcagccatgaagacgtctcccaggagaatgtccagttctgctgtgaggaggccactggctgaaggcccaagcgcagggccctggatggagcatggagggtagtggacccgcccttcttgtcctgcggcccctccaacaagcagccttcattcccatttcccactgggtggggtgggaggcaaaacgtggttctacttcaggcctgaggtgtggctgggagttgaggtgaatgaagggcaggggctgggtgacccggggtggtcacagtcccactgctgtgggaacacgtggtgcccgggacggaggagtgccaccaagcaccccagctgctggagcctgggcgtggacgtgggcgggaggggaggccgtgggcctctggggtgggggggttcaagcccaacacagcatcaggaggtcacgcacgtctccacggcttcgtcttgcgcctccactcaccatccaccatggcgggcttggcgggctcaatgcgagacacaatttcggcaaggtccgtgaaggaggcgttgggacaggtgaggacctaggggtggggtgaggacagcacgttgcctgtggacacccgcctgccagtccccagcctgcttcctgtggggaggccccacccaccctgcgccctctctgcagcctccgcctgccccccaagtaagggcagggaccggggagatgcgcagtcctgagcaatccttgtcctggccctggagtctttggccaggggggcagggcctgtggcctgaggagctgggcgtggcctgatgaactgggcgtgggcgtggcccgaagaactgggcgcggtccggggagctgggcgtggtccggacgcccgtactcaccgcactcgcgggcttcttgctcggcccctgctggtcgcggagcatcttctccagcacgccgctgcggccccagatgtcaaacaccgtgcgcccgtgctggtagcccacttcctgtgcacacccccagggccccgtcaggaggtgtggggagccccccacttcctgtgttctcaaaagggggaagcgaggaggggcagccaccagagtgcctccgcccgcctccgccgccgcgggtggccggcactcacgcagatctcgttgaacttgccgaagtccagggtgctgtagctgtcgatgggggggcgcaggtactcgcagtagtcactgctcttcaccacctccagctgccgcacgcaacacacgtaggccaggcgcgtctgaatctctgccatgttcaacacctgctgccgtcacagccgcctgagtctcctgccccggcccctaccccgtcccagcctggcccgtggcgcaggacaggttctggggacccatcctctggggtaggtaggttctggggggagagggtagcagcacccggccgggggtcctccctgcgggctgccacagccttcaggcccgtccggcctcgtgccttccttcgcccgagttgggctcaggcaggggtggtgaggggtggccccagacctgctggcctcagagcccaggagcgacccccactcccctgccgcaggacaggtgtggagctgcagggaggagcagcagggacagcccagcctgcccggtagcaccccaccttgactttcgtggccaaggggttccagcgtttccacagcagccaccacccagacagcgcatccccatagttggtgaggtccgtctcatctcggctgcccacgtcaatggcgatcaccacttttgcccccatggaccgggccacatccgctagggagaagccagccctggttaccccctggacaggcatgcagagccaggggacgggggcagagcctgcctctccgagccctgacgtgggggttgtggggtctcctctccgccattacaccttctagaggcagaagacccacatgcccagctcgatgggcagctgtgggcacacggctgtgtcctgggcctttctgaccgtatatcccacaggtgacaggagtggcctggcctggcccccagcaagctcgacacctgcaggctgttagtttctgactgtgggcacagatggggcttaattgctcccagttcctcgacttggcctttgttctgcatgctgctgagctgacaaacagggccatatgctggagcacatgctgccggtgcctgcgtgtgcatgtacacgcgtgtgcatgttctcggagctctgatgccagcctgacattttcccttggcatactctaaggaaaacgtgttccagcccaggcttcttggagcggaggcagctgtggcaggggccgtggggcggcgtgacccaggagcctgtgctcctgccgggcgtggtccccccaccgcagtacctgggaggttgttgatgtagcccccgtccatcagcaggtgtccgtccttcgggtcacagagagggggcatgtaaccggacagggacatgctggcacgcacgtaccaccacagggagcctggggagggggcccggagctgctggttacccggaggaggctcctcctgggtccagggttcagggccttgccactgcagtcctggagctggtaggtcccaactctctgaggccgcctccacagagggaagctcatggcccaagggctgaacaaaattgagttctttctctggggtcgcactgcattacatgtgcccaggacttcgaactgctgtgaccccctcaccccaggactgagggagcccctcaccccatgaccgagtgaacccctcatccccctgaaccaggtgagcccctcaccccaggactcagggagcccctcactttgtcctctcacatggtatccatcagtctagcccaacattgctgattctgtgagggtctcctccagccttctgaggtctctggcccaggccacgccccctcctgtctgtgcccctagtaggggcatcctgtgtcctccatggacaaagctgcccatacgtctgcatccttcaggagaccccgcggccttcccaacccctggggctgctgagctctccccctgcccacacctcgcacccaagcggccgccctgcgcagcaggagtgctcaccgtcggtgtggacccgcatggccgaggctgtgatgtcggtggtgatggcgaaataaggaatccacaggtcctgcgggcggacggggctcagatgggccctctcccatcacgctcctgtcctgtgtctggggaggctgacccagggccaagaggtggggggccaggaggggacaggcactgggggctgcatgggctcctgagggtgggggtgcacctcgatctgctggtccttgaagacgctgaagatgctgctgttgaagccggctccggagaacatggacgtgatggggtaggtgaggtccagcgcggccttcatcaaggacgtcatgccctggggccacatgtggaatttacagaaggcttccaccctccctgcgggctgccacagcagacacgtggcgtgctgagggcctctcatgaatggaacgggggtccagagtgtccttgggccccacccacggtcctgaggcttggcgccctggctggagcctcagagtgagcagaggctggtggtcgccccagggcctgaaagccaggacacagcccaccctcggtcccttcctgatccctaagccctcgctggccctaccctcgcaggctctgcagcgcccccatgcctggggcctcctcggctttgcctgctcagctctggggcaaggcctgcccatgcccgtggctggagggtcagcgaggaggagagctcggggcgggctgctgggcacatgaggttcctgggccagggggacacagtggattgctttcgggaaggtcagagccacccagccctggctcacatgccactgcggtactccatcaggggtcccggggaagccgggctctcttgggttccttctgggtgggcctggggcccatccttcctcagtgaggcaggcaggactcgagactgacctcaaactagcctcaatgcccagtgtggatggagaggaagggtcttccctgccatagtgagccagggctcaggggacggaggctgggagggaagcgcttggagtgtgggctggacgtgcttacaccgtgtgatgcaggcagtgagaacgcctcggccacaggcagaggagaccccggtccttccctgaggaagcccctgcccagtaccagaggggctcacagagataagccagaccacacgcccactgtcccctctcctcagcatgaggggcaggcacacagccccggcctcaccttgccccggccagttcccagggcccagtgatcccagcacggaaagaggaccagcccagagagctctggccattcccacacctggccccccagccccagacccacagacggagggacagggagagggccaccaggtgactctgggacaggaccggctcggagccacctctgcccatggcgggttctgtcccgaggacgctgtccctggggccgtcctgctgcatgccagtccccaagccctcttttgagcagccacgctgaaggtgactaggtgactcattttagggaaagaaacatttctgaacagagaggggagaaggtgtcagtggccttgggactcgctgctggggctggtggcagccccgggccacgtgaatgcagcacaggcctgcttgggagctgctgccgcacagggggtgacgaattttctttccttttaaaaggagaacacgaacccttctgatcccactcatggctccaaccaaagctcggttttgttccacaaaagcaagcgcagcgctgaggagggcagacggtggccacgtctgctggggaacggagcctggctgcctccctctgctgcccgaggggagcctgttctcactgttgtctttgattctgtatttggtattctgattctggaatccatttatcacaaggccagactagtggccaaagtagtttacatctcccccgtgacactgagccgccctgacctgatctcacatccccacgccaacatctccctgccctaaatcaacccaggccgggtgccatgcaccagggacagccccacggcccccagcgtgcctgaaggactcagtcagcccatcctcagctgctcacgctgccctgcctggccgttgggtcagaaacccccatggaggctccatgcctcttattcccaggggctgtaacagtcagcttcttttccacaatcctggcatccatgtcatcctgcagccacctccaccatctcagacccgggcacggatcagaccgcctcccatcgtcaacctccaccaactcagacccgggcacagatcagaccacttcccaccaccatctccaccatctcagacccgggcacggatcaaaccgcctcccaacaccgtctccaccacctcagacccaggcacagaacagaccacctcccaccaccacctcgaccatctaagacccgggcacagatcagaccacctcccaccaccatctccaccatctcagaccccggcacggatcagaccacttcccaccaccacctccaccaactcagacctgggcacggatcagaccacctcctaccaccatctccatcacctcagacccgggcacggatctgaccacctcccaccaccatctccatcacctcagacccgggcacggatctgaccacctcccaccaccatctccaccaactcagacccgggcacggatcagaccgcctcccaccaccgtctccaccaactcagacccgggcacggatcagaccacctcccaccaccgtctccatcacctcagacccgggcacggatcagaccacctcccaccaccgtctccaccaactcagacccgggcacggatcagaccacctcccaccaccgtctccaccatctcagacccgggcacggatcagaccgcctcccaccaccgtctccaccatctcagacccgtgcacagatcagaccgcctcccaccaccgtctccatcacctcagacccgggcacagatcagaccacctcccaccaccgtctccaccaactcagacctgggcacagatcagaccgcctcccaccaccaacctgcatctgtgccttctctgtggtgctcctttgcctcacaagctgcactgggaggcttcagggggtagcctcctcgagggcagggccctgcagagccacatgcagaggccaacggccccagcgtcccccagcaccagcaaggacctgggggctgtgctccggtgagggtgatgggtgcctgcttacctcggcccactgcttggcccggatccgcatctggctgtagttccgctcctcagagtacagggcacccacgaaggccccgatggacgtgcctcccaccatgtccacagggatgccgcactccgccaaggccttgagaacgcccacctgggcacagcctctacaccagccagggacacagagcaaggagtgagtaccaggcccaggctgcgccctgcagaggccttgtgctcatcctcagttcccaactcctccacaggcagagacgctgacgcagagagggactccagatgcagtttaaaacccctctttccgggctcacgcctgtcatctcagcactttgggaggccaaggcgggcagatcacttgaggccaggagttcgagaccagcctggccaacagggcaaaattccatctctactaaaaatactaaaattagccaggcgtggtggtgcgcgcctgtaatcccagctactcgggaggctgaggcaggagaatcacctgaacccaggagacagaggttgcagtgagctgagatcacaccactgcactccagcctgggagacagagtgagactctgactcaaaataaataaataaataaattaattaaataaatgaaatccttccttctggaggtactgagggactgtgaggctgggatggggaggaaggtgtcctgagagttgaccggcattggcctcttctacccggaaacacggctgcctccagcagggcgtctgagaggtggtgggaaaactggacttgaggggccctggaagggaggagcctgggaagcatcctgaggggcagcaccccaggagtcagatgagctggatgtagaccagcacccatgagaccagggagcacccccgagaccagggggcacccccgagaccaggcagccggcacccagggcctctaattgctactgctgctttcatacagaatgtccaccactcaaccaaagattaccagtcatatgagaagaaaagcctcatataggctttccttttggcctcatagccaaaagaaaaaacagacaatgaaagtgggcccagagtgcctcccaggtaagagatacagacacaggcttttacaatgaccacgcttaaagtgtgcagggagccaaaaggtggcaacagctgatgaatgggtacaaagtagacaagggaagagcacccagctctaaggagggagctcggatgcaagccacagctgggggggaccctggaggcatttgctgtggtttagctctctgtccccaccgaaatctcatgttgaattttaatcctcagtgttggaggagggacccggtgggaggtaactggatcatgggggcagatttgaggtgggaagacgtcaaaggctacactgagctgacgtcacaccactgcactccagcctggactggagtgagaccctgtctataaaaaagttctggaaatgaacagtggcaattgttcatttcacgacattgtaacaacattgtatcattaattatattaatatgatatattaatacttaattggatactcaaaaatggttaagtggtaaattttatgttatgtatattttaacataataaaaaaaaccatatgtaatactgccacagaatattactcaggtataagccttaaaaacaagttcaagttgggaggtggaggttgcagtgagccaagatcgcaccattgcactccagcctgggcaacaagagcaaaactccgtctcagaaaaaacaaaacaaaaacaaaaacccaagttcaaggaattaaaaacaagagtgttaattctggcataaaaccaaatgaaaattctagaagtgaaaaatataataacaaatgaaaagctcaatgagtgggtctaacggcagaacagaacagctgaagagagaaatggtaaaatacaagatgggtcagaaacagtcactgaatcatgaagcatcaagaggacagaatatgtaacaatattgttttacaaaatctgtaagggagtttaggaaacatgggatctggcaccaaactctaatgtatgtgtgatcagagccacagaaagcagacagggagggagctgtatctgaagagacagtgtggcatgttctacagacagacatcaggcctcagaatcaggaagcatgataaatcctaacataaatcaaaagaaaaccattctcatgttgtcaaaaacccaaggaaagaaaaaacctttaagcgagcctgagaaaataaaagatgcgttaccttaacttttctatcctctgagtggttgtgagagagtatatatttactatctgtttctttatagacaatgtctgctcgtctaaatgttagggaaaaaagaacaacttaaataaaagagtaaaattaagcaaataacaaagataagagcataacttaaagagccaaaaacaaacatagagaagattgacaaagatgaaagttggtgttggagggaccaattcgacggacagcccgggtgaagccgatcaaggaaatgaaagagagaaagcatcaatgatgaacaggaaagaaaatgggaacattggtgcagatgctttagtttaaaatactgaacagcttcatgccataaatagaaaaattcagataaaatgggcacatttttagaaaaacctaactcaccaaaataacataagaaatagaacatatgagtagtactgtaactcagtaaagattaaataaatttaatctatttattttttatttttatttttagacagggtctagctctcacccaggctggagtgcagcggtgtgatcacagctcactgcagcctcaacctcctgggctcaagtgatccccctcctgcctccgcctcccaagtagctacgaccatatcacacccagctaatcttttcattttttataaagatggggtctcactatgttgcccaggctggtctggaactctcgggctcaagaaatcctccctccttggcctcccaaagtgctgggattacaggtgtgaggcaccgcgcctggcctcttggaaggttttatgtaaaatttgttttatttattccttatacgtttcataaaattcaccagtgaaaccatctggatatgaaactttctttgtggggatttaaaagttacagattccatttctggctgagcgcagcggctcacacttgtaatcccagcagcgagctgtgatcacaccactgcactccagcctgggcaacagaatgagacactgtctcaaagaaaataaataaaaataaaaaagtaaaaataaaaattttttaaaaaccttctagagaataggaaaagaagatgaacttcccacttaagcttatgaagccaacaaacaaaccttcataccaaacccggtaaagacatttcaaaaaaggacaatttcagtccagtcttactcaggtttgagtagaatctagcaatatacaaacaggataactttaacatcaggacgaaatgggtctgtcccaggagcacaatgttcattttaatttgaaaatcaatgtaattaacacattaacagattaaagagaaaatacaatcatctcgatagagtcacaaaaaccaccattcatgatttaaaaaactcaggaaactgagaataaaagggaacttcctcagtctgaccaagggcagccacaaaatgccaacagccaagatcacactcagtggtgggctgaacacctgctcccgcgcctggaatgagggttgggtgtctgcgcccaccacgtctatccacagtgcagcggtggttcccaccagcacagtaaggcaagaagaagaaacagaaagaacgtacatatgcatattgtacaggaagagaaaatactgttttaatctcagaaaatttaactatgtgtctagaaagtcaaaaagaatctacaacaaagctacaagaataaatgaatttagcagggttgtaagatataagatcaatttataaatatcaattgtatttctatatactggcaacaaacaatttgaaaatgaagtctaaaagataccatttatggccgggcacagtggctcacgcctgtaatcctagcactttgggaggccaaggcgggcggatcatgagatcaggagttcaagaccagcctggccaagatggtgaaaccccgtctctactaaaaatacaaaaattagccgggcgtggtggcaggcacctgtaatcccagctcctcaggaggctgagacagagaattgcttgaacccgggaggtggaaattgcagtgagccgagatcgcgccactgcactccagcctgggtaacagagcaagactccgtctcaaaaaaaaaaaaaaaagataccatttataatacttttttaaaagcctgtaaaacccttagaaatatagttaacaaaagatgtgcaagacctctacactgaagaccgcaaatcatggctgatcataactacagaaggcctaagtacatggggagatctgtctagattgtgggctggaaggctcaatgttgtcgactaatgatgtacagattcaatgtattcctccatccaaatctcaggaggttttctttttggagacactgacgagctgattttaaaattcacatgcaaatgcaaagggcctaggacagccaaaacaattaaagaaaaatggaaaatggaaggaactagatgactcctcgatgccaagactgactgtgaagctacagtaactaaggcagtgtagtattgtcactaaggatagagaaacacaccagtggaacccagcaaggtccagatgggctcacacctgcagggccactggcactaaggatagagaaacacaccagtggaacccagcaaggtccagatgggctcacacctgcagggccactggatctgatggaggcctcagcctcacacctgttgggccactggatctgacaggggcctcagcagttcaggagggagggaaggtgtactcatccattttcattctgctctgaagaaattcctgagactgggttatttataaagaaaatgagatggaggctgggtacggtggctcagcaggattacccagcacttgagccactgtacccagcctaaacctcattttctttataaattacaagcctgtaatcccagcactttgggaggccgaggtgggcggatcacttgaggtcaggagatcaagaccagcctggccaacatggtgaaaccccgtctctactaaaaatgcaaaaattagctgggtgtgctggtaggtgcctgtaatcccagctactcgggaggctgaggcaggagaatcacttgaacctgggaggcggaggttgcagtgagccgagattgcaccgttgcactccagcctgggtgacagaatgagactccatctcaaaaaaaaaaaaaaaaaagatttaggccaggcaaagtggctcatgtctgtaattccagcactttgggaggctgaggcgggcagatcacgaggtcaggagtttgagaccagcctgaccaacatggtgaaacccggtctctactaaaaatacaaaaattagccgcgtgtggtgccacatgcctataatcctagctactcaggaggctgaggcaggagaattgtttgaactcagaaggtggaggttgcagtgagccgagattgcaccactgcactccagcctgggcgacagagcaagactccgtctcaaaaaagaaaaaaaaatggtttaatggactcacagttccacgtggctggggaggcctcacaatcatggtggaaggtgaaggaggagcagaggcacatcttacatggtggcaggcaagggcacatgtgcaggggagctgccctttgtaaaaccatcagatcccgttagactatcacgagaagagtacaggaaagacctgcccccatgattcaattacctcccaccaggtccctcccacaacacatggggattatgggagttatagttcaaggtgagatttgggtggggacatggccaaaccatatcattcagagcaaccagacaccacatgggaaaagtgaactcccacctcacaccagtcatgaaaatcaatttgaggtggctcacagacttaagcatacaggatagaatagaaaatcttctagaagaagatgaagagtacctctgtgaccttgggataggctgaagctctcagaacactggaattaataaccataaaaaaactggaaaatcacacttcaaaattttaaatggttcatccaaagatgccattaagaaaatgagaagaaaagccaagactgaggacaatatcagtaataaatgtatctacaaaagactcgtgttcagaataaagaactccttcgatacaatagtaaaagacaaaaacctattacaaaaggaataaagaacttaaatggatactccacaaaagaagacacacaaatggccagcaagctcatgaacaggtgttctacgtcatcagtcatcggagggatgcaaattagaatcacagtgagacaccactgcagaccattagaatgggcaaaatttaaaatactgccattaccaagggtcggtggggatgtgggtcactcgaactctcagacattgctggtgggagtgtaaaacaatacaactgccccacgaccgggcacttacactcctaggcatttgcccaagaggaaaggaaatgtgtccacagaaggatttgaacaagagttggggctgggtgcagtggctcacacctgtaatcccggcactttgtgaggccgaggtgggtggatcacttgaggtcaggagttcaagacgagcctggcccacatggtgaaagcccgtctctattaaaaatacaaaaattagctgggtgtggtggtgggtgcctgtaaccccagctactggggaggctgaggtaggagaatcacttgaatccaggaggtggaggttgcagtgagctgagattgcaccactgcactccagcctgggcgacaaagcgagaccccgtctcaaaacaaacaaacaaaagaattggtgataacagctttgtttgtaataaccaaaaccagaaaaccaaccaactgtgcatcgacaggaagggggataagcaaagcgtggggagggcaccatggaagctggcccggcactgccactgctgagagtcaggagtgcagacaaatctcaggcacgttatgtcgcgtgatcaacgccagacaccaacaggcgcctcgtggaaaatctgagcaagcaaggagggcacaaggaaggcgacgagcattctcaggagcgcgaggcagccctggaggacaccggagtgccgtggggaaacgcacgcggacctcagagatgttttagcagaaaagatcaactgcaagtacatttgagaaaaatcttccagaaagtggaacagaaggacagagatgaagaataggggagagaaaagactaaaaattagaagatccatctaagatgccccaaatctgaccatcagaagctccaggaaggctgggcgcagtggctcacgcctgtaatcccagcactttgggaggccaaggcaggcggatcacgaggtcaggagatcgagcccatcctggttaacacagtgaaaccccatctctactaaaaatacaaaaaaaaaaaaaaaattagctgggcgtggtgggggcgcctgtagtcccagctacttgggaggctgaggcaggagaatggcgtgaacctgggaggcggagcttgcagggagccgagccgagatcgctcactgcgacagaacaagactctgcctcaaaaaaaaaaaaaaaaaaaaaagaagctccaggaagagagaacacagataagagggaggtaaacattttcatttagaaaaattaaaaatttcccagagttgatgtctgtgagtttccaaatttgaaagggtccactgggaatccagtgtcagtggatgcaaaaagagccacatgaaggcccatcatgcactttcagaataccaagagtgcagagtctcaggccaggcacagtggctcacgcctgtaatcccagcactctgggaggctgagtggggaggattgcttgaagctgggagttgaggctatagtgagcttatgattgccactgcacgccagcctgggcaacaaagcgagaccttgttttgttttttgtttttgttttgagatggagtcttgctctgtctcccaggctggagggcagtggcgcaatctcagctcactgtaagctccatccccccggttcacgccattctcctgcctcagcctcctgagtagctgcgactacaggcgcccgccaccaagcctggctaattttttgtatttttagtagagatggggtttcaccatgttagccaggctgctctcaaactcctgaccttgtgatctgcccaccttggcctcccaaagtgctgggattacaggcgtgagccactgtgcctggctgagaacctgttttttttttaaaaaaaaagaatctcctacgaggttccagaagaaaaaacggccctgtgaataaaaatagcattaaatttctcaacagcaatacaaaaaactaaaaagacaatggaaccatgccttaaaattctcagggaaatttatttccatctagaattctatacccagccaaactatcactgaagtatgggaatagaatgaggacacttgctgatatgcatggtcttaaaatgtttacttccccatgcgtcttctcctagggagatttctagaacatatatccaccaaaatgaggaataaaccaataaagaagacatgaaattacaggaaatggaattgaacacaggagagaaacaaaggcagtttccagggtggtggtgaaagaaaattccaggccaacatctcagcagcatgttagaaaacaaccagtagagatacgaagaggctagagggctttcgggaggatgactcctgaaaagtaaacagagatgagtggtatgtccgaacataccgagaggaggttaatgcctgcctcagtgtcttcgggtaaattaaggatacccagaaaactgaacaaatgtgacaattattaactccaaggaaggaacttcaatcataggataggataggatgtgacttagttctgagtgacacccacagtgtcataacaacacagacagtgagtgctggctaactagtgatgggaccacactgggattgagtggaaaggagggagacagatgcatagatgagtgattaatcaatagttagcagactctgattgcgggtgttgaagggggttaagaagtcaacaatctaaaactaaaaaaaaaaccaaaaacttagtagaataggaatatgatttagaaatacagacaagcagacagctcaaaacactggacatggttatttctgggataactctggaggtggtgctggaaggaaggcaaaggactgcagttacgtgccttacagaaccgtatggcttctaagtattaccttgatcaaagctactttctcattaaaaatgctgctgatgtggcctgggctcaactgctccaagtccctgcactgtcccagacccacagaaagagacttgggtcctgtccccagcctggcaacctcaggcaagccattgaactgctgtaggccaacttccgcagctttcaagagaaaatgtggcacaagacaaggtggaaagtcccttagacagaaggatgcagtgggcacctcatcacctagaacagccccaggctgacagggccctgccctggggccagcagaagcatcctcgaggccctggggccacctccgagcttttcccggggtagcagtgctggcactccgtgggagatgggaggggctgccggagaggccccaccccagaaggcagccctggcctggacccccgcccaggcacccctcgatgtcctcccttcctttgggggcagcggtaggaggctccgccctgccccttacgcacctggctcagcagaggggcacatgcctgtcccaccctcctcgtggctcccaggctccatctctgttccaagggtatttattcaagttcaggagaaggtggtgtctgacgacaaggcaggggaggaggtatctgggtttaaagtccctgaaggactcagtttgggcaaagcagatcattctttatcaagtattggagtgaaggaaactcaccagatgctgggaaagaccggctaaggaaagagcagaggtttcagaggaggaggtgcaaagggccaacaagcaaccgcttctttttttttttgagacagagtctcgctctgtcgccaggctggagtgtagtggtacgatcttggctcaccacaacctctgcctcctgcattcaagcaattctcctgcctcagcctccaagcagctgggactacaggtgcgcgccaccacgcctaatttttctatttttagtagagactgggtttcgccacgttggccaggatggtctcaatctcttgacctcgtgatctgcccgcctcggcctcccaaagtgctgggattacaggcgtgacccacgcgcccggcccaagcaaccacttctaagcaaagacagtcaaaacgagatatgtcttctactaaactggccctaataaaaccagggccactttgggtgtcagtgggcacaccgcatgtgccagggtctgcagggcctgctcagaggacaggccggggtggaggctgggtctggacaggcggcctgagggtctcgtctgcgggtgacaccccctgtcccccgcacccagcacctcctagcacccgagggggcgactgtcaccacacacaccagtgaggagtgtgtaggaagcggggggactcaccttgctccccctcccccaagcaccagggcaatggcgttgcccgtcagcaccctcgccaggcgggagaagtctgagtgtcggtccgggggccgctggaagacatgcttgtacatctccacctgggggaggagccgtcaggcagggctggtgcagggccccaccctcggccgagacctcgcatcctggcttgactggggggagtttcctccacttctgacccaaactgaccccaaatcctctccagcatgcagcaggccctgcctgatacgactggtcagcacctcagtgcccggaccgggccccagagacagctcagctactggggggaggacactggcagagggtacgtgggcaagagagtgggcccgggtggggggccagagagtgggcccgggtggggggccagaaggcatcctcagagctgttcccactggggtccctctatcctgcagcagatggtgccttcagggcgtgggtttctggacagagctgtgggctgggggccgtgagcatgagcagactccccacacccctcactctcaggcccctgggctgcctgaggacaccggaattaaaagtctcagggccttctgcccaaaggagggagcagcgctggcctgaggacaccctcatcagctggatgtgggggcctcagcctcagccctgagcagccctgacatgaggcccatcccccagggttcactgagcccccctgacgtcaggcccatccccagggtttgctgagccccctgattcaggcccatccccggggttcgctgagcccccagcccgatggccgccctgtgcctgcccccactgcaccggctgcttcctagccgtggccaccagaggcccaaagggcaagatgaaggagacgtgaggcagggtcacgttcacaagcacaggaagggcccaggagcgcaggtgtcagggaatcaggtggggaatgtgaagaatgcttcgaacgttcgaggaaatgaaccacggagccacgggcaggcagcctcctctccccgcctcaccagcttgggcaggctcctcctggagaagacgcggcgcgggcagcagaggtgcaggtggccggagcaccagctccgcatgttgagccactccacggtgcgcgctggcgccgggccctcctccctgtgcagcaggatcagctgcttctgggcacgcacagctgtgctctccagcatccgctccagctgaaaggcagagcccacgtgtctgccagccgggtgagcctgggactcgggacaggacggagctgaaggccagcacagagggtctgagggcaggaccccgggagcagctcctgggttctgcaaagcaacttggctgtggcctggtctgccttggcgctgccgaagctctgacggcaggggtccatccgtccactgtgtgctgggcaaggtcagtacggcaggagggggacgcctcctctttctgtttctctaacactgcctcataaacacacacagcaacctttccaaatgaggtattttgcaaacaaactctcacaagggagcatcactagctgcagaacaggaacatacatcagagaggaggaatttttagctgccccaggattagcccaggcaggcttgtgatgagaacagagcagggagcagaggagggagacgggaaatgcaaactgaaggcaggaagctggagaacacgaacaggactgggtggccatgagcccgaggcctcgcctgcagcaatggccaggtggaaggaagcaatcaggtcagtgatctgctgccatctgggaacctgcagacacagcctggggccagcgtcccgaaggtgcctgcagaaggctgttcctgttggctgaggatgcagaggcagagggtaaggcattcacaagaggaaaactaagcagccagaaaaagcagtgagaggaacaggaacgacgccgacacctaagtgctgtggagaaaagcaaacttcagatgacacaaaatagggcaccgtttacgtaaaaggttagtcctggaaaaggcttcccgcacctgctgtaaaagtgcgaaaggcggccggaggctgcggcttcacaagaggccacgtggggcacctgccctgctccgtgctagaacccctggaggtcaatacagcaccgtgtttttaaaacatgggtagcagatatctgagtgttggctcttatcatctgtctttttctgagtttgtgcagtattttactcaaaggaaaagagaaacaggaggttctgaagagagggctctccccagctccaccggccctccccgtgctcacctcgcccactgtgggctcctggtcacccaggcccacgatgaggatgcagtcggcctggcgcacgcagcgctgggtccagggtgtgagcgtgccatctacctggtagagcacgatcctgtgggtgtcctcctgctgccccagccagctggacagccggtactcgtgaacactgcagcacgcagagggagtacctcactactccgcaggggcctggcactcttagcacatgtccccggggcaaagaggcagcagaggccagcaccagccgctgccccttcccctccctgcccagcacttcctgccatcgctagttcgcagtgagttattcagggcctaggcagtcacgcagaggctgcagttaagcccagaggctgaggctcgttgaggggcaggctggggagagtgagacccggggctgcccaggcgggaagcgggggctggggtcccctgggaggcctgacagtgcccagcaggtcagcgctgcccagtgtgtccagtgaagggagtcacgtcatcagccctcacaccacagtgtgctggacgaggagcacgctgcagtgcagatgctggatgtggacacagtggggacacatctcagggctgcgttgggccggctgggaggaaggagtcggggctggcggcacgcacctgtccagggcagcggagccaaggcgccgttttatgttgtcactagtcagcagcagggtcgggcctgaaaacaccaccaccagtaacggagcctgcctgggcagcccacctccaacgccaacaaggcaccgacacccagcaaggtaccgacgccgagccaggcaccgacgcccagccaggcaccaaggaggaggaaggcagtgagagtccactccccaaccccaaggtctgctccccttgagcacaactgccaagccttcttcacctgccagtggggaagggcctgtggcctgatgctacctcccatctgccctgaaggaggcctcgggtagcctctctgagcctcggtcccctccagcacgagcagcagtggaatctctgtgtcctgccacgtgtgcagggcagggaaggctgtgcgatgggagataacgtaatttccaaaacccagatcatcgaggtgccagacgccaagaggccagggtccccagtgttgacatgcctgttcgtatgcatcttccacatgggcacggctgtcagggcccttctcaaccaggggcgccagtgtcagccctggcatcacagccaccagaggctcaggggagaagctaagatgaggggctcagcctgagggggtgctgcttggcagtgccgggtgggaaaggacccagagccccatgtgtgggaagcagggaggtctaattctaattaaaagctagagatcggctgggcgcggtggctcacgcctgtaatcccagcactttgggaggccaagggatcacgaggtcaggagatccggtgaaactccatctctactaaaaatacaaaacttagctgggtgtggtggcgggcgcctgtagtcccagctacttgggaggctgaggcaggagaatggcatgaactcgggaggtggagcttgcagtgagctgagatcgcgccactgcactccagcctggacaacagagcaagactccatctcagaaaaaacaacaactagagatcagatcaatgtgtctcgtgccttaactagcaacatttgtttcttagaggcacacaaaataagggcccctcttacaactgaactagaatgccccctgggctcaagagacagctctgagctgaaaatccagcccaatgctggtgcgatgtgcagcagccgaaacctgctcactgctgtgggactgcagcctggtgcagcctcactggaagtcagcttggtggtttcttctacaactaaacatactccgaccacaggatccagcaatcatgctccttggtgtttacccaaaggaactgaaaacctctgtccacacagaagcacgcacacaggtgtttacagcagcttcactcataattgccaaatcctggaagcagccaaatgccctccagtagatgaacagatcaactgtggtgcgtccaggcagcggacgatgactcagcaccaaaaagaactgagctccaggccaggaaaaggccaggaggaactttgcgtgcacgtgactgagtgggagaaggccgtctgcagaggctacaccgtgtggttccatttccatcactttctcagaatgacaaaattatagagatcgagaacagatccagggctgccggcaagccggggtgctgggtgacaacatggcagccacctgcagggtctcctccgtgacagagtggccccgtgtggtgcaggtcacagaaacggcacccacaccacactgcaccacacacacccaggagggcacggacgggctgctggggcccaaggggtctacagatggcgtaaacgccaacgtcccggcctcgatgttaccccctaaggcgctgcccgtgaaggagccctggcgaagggcacatggggtctctctttactattccacaatttctccgatcctataattatttcaaaataaagtgggttttttgtttgtttttgttttgacacggagtcttactctgttgcccaggctggagtgcagtggcaccatctcagctcactgcaacctccacttcccggggtcaagcgattctcctgcctcagcctccctggtagctgggactacaggagcctgccaacaagcctggctaatttttgtgtttttagtgagacggggtttcaacatattggctaggccggtctcgaactcctgacctcaagtgatcctcccacctcagcctccccaagtgctgggattacaggcgtgagccaccacgcctggcttaaaaagtgttttttaaagggaactaatttatgtgacgtgggacagctccaccgcacaactcgaagatgtttctaaagggaactagtttatgtgacgcgggacagctccaccgtacaactcgaagatgtttttggacatacctggaatactctgactgatgtcaccggaaatgagtaagattttctgcatatactgggaatatgtgtcatgtaacgacggtcaaggccatcagacaaggcaatccatgctttatgtgttttaaaattttgttttgagagtaactttcatttatttatttttgagatagagtcttgctctgtcacccacgctggagtgcagtggtgcgatctaggctcactgcaacctctacctcctgggttcaagcgattctcctgcctcagcctcccacatagctgggattacaggcatttccaccaccacgcccagctaatttttgtatttttagtagaaacggggtttcaccatgttggccaggcttgtctagaactcctgacctcaagtgatccacccgcctcggcctcccaaagtgctgggattacaggcatgagccaccgcacgtggctgagaataacttataagtattcgatgtttatagtagcatctttctatattataaattttttgaatgtattgttttctattaccaaatgtctgtatcaggagggagcattttcacatggttctgaaatactcttgtcacaatatattgttttataataattatacaacattcattgcatttattattattattatttgagacagaatcttgctctgtcgcccaggctggagtgcaatggtgtgtgatcttggctcactgcaacctctatctcccgggttcaagcgattctcctgactcagcctccccagtagctgggattacagatgcgcaccaccacgcccagctaattttcgtatttctagtagagatggagttttaccatgttggccaggctggtcttgaactcctgacctcggcctcccaaagtgctgggattacaagcatgagccaccgcgcccgaccgcattcattattattgcattattttgccaagacaacactgaaatttttagcataaccttaaacccacagaaaactgacttcctgtctatcatcatggtccctatcatcacatgaaaacttgtaaataaaatgttgcaaagaatatagaataacttagaattttgagagttctcaggaaattcaattccttgcccttgaatccccaaatttaacagctgccagcaatttggaaacactaccgaacactgaccccaactgagccctgcccacccaccgccgcgtcccctcgaagacagagggcagccggcaggcgccctccaccaggcccagaacccaaggatggctggaggctgggaggctcaggcttaccgatggcgctgagggcatgctccagctccagggcgaaggcggtgaggggcacttcctctgacacgggcatcactgccaccgtggacaggttgacagccgggttccccaagtcccacttgctgccctccgtggggagcccaagctggtggcctgtggagcaaaggacccacgtcagctgggacagcccacacgctcacagatgcctccagatgccctggggccccccgaggctgcacaggagcaacgcagcagcaccagaggccgcctggccctcccgcctccccagtcctgaggctgcctggccctcccgcctccccagtcctgaggctgcctggacctcgcgcctccccagtcctgaggctgcctggaccttgcgcctccccagccctcaggggctgcctggacctcatgcctcccccaaccctcagaggctacctgggcctcacgctgtccccagccatgtggctgcctaggcctcacgccttctccaggccggaggctgtcttggtctcacgccttccccagctcttcctgatgagctgccagtccacacctgcaagcgtccccaggccccacacagcaggtctgaccagcactggtccaggcccaggcccagggagtggattcctcctgacccaccaaagacagtgattcacggagcgactgaaaggaatgtgaggctcagagtaaaccagacaaacgctgcaggtgaggcctcatcggagtaaaccagacaaacgctgcaggtaaggcctcactggagtaaaccagacaaacgctgcaggtgaggcctcatcggagtaaaccagacaaacgctgcaggtgaggcctcatcggagtaaaccagacaaacgctgcaggtgaggcctcattggagtaaaccagacacactctccaggtgaggcctcatcggagtaaacaagacatactctccaggtgaggccttatcctctgaaccaatcgtcgcagggctttccaccactcactccaggaacagtaaacaacacacgggctagacatcaataggcccgtttctcttgtctgtcatctgcaagggattccagaaaccaaggaagcacagcgcagccctgggaagcctgggccaggccctggagaccccggagacgcgagtgagggtgtcaaggcagaccaggctttcctctccctgagactggagcctccagggcccaccaaggggcccgcccagacaggcaggaccctctccctgggccccatgtgggctgaggggcccctcggccagcacagtggcaaggacatggaccagggggtctgggacttgagagtcccccagagggtcccaggccctctttactggatgccgtctggcgagtggcatctctgcttccacagaagaggttgaggggacggcctcactgctcctgaggccaccgcgccaccagccacgctcctgcccacgagggtctcctgcatctaggtgccgtggatgctcctcctctgcagtccccgtggcccagccctctcacaggctgtcccctggcctatgtctcccgtccccagtgaggtggcttccaaaatccaccagacacgcaggtcctgattggccaaggtcagagtaaggggacgcggcatggtgagggaagaggccaggagagcaagcctggggacacagaaccaagtgagggcttaagggccactccctgcagacggcggccagcggacacctgcaagatcctgggatgcacacggcgccgtggcagcactgcgggtaagagcctgtgaacggggaacatggctcggagaaccagcgcacagccggcaatcatgtgctcacaggaaaatagctgatgacgtgctgctgagcaggaaagctgcagagtggtttataaatgtgattccattattaaataaatactcaaggcctcccaaaagaaaaacacccgtacctgtatgcaggcagaaacagataaatgatgctgcccatcccacatcccgaatgagtgtccaagactcacacagccccagatcctccctcggactcggcccccacctccggccccaggctcctacccgacccaccaaagctcagtccccgccctcagtccaactcagcaccgggagccctgggcctccaccgcccagccttggggtggcttcagccgcctgcttgagaggacgctctgtgcacagtggccggagctggccttcgacgcccaagtctgcccggagccttttttgctcaaagcccctggtgcccctccccactcagaacaagccagagtctgcagcctcagcccatctgcggtccctgagagctgctggtgacccccacaccacacagctctcttcctggccccaagggtcctgacctcctcagggagcgctgccccaccacctgcgtgcccctgcccctccccccgcccttctgagccatctcttttgccttcttggtccaatttcatccctgacccaactcgactgcagctctaggagaaggttctttcctgactggcttcctgagcacggtgccagcttccgacagggcccagtgcttggttggccccagcaggtaagccagggatggacggttgcgtgctgcgcaccggctgccaagggctcagtgtccagtgcccatctctgcctggaggttgcaaagcccagctgcatccccagctgttcacagaccgcacccagcttctgccaagggctgtgaccaagcagcgctggagacgtgcagaggcatccacaccgggccctggtcgggataagcgcttggagctgagtggcccaaagtgccggcctggagtgcagggctggccaagtgtcgccgtggggctcatggacccctggaggggaccccagccctggagtaaatacccaaaccggcagccccagtaaaggaccctgcctgacgcatgtgcagctgtgtctgtgcaggaaaagaaccggggcactggcgcctcagcaccacctgagcagctgtaagagggaggcgcccacgtcttcatctcgtgcctgggggctcttaggtctttttgcagcctacacagcctttgtgataaaactccacaatgacagacaagaaaaatgaagcaaaataaaaccctccacacgtgttcctcctggcagcctctgctcctctgggggaaccagccacaccggcacggaaccggctgtgccagccacagagcctccagttctacccaaccccagctggcccccgagaggccgtcccatccagcctccacctgcctgtcaggggcatctcaggagcctgggccaccaccacaacctggcacgccctgcgaggtgtccccagcatcaccttcaccgcacgcacttcagcccctcactgcagctgagccttggccacacgggaggagcgggggactcaggcccagatgatgtgtctccgcctctaggcgctgagtggaaggcaggtggcttctataatcaggaggaaataactcccagatagcaaacaaacaatgcacacacacaccaaagtgctgctgagcacagaaagacggagaaccgcctcctcatcctgagcttcggcctgaacgctgctctcgtggtctgatgtctcgtcccgagcttcacttgcagtctgatgtctcgtcccgagcttcggcccgaacgcggctctcgcggtctgatgtctcgtcccgagcttcggcccgaacgtggctctctgatgtggatttatttttatttttcctgcagcttttccttgggaatccctttcctctcgcctctccagggactgaggtgtcagagtcctcatttgaggcggaatgggggaggccattgctagttccatatggccttagccttgggaaaaagcactggtgaggttctggctctgggccagaagggaggtggagcagacacaggccacctgtcaccagtcatgatcagagagggacagagctcgaggcagctctcgcaagactccaaaggatggagaggaaggcaggctggccggggacctcggactcatggaggaaccacttgactcaggccaagaaagaagcagagtctgcttcccagccacatggctgccacagacggaggggtctgtccctccctccccatgggagctgcctctagggacactgactggcaccaagcaagcaccagcagacatccccccccaactgtgcaccccccgaccagccagcatcctcccaactgtccaccacccacagcaggaaacctcttcaccaactgtccaccgcccacaccagcagacatccctccaactgtgcaccccctgaccagcagacatccctcccaactgtgtaccccctaaccagcagacatcccaactgtctactcactgaccagcagacatccccccaactgtgcaccctctgaccagcagacatgcctcccaactgtgtaccccctaaccagcagacatcccaactgtctactcactgaccagcagacatccccccaactgtgcacccgctgaccagcagacatccctcccaactgtgcaccccctgaccagcagacatccccccaactgtgcacccctgcagagaaagcagaggaggccccacctcctgccaactagaggtaggagatcaagaaagcctcgaatctgtaatgaagacgcagcctgtgccagggtcaggtgttcgggtctgagagctgaagatggcgcagaatgcagccttcacactgggcctgggcagcacctagtaggcagaccagggtcagttcacgttcaaaccacactccacaaacgttggccaggacatgccctgtgaatacaagcacactaacagtgaaaattgaagacttaaatgggaaccagagtctcatagcctaacactcaaaacatcaggacacaaaatccacagtgaccaggatgggtccacagtgaccaggccacatccatggtgacccagtatgccaagagcaaggaggatctgaaccagaggagtaaaaacaatccacagataaaaacgaccgcatgtcacagacggaattatttctccaggacgataaagctgttatcattaccagctagaaccagcaatcctgaacactcctgaaacaaagacaaagagagaacgtcctagcaaagaaacaggaggcacacagaagaaccaaaacacgatgacagaacatttttttaaaactctctgataggcctcaaagcagaatcgagatgacaaaaagccaaagatcctgaagatagatcaaaagaaacaattccatcttaacatcagagagagaaaaaaaaggtttaaaaaatgagcagtgccccagagaccttggggacaataacgcgaggtctaacacttgtgccactttatttccagaagaggtggaggggcacacgagtggaagaatcgtttgaagacatatagactgaacacttccaaaatgtgttaaaagctataaacctacgggtccaagacgaagaaaccccaaacaggacagatccaaagtattcatgctcagacacttccaaatcacatttctgaaaactaaagacagagaaaaacacctttttgtgtgtgtgttttgaggcagggtcttgctctgttgaccaggctggactgcggtggcgcgatcatagctcactgtaacctcgaactccgaggcccaaacgatcctcccacctcaaccctctgcatagctgggacgacaggtgtgtgctaacatgcctggatcatttttcaaattttattcatagagacagggtctcactatgttgcccgggctggtctcgaactcttgggctcaaataatcctcctgtctcggcctcccaaagtgctgggatgaggtgtaagacactgtgcctggtcaaaacattcttgaacacagctagagagaaatgatgcgttacctactggagaacatctggatacctggatccttcatgagaagcaacagaggccatgaggaagtggcacaagatttttaaagtgctgaaatactttgtatttctgccaaaccagaattatacatccagcaaaagcacccttcagcatgagggtgacatggagatattctcagattctcagatgagggaaagcaagcggatctgcagccatcagaccttctctgaaagaaccgctaaccacaattcttcaacagcaaggagacgagcccagaaggaaacctgagatgccgcaaatgaaagaagagcaggaggacggtgaccctgggtgaacatcacagactattctcctaagttttaaaaatcatgtttgatggctgaaagcgaaagttgtagccctgtgtttttggggctacagtttgacaaaattacagaggtaatagttaagacaaccacatcataaagggggaaggatgaagtgactgaacaatggtgagctctccacattccacttaaagtgctgagatgtggctgtcagtagacaaggataagttaggtatggataacgtcatcgctagagtaaccactgaaaatgtcacatgaagagacatcatggaaaccacagttgataattataatggaatactcaaaaaagttcaagtaacataagagtagacagaaaagctgggcgcagaggctcacagctgtagtcccagctactcaggaggctgagggggggggaatcacttgaccccaggagttagaggctgcagggagctatgattgcacttgtgactagccactgcactccaacctagacaaaatagcgagaccccatctctaaataaaaagagaaaatacagtagtgtttaacaacagtggggggcgtgagaacagaaaaaacaacaaaatggaagacgtaacagaataattacactaagtatctacagtctaaacacacaaaagataaagattgtcagaagggatgaggaacacatgatccaaccggacaccttctacaagaaactcacttcaaaactcacggtgccggtaagtggagagcgaagagtcacattacgttacgtgttagacagtgtcccccaaaattcacagtgcaggtaagtggagagtgaagagttacattacgtgttagtgtccccccaaattcatgtctacccagaaccgcaaaatgtgaccttatttggaaacggttttgcagaggaactcagatgaagatggggtcaccctagagtggggctcacacttcgctgcctctgtgtggccctctgtgcatccatccgcttcttggacagacgttcaatgctgtgcacacgtcactgtgtgaacacagacgcaggctcctgctcccagccagctcacacgccaatgccagaggcaggtgacaggtcatgcaatgtgtcgggggtgacaagcacagagaagaaaaaggaagcggaaagggagctgagagtgctgggcggatggggaggccagggaggctgtgctgagacggagatgcaggacacgcgggagcagccaggctcttctgagggctccaggcagagagcagcaggcacagaggcagaaggcaggagagaggagctcccagaatggcaaggggatctggggtcaaatgctgtccagcagagataaagggtcagagtccttgagtatgtgggacctggtgagagaggacagcctgagagctaacagtggctccagaaaaaagtacacctcagaactaggaaagaatgaatatgctggagcagggaaaactaaattccccacactctagaatggtctcattatctttccatgctgagcacaggagagagagcactctccgctccaccaataccgtttccggaggtttcaccctgtttcctttttccaatcagctgacaaaaataggagggagatatatcacatttcatcttttcacatatagcagagctttcctccagtgctgcccacattgagatacagtttgaaaaaaattactgggctcgggtgggcggggctctgaggtaggtgggaccatgggtgggcggggctccagcacaggggaggggcatgggcgggtgggtggggctccagcacagggcggggccatgggcgggtgggtggccggggctccagcacagggcagggccgtgggctgggtgggtggggccccaggatagggcagggcccatgagctgggtgggtgggactgcacgacagggcagggccatggtctgggtgggtgaggctccaggatggggtggggccatgggctgggtaggcagggctccagaacagagcagggctatgggctgggtgggccgggcttcatgacagggcagggccatgggctgggtgggcagggccatgggctgggtgggctacggctctgggactaggtggggccatgggctgggtgggcagggcttcatgacagggaagggccatggactgggtgggcagggctccaggacagggcggggccatgggctgggagggcggggccatgggctgggtgggcggggctccaggactgggtgagggctcccaggaggctctgggttgggagaggtgacccacctgtcacaggtccctgctggaggctgcccaggatcttctcacccaagagatgaatcagccgagtcaccacctgcgggcagacacaggagccaagagccacacgttttaaactgagaaacactgggaaccaaagacagtgatgctcaacaacagcgagactcagccaatggcgctggatctgcttttcaaaacctccatgaactgagttgcacatgactcacaagccacgtgctgggccatggctgtttaggccttgcagccttcttgatgcccaggtaagccatacggctgcctttctggttgccaggccagcaggtacaaggggtatgtcctctgtgaccgtgagcccaggccagcctctcactctcacttcagggcaggcagacaactccaagcaagccacccacgaccctgaaggcaggacaagggcaggctggcaggcttctctggaactgagggctcattgtggctgttgcttctgggtgccaagcctgcttcagggcacggttggggacatttgtcctgactggaccaaacggtccccacaccaggggttgctggcttgcagggaccctgcccaggggctgactgtacagcaaagctggccccacaacagcggacccactggcttcacccgcactgtcccccagaagctgctggttggatggagccctgcagcggcctctaaagggtgggccagggctcctgctccgaggcgctcatgagaacgaggcccaccctgcaggccaggacaaagatggaggagtggcctggctccctgctgttcccagcaactgtggctgccaccctggagcctgctggccctgtgagctgcactcacatgctccgccaggctctcctggtccataagtgggcaagtacagcaagcgccaggacctaggatctgcgggcaggagaaccaggatccaggagctgcgggcaggagaaccatggcccaagagctttgagtgggagaagcgctacctgaggggaggcggtggagggagggcagtggtggcctctcaggatgagccccaggggtggtgagaggcactggccgtaaaaggccctgcaacatgctgtgggccacacctgcaccccctttccatttgttctagaatgaaaaacttcttgggatccgtgtgctggctgatgaacaactgcagacctgcccttcaggcccctctgccggtccttcctgggcgctctcctcaccgctgaccctgcacttccgagcagcccgccctgtccttctccagatctcagagtgagagtcacttccctttcctctgccacacccacatcactcatgagtagagaggccaccaagaaggcagctgcacgactgtcctgggaagcagcctgggcgcctctccaggtttcctgctcaccgtcaccgcccccacccagctgggctctaatcttcacctcctccaggtcgttttccatccatgtgtaggtagaccgaatgatcaccacaactcagggcacagtttgggacatggcctgtgccaccctcacccgcaccaccctcacccgcgccctcacctgctctgcgccctcacctgctccgcaccctcacctgcgccctgccctcacctgctccgtgacctcatccactccgcaccctcacctgctccgcgccctcacctgtgccctgccctcacctgctccatgacctcatccactctgtgccttcacctgctctgcgccctcaccagctccgcaccctcacctgcgccctgccctcacctgctccgtgacctcatccactccgcaccctcacctgcgccctgccctcacctgctccgtgacctcatccactctgcaccctcacctgcgccctgccctcacctgctccgtgacctcatccactccgcgccttcacctgctctgcgctctcacctgctccgcgccctcacctgctctgtgccctcacccgctccgccctcacctgttccatgccctcatccactccacaccctcatccgctccgcatcctcacccacgccatgctcacctgtgggtacctgcgcttgatggacgtgagggctcctgccggcagcttggccaattctgagtcccgaacggcatgcaccgtggtcgcccgggcctggtgggtcagtgtctccacctgaggacaggagccggctgctggggccgcgggcttgggagggccgagccagctggacctgtccctgacagcctccggtgcctgccagagccacacatgacaccccatccacaccgcaaggcggaggcagtcagtgagtgctggcgggcgacgctgtcagaaccactggaacatgccagaagccaaaggtgccccctagcaacccaggcaaattgcagacacaggcattggacaccacaggctggaacaagggcagcctcagctctcccgaagaaataaatgcctttggagaacacctcttttttttttttcttggagacggagtctcattctgtcacccaggctggagtgcagtggtgcgatctcggctcactgcaagctccacctcctgggttcacgccattctcctgcctcagcctcccgagtagctgtgaccacagatgcccaccaccacgcccggctagtttttttgtatttttagtagagacggggtttcaccatgttagccaggatggtctcgatctcctgacctcatggtccgccgcctcggcctcccaaagtgctgggattacaggcgtgagccgccgcgcccggcctggagaactcctctttttaagatgtgtccctcagcctgcgggagccctgccctctggcactgaggcctccctgccggcatccggcctggagtgtgagccttcatccggtggatggagctggaaccaccaggctgcacataaagccaagcagaggcccagggcctgctgagccatcggagcgcgggactctgatgggaagaccttcggccctggcagagctgaggcgaggcggtgctggagcacactgacagagttcccatcagccccgggcaaaacacggagcaacacggcacctccgacctcagaggctgcctgaaggccacgctgtccccaggggagggcacctaggcctccccacacactgtttttttttttcagacggagtttagtttttttttgtttttttttttttgagatagagtttagctcttactgcacaggctggagtgccgcctcccaggttcaagcgattctcctgcctcagcctcccgagtagctgggattacaggcacccgccaccacacccagctaattttgtatttttagtagagacggggtttcttcatgttggtcaggcttgtctcgaactcccaacctcaggtggtccacccaccttggcctcccaaagtgctgggattacaggcgtgagccaccacacctggccacactggtttaaaacttaacacagtctgggagcagtggctcacgtctgtaatcctaatactttcagaggctgaagtgagtgaatcacctgcggtcgggagttggagaccagcctgaccaacatggagaaaccccatctctactaaaaatacaaaattagccgggcgtggtggcgcacacctttaatcccagctactccggaggctgaggcaggagaatctcttgaactcaggaggcggaggttgcagtgagttgagatcgcgccactgcactccagcctgggcaacaagagtgaaattccgtctcaaaaaacaaaacaaaacaaaacaaaacaaaaacacaaatcggcagaagccccaggccgtggcaccttggagctgggcagccccccactcgctcaggatgcaggggcctgctgtgagacccagaccagctgtagttgctcctgtggaaccccagaccaaaggcagctcctgctgctaccagccctcaagagacacccaaggcatctgggccagtgctcccagatgccaggataggtgcctgggagtcccccacagaggcagagcctggggatcacagcaaagcagccgcggggagtccccccaatggaggcagagcccggggctcacagcaaagcggctgcggggcatcactactaccatccactcctggggcttttgctcccaagtaactggccaggccacacccaggccagaacccaggatgctctgggagggatgcagaggtgggggaggcaggagcagggcccagcacctaccacgccgacgaggtctcctcggccgtactccccggccaggcgcttcttcccatcatccttccggatcacagagcgcagccggccgctgagcatgatgtacgtgcagtcggacttgtccccctgcctgcggaagacacagaggccctgcagccctgggcccccagcctcagcctccacacccagcttcccaatgccagacagactcaggatggagaaaaagaaaatgcaggcttctcactatcttatttttgttttggaaaacatattttttattttaaaatatttatgttaacaggcctgggttgttttaaatgaatattctaaaattgtcttggttttaattattattattattttttgagacggagtctcgctctgtcgcccaggctgaagtgcagtggcacgacctcggctcactgcaacctccacctcccaggttcatgtgattctcctgcctcagcctcccaggtagctgggattataggcgcacaccaccacgcccagctaatttttgtatttttaacagagacagggtttcacccatgttggcaaggctggtctcaaactcctgaccttgtgatccacccaccttggcctcccaaagtgctgggatgacacgcgtgagccaccacgcccagctaatggggcccttttaaagggacggtgtggacttgaatataatgacacggagagatgctcatagaacatggactatgtccaagcgtgtgtgggtgtcatgaaatccaggaggccacgaagtgtgtttccgagctaagctggggtggggctggggaaatccagccttccatgtgtggtttccacagtaacttccgtgtgtggtttccacggtaaccgtgctttgcccatccccagctcctgcatgccagggcagcatggatgcggagtgtgtggcacccacggcctcacctgtatattgctcgcccggcctccacctccacccagtccagggcaaagtcgatttgccgcacgaaggacgacatcctcttcaccacagtgtgcgccacacccaggacgacggtcggctgcttccgcatgattctgccgggcagcccagagtcaatcctgccccatccctccaaccctacccttcgcccagggccgcagtgctcgggaatggatgggacccacaacccccaccccacccggaaagtagagagaccactggcaggggctgggacggggcacgcaccagtcagctgcctgccccacggcacagcactgcccaccacgtgcccagtggccagcagctgttggggagcccagagagccccctcctggcaggcccgcgagtgccccttggacacgggccctgtgtcaggctgcggtcctggcaggggactgcacatgccgtcaggagctgcataatgcacactcgggccgtgggtgtggctggcagtgagtgccgtgaagggcaccagcaggcaaaggcagaggctgagagacccatggggcctggatagcacagggtctctcctgggtgggtggagggtggctggggcctctgacccggggaacactgttctctccccggtggtcgtgtgtggacagactgtcgagggtgagggctgcagcagggacgtgcccaggggctctgggcagtggcgaggtgggacgtggggcaacctgcaccaggtgtgagagtgacgccgggcgactccaggcctagcctgagccacaggcaggtggagctgccatttcctcagaaggcaaaagcaggaggaagagcaaacgtggaatcaggatctgctttgcacaggaggtgggggaagctggggagatggcaagacagtggctgggtgagggcgtgaagggcgtgagcgtggcacttagagccctgggggtggaggaggagccctgggatgctggctggggtgacggctgcaaggcacaccatgcacggacacacaggcagacacacagacacacacagacacacggagacagagacactcgcagacacacggacacacggagacacacggacacaggcagacacacaggcacaccgagacacacacagacacacagacacacacagacacaaggagacacacatggacacatgtagacacagagacagacacacggacacatgcagacacatggagacacacagagacacacgcagacacacgacacacgcagacacacagatagacacacagcacggggggactgagctgcattaaggctgagggccctgagctctgccctgggtggttcctgtccctgctcttcgccatccgtcctgatctccctggcactgatgtggagcagctggggatgctcaggagggagatgggtccagctccacccagggtcccctgctggtggagggaccgggacttggagcctcagtctccccatcagcacgctgcggtgtcagggcacccggcatcgggacctggctggagccactcaggccaggcctggaagacagaggccatgcagaaagcccttcccaactgggccagggccccgctgcccccacccctgccccttgcccggctcggggtccccaggctgaagcagcaacggcgcggtgccatttgctggattacaggcgtgagccgctgcacccagccgacctgttttcttcagctgctgtgcttccactgaccttcaggcttctgacctctcctgctgcccaaccactcaggcagaagagctctgagaccacagcagacatctggcctatgagggtgcggaggacttccagaaaacacacacagaacggctcaagccaccagaggcgagagctggggttaaactgaaccccaggctccaggagattctggacctgacagagcagaatgcccagtgccgtggatgcaaagacgtggcggctctgccaggcagccacaggcgggccgagggcagctctgggcctggaggggccaaatctgagacttacgggctggggtcaagtggacagatgtcttccagcccggagcctggaaggcgacacgggcacattctgccccaagaagggacacacgtcagtggggctcctcccccgagccagagacgcgtcctcacccactgccttgcccttccacctccgcatcactggctcccgacacgtcagcccaggctgcagaggtgggacggctcacggcccctgaagcccggccctgccccaacgtgggccttgctgagccaagctggggagccccagaactgaccagtgataaatggacacggctgagaccagaccacagaccagtgataaatggacacagctgggaccagaccacagagacggccgtgcgaagctgatcgctgcgggcaggtggggtcggctgactgagcgctggagcagggggcacagacctgggcccacacaggtgccggggacaaagaggggagcccgagaagcagggaagagggtgagagcaccaggaagaggccggccacgcggggaggggtctcagggcagggggggctggggcccgccctgaggtcctggcccgtgggactcactcatagaagtgggccttggagatggacaggaagctgcagtccctgttggccttgacggtgaagatgagaggctccccggtgagcacggccagctggcccaccatctccccggggcgcgtgaggaacaagcaggtgtcctcctggctgccgatcttccgctggtacacgtgcagcagccccgagaccacgaacaggatgctggcgtcctgacacacgagagggctcaggaggcgccgcgagtggccgcgggcaggacgggggcagctctgggcccagagcggacgatgccaccaggctcagccgggagaccatccgccgacctgatcagctctgggcatggacttcactggaaacatttcggcagcgtctacggtttcatgatttcacgagcagtcgtggaaaatctgggttctcaagggctccgtgcagcgagccgggcctcggacctgcacaccttccctcccggcacccgcatactgactgtccctggcaaatgcgcgtcagcccagcattcctgtgcacggggggtcccatgccgcctcgcctggggcctggcctctgaggggtgggctcctggcccctcccacactgagcccccggcacacgccacgcgttttggtcccacatctgcagatgtacccatgaaaccactccaaggccacttccactgatctgtatccactgtgacctcttatgacctcttcccaatctgcttgcccggcccactctcaggtgcgagcagaagggccagtgcagcaggggccaaaggtggacacagctctcagggctcagggctgcctgaggggaggggctctgccatggtgcccagaggggcagtggcccggtgctgggaggtccccagtcactggtgtccagtccaggccctcctctggtgctccacttggcactgggctatggcattgggtggtcccagtgcccccccccagacccccgctcacctggtctccctgccttgacaccaccgtgcctgcaggaacgtgcagaagcgccacccggccatccaacagagatgagtcctaaaaacagagcagacttcagggaacacgggcgggaagcataaatgaaggtccagagaacagaggctgcactgggctgttcaggggcaacgagcggtgaggccagaggccgggcaaggccctcctccgaggctgtcctccaacaagggcctgatggacactgggcaccctgcagagccaccgatgccaaaccagggcatcggcacagagacagacaccaaacagtggagcaaggcagaaaatgcagaaacagacactcgtatttttgtgaatttacgtaaaagagagaggatgtcattttagggagaaagggtgatttctttataagtggtgctggcatagccagcagtgggatgccttctccacaccacctacagaatgatgccctccagggcacgaggactctggaatctgggagctcccagaggtgacccgggagtgcccaacacactggaacccagaaggcagaggttgcagtggacccggagcctgtggagaggccctggggcaaaccaagggtgagggagcgtctgcgggcaccacacccacgaaggtttgaaacatcaggtgtgtaaacccccagtccacagtgatgatgaaataaaaataagaagccccacccagcatctttggaaaatgatcgaaaaacaaaccattaaacttcccaaaccctgacggtgaagggggtgaaggcagctcccccccaaaagagaaatgacatcacatgtcgccaaaagtttgtcaaacaggagggagaaagagatggaggaggatgagaagaatctgagcagccacatatccagctctcaggcagaggacggccgctgacggagaggccgcatcgccccagggcgcgttgtcagcccgaggaggagccgtgggaggttcttcaggagaagaaagcggcctccctgaggaaagcagctgcactaagaaagtcagagccttcgggagatgagggggacgggggggacgcgggggacgcgggggacgcgggggacgggggggacgagagggatgtgggagccggccacggtgacatggacgaggccgctggacaggggggcactgaacgcacggctgaagtcatttggccattttaaggattactgttaagtattcagaaatgataagagtattgtggttagagatgaatcctgaaatatccaccagtgacgtgctatgatgatgggatttgcttcaagggggggcacccgaacggtacggaaggggtgcagagaaaacaaggtgggctgtggtgtgatcgttactgtgagggatgctaggtactcaccttcacatattattccatctattctatatagttttgaatttcccataattaaaaagttgtttaaagagagagaagactggctgggtacagtggctcatgcctgtaatcccagaatttttggaggccgaggcaggtagatcactagaggctaggagttcaagaccagcctgggaaacatggcaaaaccccgtctacactaaaaatacaaaactcagctaggtgtgttagtgaggcctgtggttccaactactcaggaggctgaggtgggaggatcacttgagcccaggaagtggaggttgcagtgaactgagatggcaccactgcactccaggctggatgacaaagtgagacactgtttccaaaaaagaagaaggaaggaggagggagaaggagaagaaagaaagaaggagaatgaggagggggaaggagaaggaggagggggaaggagaaggaggagggggaaggagaaggaggagggggaaggagaaggaggaggaggaaggagaaggaggagggggaaggagaaggaggagggagaaggaggaggaaggagaaggagaaggaggagggagaaggagaaggaggaagaaggaggagggagaaggaggagggagaaggagaagggggaggaagaaggagaaggggaaggaagaaggagaaggggagggaagaaagaaggggaaggaaggaggagaaagggaagaaaggggaaggggaaggaagaagaagaaagaaaagaaagaaaaagaagaaaaaagaaagaagagaatgaagaagaaggaagaaggaagaagatgaaggaagaagaaagaagcaagaagaagaaggaagaagaagaaggaggaggaaggaagaagaaagaagaaggaagaagaagaaggaagaagaaagaagaaggaagaagaaggaagaagaagaaggaagaatgaagaagaaggaagaaggaagaagaagaaggaagaagaaagaagcaagaagaagaaagaagaaggaagaagaagaaggaggaggaaggaagaagaaagaagaaggaagaagaagaaagaagaaggaagaagaagaaggaagaagaaggaagaagaagaaagaaagaagaagaagaaaaaaggaagaagaaaaaagaaaggaagaagaagagaagaagacggaagaagaaggaagaaggaagaagaagaggaagaagaagagagatttttttttttcctttgggacagagtttcactcttgttgcccaggctggtgtgcagtggcgcaatcttggctcactgcaacatccgtctcccaggttcaagcaattctcctgcctcagcctcccaagtagctgggattacaggcacgtgccatcacacccagctaatttttgtatctttagtagaaacagagtttcaccatgttggtcaggctggtctcggactcttgacctcaggtgatccacctgcctcggcctcccaaagtgctaggattacaggcatgagccaccactcctggccagaaaagcagatttaagagatagatcagcccactgcagtgtatggcccttactcagatcctgatctgtacaacaagaaaccactgagaaccactcatgacacagtcaggggtccaggaacacgctgggtgggtgagcaatcgcagctttttaacatttcacttgcagaacgacaccgtggtgatgcctcagaaggagtccttaaccgttagagaggaatgatgtgaacttataacgtgttggagatttttgagacagaaaataactgggggagggactaggagtacagctgtaaagtgattagccatgattggtaattacggaattgggtgaccagtgcatgggaactcatgacaccatcacggctgtctttttacctatttaaagctttccatcagccgggcgccgtggctcacgcctgtaatcccaacactctgggaggctgaggtgggcaaatcatttgaggtcaggagttcgagaccagcctggccaacatggtgaaaccccgtctctactaaaaatacaaaatttagccaggtgtggtcgtgggcgcctgtatcccagctacttgggaggctgaggcaggagaatcgcttgaatccaagaggtggaggttgcagtgagccgagatcatatcactgcactccagcctgggcgatactgcgagactctgtctcaaaaaaaaaaaaaaaaaaaaaagctttccatcatatgtaagaaattaaatcctagatgaactaatgattgaatattaaaaagtaataaaaataaattattaaagtgaagctgggaaaatgtcatactacaataatctgacactattattgctgtattaaatataaacatagatgagaattctaaagttcagctttgggacaccctgatgtcccagaaagcttcggctttgagtttgaacataaggcgatctcaagctgctagcttcccaaaggggaccccaaaagacaagcaagcctgcactccacccaaaacacctcctttgcagccactgtcctccacacctggaaccactgcccaacagaggcagagaggaggccacgggccctgggtgggacaagggccaggtgcccgccggggccactcacttccagcttcatcagggtgagcaggtccttcttggcagctctgaagatggcatccgacttcctgctggccagggtctcatccgtgtgactctctgagtgctgggagaccgtggagggtatctctgcaaccatcacgcttttcctggactggagaagaacggagataccggcaattcgaagggatgtggttggggaacatcgcacaagggtgtggtcaggtctgaatcgcacagtgcggaaaggccggctgagcctcctgaagctgcaggtgccacatgacaccaaagccggcggcgcccccaatgcaccagcaagccacggagagggtggggccccaggcggagggtgagaatgacagccagggcctaccttgctggccacggagctcccggggtgctcgtccgagtgcaggaagaccctggcacggtcacatgccatccccagatcagaagtggcactgcctgggccccctacacacagaggggacactcaggacacggttcgctaggccactgacacaaacgtccgcggtgtgggctgagcacaccctgcagtctaaccacacagaccccggcagctccctcgagggagtcgggccctgagatccctccacaccctgctttctttcggcatctgcctcaatggctctgtgacccaccagctacaggttttctccgcagcttaaacccacacggtgccttcaacatttctgggcactgataaaggtagcccggtcggtacctaaaacacggaaggaaaccagccctggtcctgagccaaattcctcaaaccttgccatgcgtgccacaccctgacggctcgctgcggccaaccctgggtagagcaccctttctcttgctgtccatctcagggatgctgccgccctctgtatgtgagctcccctaacgggtgccctgggccgtcacgctggtgctttgggcttggctctttgcagtcccagccccatctcagaggttcgctcttcgcagtccagccccatcttggagggagggggttgaggcaccccctccaaagagctcccctgttgctgcttttgggcggcctcgggctgagcgggatgaagcagtgtgcacccttttacagcctgccctcagcattacacatcactacacacacagcgtatctgacctctggaccagctgctgtggattctgaggaagggtgcacgctttgcacgacggggtcacgcacttccaggcacagatccagcccttcgtgtgcagctgcgcatgcgagcgagtcatctgcactgcggtttcccatccatactggaattcgcaacacccatttctcagcggaatacagaggaaccgcgcagacactaaccgcagacacatgccacacagatgccgcagccacatggcgctgcgggaaggaaccaggcccaggagcacagccatgtgcccctccctgggaagccagacacagagagccaggagcgctgggccttggaaaggggcgcatgtctccgaggcttacgctgagggtgcgctggtcgggtttcacggagctggcacccttcagcccggtgcactgtgctgtgtattactcatgcccccgtcaagtcctgctgttttttaaaaaaatccgaactggaaagcaatctatggcaacaaaggtcaccagtgcttcctctggggctgaccctctgggctgggcgagaggagcgcagcagcccctttacctggctgcagccacacaggggaacactggggtgtaatgaccacaccttgtacgtcaacaagcatgtagctaaatgataaaatttctcacacctatagtcccagcactttgggaggctgaggcaggcaggtcgcctaaggttgggggttcgagaccagcctgaccaacatggagaaaccctgtctccactaaaaatacaaaattagccgggcgtggtggcacatgcctgttaccccaggtcctcgggaggctgaggcaggagaatcccttgaacccaggaggcagaggttgcggtgagctgagatcgcaccattgcactccagcttgggtgacaagagcaaaactgtgtctcaaaataaataaataaaataaaatacgggggccaggcatggtggtatgcacctgacaagagcaaaactccatctcaaaataaataaataaaataaaatacgggggccaggcatggtggtatgcacctgtggtccttgctgctcaagaggccaagccggaaggatcgcttgagcccaggagtttgaggcctggacaacatagtgagagactgcatctcttaaaaataaatacataaataaatgggccaggtgcagcggctcatgcctgtaatcccagcactttcagaggccaaggtggaggcagcgcttgaggccaggaattcaagaccagcctgggcaacacagcaagagatctctatctacaaaaattttaaaaaccagccaggtgtgggggccacacctgtggtcccagctacccatgaggctgaggcgggtggatcacttgagccctcatgggctgaggcaggtggatcatttgagcccaggagctcgaggctgcagtgagttgtgatttcaccactgcaccccagcctgggccatggagcaaggccttacctcaaaaaaagaaaaagaaaaagtggtggatcaactagatagccatttagaaaaggatgtatcagccgggcgcggcagctcacgcctggaatcccagcactttgggaggacgaggcgggcggatcacgaggtcaggagatcgagaccatcctggctaacacggtgaaaccccgtctctactaaaaatacaaaaaattagctgggcatggtggtgggcgcctgtaattaacagctactcggcggctgaggcaggagaattgcttgaaccccagagatggagcttgcagtgagctgagatcgcactattgcattccagcctgggcaacaagagcgagactctgtctcaaaaaaaaaagaaaaggaaaaagaaaaaagaaaaggatatatcttgacccctactcactttctacaaaagaataaattctagatggatcatatgaaaggtaaaacgttaaatcttacagacagatttcttaaacaggacacaaaatatattaaccacaaaagaaaaatattgataaattagatcccattaagtttaaaatttcctattcatcaaaagacaccactacgatagtaaaaagtgaatagaaaatatttttaatatacatacttgacaaaggaatcatacagagaatatataaagaattcctattaataataagaaaatgaaagctaagaggaaaatgggcaaaagacaaagaaggctatccaaggtgctcggcctcacagttcatcaagaagacagaatcagagcacaggcagcctccactgcacgcccaccagaagacagagagcagcacatgctgggccggaagtggccgctaaccatgggcggccagtgagcacctgaagtgtggctggcatgagtgagtttagctggtacgaatgagtttaattggcatgagtgagtttagctggcatgagtgagtttagctgacatgagtgagttagctggcatgagtgagtttaactggtatgagtgagtttagcgggtacgagtgagtttagctggcgtgaatttagctggcatgagtgagtttagctggcatgagtgagtttagctggtacaagtgagtttagctggtgtgagtgagtttagctggtacgagtgagtttagctggtacgaatgagtttagctagtacgaatgagtttagccggtatgagtgagtttagccggcgtgagtgagtttagctggcatgagtgagtttagctggtatgaatgagtttagctggtacgaatgagtttagctggtacgagtgagtttagccggcgtgagtgagtttagctggcatgagtgagtttagctggtacgaatgagtttaactggtgtgagtgagtttaactggtgtgagtgagtttagctggtacaaatgagtttagctagtatgaatgagtttaactggcgtgaatgagtttagctggcatgagtgagtttaggtgtcaacagtcacatgaggcttgtggcccatgatgcacagcacaggcatggagcagccacagcagtcggatgaggctgaggagtagacgctggtgtctgtgggcggcaagccacccaggcactgaggcaagagacagaggacacgagctgttccagtataataaaatataaaacaagaatagttataccagatatagatcttaggtatgattatatatgaatatcattaatcattagttggtagtaattactctttatcccaatattataataatcctcgctctacaatcataacctaggaaaaaccaggccatacagagataggagctgaggggacaaagtgaagagtgaccagaagacaagagtgcgagccttctgttatgcctggacagggccaccagagggctccttggtctagcggtgacgccagcgtctgggaagacgcccgttaccaggcggatcatggtccagcggtagcaaaaggtgtcaaggaacaacacccgctacttagcagaccgggaaagggagtctccctttccccggggagtttagagaagactctgctcctctacctcttgtggagggcctgacatcagtcagacctgcccacagttatccggaggcctaaccgtctccctgtgatgctgtgcttcagtggtcacgctcctagtccaccttcatgttccatcctgtacacctggctctgccttctagatagcagtagtaaattagtgaaaatactaatagtccctgatatgcagaaataatggcgtaagctgtctttctgtctgtctcctctccctctctgcctcggctgccaggcagggaagggccccctgtccagtggacacgtgactcacgtgaccttacctatcattggagatgactcacactctttaccctgccccttctgccttgtatccaataaataacagtgcagccagacattcggggccactacaggtctctgcacattggtggtagtggtcccccgggcccagctgccttttctcttatctctttgtcttgtgtctttatttctacactctctcatcgccgcacacagggagagacccactgaccctgtggggctggtccctacaggtgtcagtgcctgaaacgccaccaggcagtgcccccgtgtgggcggaaagtcacccaggtgccgaggcatgagactgaaggcacaagctgttccaatataatcaagaaaatagttaggataagagaaagttatattcgaaataggatatagagatgaatgtatatggatattatcaatcattagttttctgtattaacctttgtatgattattataaccaaagaaaaaccaggccacacagagttaggagctgaagggacattgtgagaagcaaccagaagacaagagtgtgagctctctgtcacgcccagataagggccgcttgagggctccttggtctagcggtagtgccagtgcctgggaaggcacccgttacttagtggaccttggtctggcggtagcaccagcgcctgggaaggcacccgttacttagtggaccttggtctggcggtagcgccagcgcctgggaaggcacccgttacttagtggaccttggcctggtggtagcgccagcacctgggaaggcacccgttactcagcagaccttggcctggcggtagcgccagtgcctgggaaggcacccgttacttagtggaccttggcctggtggtagcgccagcgcctgggaaggtacccgttactcagcagaccttggcctggcggtagcgccagcgcctgggaaggcacccgttactcagcagaccttggtctggcggtagcaccagcacctgggaaggcacccgttacttagtggaccttggcctggcggtagcgccagcgcctggaaggcacccattacttagcagaccaggaaagggagtctccctttccctgggagagttagcgagcactctgctccaccagttcttgtggggggcctgacattccccaggcctgcccgcagtcattggaggcttcaacgtctccctgtggtgctgtgcttcagtggtcacgctccttgtccgctttcatattccgcctgtacacctgctgcttctcttaagttcttagaagatagcagtagcagaattagcgaaagtattagagtctttgatctctctgataagtgcatagaagaaatgctaacgtctgctgtcctccctctctgcttcagctaccacaaagggaaaggccccctgtcacgtggacaggtgacttgcttgtccttatcaatcacttgagatgactcacactccttaccctgcccccttgccttgtatacaataaatagcagtgcgtccaggccttcagggccactaccggactctgcgcactggtggtagtggcctctgggcccagctgtctttcctactatctcttagtctcgtgtcttattttactacaatctctcgtctttgcacatgaagagaaaactcacaaggccctgtagggctggaccctacacccctgagccaagcacacgtgactccatgacccagcagccccaacagaaatgtgtacacgctcgtgcagtggacgcacagacgtaaacattcacacggcgaagcctgcaccaccacgagaaggtggggaggcttctccacatgacggcatggatggacctccccacgggacgtggagcagggaagccaaacacaaacgcacaccacacggctccacttctgaaaaggaaaacaggccaacctcacctcggctggcagccatcgggacggcaggcagccgtggtggggagcaggttttacaaccagacatggctgctggtggtaacaagaggagcatgaacggggcttgcaggggctaatttatgtttctttacctggttcacaagtgagttcagtttatggagtcatcaaaccgtccacctgcaatgtgcgtcctgcatgcgcattatacaaccatcactagttaataaacaaacaacaactgggccaggtgctgtggctcatgcctgtttcccaacagtttgggaggctgaggcaggaggatcacttgagcccaggagttcgaaaccagcctgggtaacatggcaagacaccctctctacaggaaacaagaaaaataaaaagaaaatacaaaaaaaaaaaatgccaagtgcagtggtgtgcctgtactcccaactactcaggaggctgaggtgggaagatcacttgagcccagagggttgaggccgcagtgtgccatgatctcaccactgcactctagcctgggccacagaacgagcctctgtctgaaaaaaaaaaaaaaagctgttacttaaacaaaaaaatccatgtagattcagatacctgatgcccgatggcacaaaaaaagcaagagagagatgacagattgttttattaatggtgttgggtaaattatcaccataaagagtaaggaaaagatgaatttcttccctcattcttgcagtataaactacagataaatgaaagacctctatgtgaaaggcaaaactaaaagctaataaaaatagtctttgaggccgggtgcggtggctcagcctgtaatcccagcactttgggaggctgaggtgggcggatcacctgaggttgggagtttgagaccagcctggccaacatggggaaaccccgtctctactaaaaatacaaaattagccagttgtggtgacacctgcctaaaataggctgaggcaggagaatcacttggacctgggaggcagaagttgcggtgagctgagatcacaccattgcactccagcctgggcaacaagagtgaaactctgtcacaaaaaaaaaaaaaattaaaaaacagaaataaataaaatagtctttggaaaatttatttatgactcaggaataaggaaagaataaataagacccaaaacacaaatcacaggtgccaaggcaaaaagctggctttccacaaaagaacatcagggtccctgttgcgtgaaggtcccgtggcggcattttccagcccatggacaagagggaagagaatctccaacaactgaaactaatgagacaagagggaaaagaatctccaaaaaaaactaaggagacaatggggaagagaatctccaaaagtgaaactaaccagggacctctacctacagcacataaagaatcaacacaaatcaaccaaactccagaatcctgcagaaagtgggcagagaatacgaccagacaatctgagagggacgcccagatggaaccgaatacagcaggagccaatgagcttgccggtgacctgcgggtggcagacggcagagggggcaggtctgcggcaggagcacggctgcactgccgggcaggatggacttggaggctgccctgaaaatgccctgggccctgtggctgggctgtgggcgggtcacctgactgttgaggtgcccgggccctgtggccgggctgcgggcgggtcacccggatgttgaggtgcccgggccctgtggctgggctgcgggcgtgtcacccggctgttgaggtgcccgggccctgtggctgggctgcaggcgggtcactcggatgttgatgtgcccgggccctgtggctgggctgtgggtgggtcacctggctgttgagatgcccgggccctgtggccgggctgtgggcgggtcacctgactgttgaggtgcccgggccccgtggccgggctgcgggcgggtcacccggatgttgaggtgcctgggccctgtggctgggctgcaggcgggtcactcggatgttgatgtgccggggccctgtggctgggctgtgggtgggtcacctggctgttgagatgcccgggccctgtggccgggtcacctgactgttgaggtgcccgggccctgtggctgggctgcgggcgggtcacccggatgttgaggtgcccgggccctgtggccgggctgtgggcgggtcacccggctgttgaggtgcccgggccctgtggctgggctgcgggcgggtcacccggatgttgaggtgcctgggccctgtggctgggctgcaggcgggtcactcggatgttgatgtgcccgggccctgtggctgggctgtgggtgggtcacctggctgttgagatgcccgggccctgtggccgggctgcaggtgggtcacctgactgttgaggtgcccgggccctgtggctgggctgcgggcgggtcacctggatgttgaggtgcctgggccctgtggctgggctgcaggcgggtcactcggatgttgatgtgcccgggccctgtggctgggctgtgggcgggtcacccggctgttgaggttttgctacacatcagttacagcaaaggtccctgcggggaggcacacgtcagcagggctggggaaggaagggaggcttgctagagacccgggacacaaggcaggagagggaccatgcagggagggcgggaagggccgagcacatggctctgcggggcatctggtggcaccggcccagccctggcggtggtgggggtgagacagggcaggcacgcagaggagcacaccagggtgttctgggcggcaggacggccaccaagcctcgaccctagagccagaggacaggcacaggcccccctgggcacgtggggctctagtggagggtgcccgcctcggcggcgatgctgggcatcagtgcagctcagcctgggtctcagatgccgagggcctgtgggtcacactggctgggcagccgtcgaggttctttaccttgtggggccgaagggtcagggtcacctgccccgggcttctccagctcctccaagatctgtttgcgaatggaaggcgcggggacggagtggctcctcttcagcaggggcccagcagctgccgggcggccgcccccgtgatctgctggggaggcagccgtaagcaaccttgtttgcacgcactccctggtgtctggtgcagcccattcggggccacgcagggagcagggtccccacagtgccctgcgcacctgaacgcgctctggaccagcccaccggccaccaggcctctgcatctgccgggccagcaggtgagtgcaagcgagtgccggcctctgactagccctggcccctccccgcccaatcccgcctcccacatccccctcctcccaatctccctccccaccccatcccccttcccccaaatcccccctcccccctcaatccctctcccccaaatgccccctccccccaatccctctcccccaaatgccccctccccacctcaaccccctccccccaaatcccccctccccaccccaatgcccctcccccaaatccaccctccccacctcaatcccccctcccccaaatcctccctccctaccccaaccccctcccccaaatcctccctacctaccccaaccccccattccccgaaatccccctccccaccccaatccctcctccccaccccttccacccctaccccaatcccccatgcgccccacccccatccctaacctaaccccctgccccattccgaggccttgctgccctgattgtcctgctgtgggccaagtgccttgaaggcaaactccatccaggtggggctgccagccaggccctttctcagggcgtcccattggtggatgtggctgtctgggctcgcctgggatgggccacgcagggctgcatctgcccctcaggtgaaacgaggaaggagcctggccttgccgaccacacaggctgaaggaggctgccctgcctggacactgtccttacctacagaggcccatgagcacccccggccctggtctctgccaagacctcatccaggacagctgctgccccatcaagtcacatggacctaatccagtgaaagaaatgccattcaggcaatgacacatactctaaaatacactttgaggccaggtgcagtggctcacacctgtaatccaaacaatttgggaggccaaggtgggaggatcacttgagaccaggagttcaagaccaccctggaccacgtagtaagatgccatctttacaaaaatttaaaaataaaagtaaatgagctgggcctggtggcatgcgcctgtggaccaagctactcaggaggctgacgcaggagaatcctttcagccagtgacatgggggtggcagtgagccagtaccacaccactgcactccagactgggcaaaagagcaaaaccctgtctcaatagtaataataataattattattattattataaaaataaaatgcatttctgggaaaaagcacatcagccagagctgcgtttaaaggtggctgtgatcctcatggggtctcacaagcacacatgagtgcaggagtaacaccactctgctcactccatcctcactcactcaactctgtccactccatcccccactcactccactctgtccactccatcccctgtcactcactccactctgtccactccatcccacactcactcactccactctgtccactccatccctcactcactcactccactctgtccactccatccccactcactcactccactctgctcactccatcccccactcactcactccactctgtccactccatcccccgtcactcactccactctgtccactccatccctcactcactcactccactctgtccactccatccctcactcactcactccactctgtccactccatcccacactcactcactccactctgtccactccatcccccactcactcactccactctgtccactccatctcccactcactcactccactctgtccactccatcccccgtcactcactccactctgtccactccatccctcactcactcactccactctgtccactccatcccccgtcactcactccactctgtccactccatcccacactcactcactccactctgtccactccatcccacactcactcactccactctgtccactccatccctcactcactcactccactctgtccactccatcccccgtcactcactccactctgtccactccatcccacactcactcactccactctgtccactccatccctcactcactcactccactctgtccactccatcccccactcactcactccactctatccactccatcccccgtcactcactccactctgtccactccatccctcactcactcactccactctgtccactccatcccccgtcactcactccactctgtccactccatcccacactcactcactccactctatccactccatcccacactcactcactccactctgtccactccatcccccgtcactcactccactctgtccactccatccccactcactcactccactctgctcactccatcccccactcactcactccactctgctcactccatcccccactcactcactcgactctgtccactccatcccccactcactcactccactctgtccactccatcccccgtcactcactccactctgtccactccatccctcactcactcactccactctgtccactccatcccccactcacgcactcactccactctgtccactccatcccccactcactcactccactctgctcactccatcccccactcactcactccactctgtccactccatccctcattcactcactccactctgctcactccatcccccactcactgactccactctgtccactccatcccccactcactcactccactctgctcactccatcccccactcactcattccactctgtccactccatccctcactcactcactccactctgctcactccatcccccactcactgactccactccatcccccactcactcactccactctgctcactccatcccccactcactccactctgtccactccatcccccgtcactcactccactctgctcactccatcccccactcactcgctccactctgtccactccatcccccactcactcactccactctgtccactccatcccccactcactcactccactctgctcactccatcccccactcactcattccactctgtccactccatcctcactcactcactccactctgctcactccatcccccactcactcactccactctgtccactccatcccccactcactcactccactctgtccactccatcccccactcactcactccactctgtccactccatcccccactcactcactccactctactcactccatcccccactcactcacttcactctactcactccatcctcactcactcactccactctgctcactccatcccccactcactcactccactctgtccactccatcctcactcactcactccaccctatccactccatcccccactcactcactccactctgtccactccatcccccactcactccctccactctactcactccatcccacactcactcattccactctgtccactccatcccccactcactcactccactctgctcactccattctctcctcactctcatcagcattgcttcatttaatttcacatacttttgttagtcacttcaattcttttgggaacatgatgggctataaataaccaagcgcgcacctcatctgtagggtggctgttaactccatcacacagatcgtcgtggggtgactcatgcagtgcacgccgcacccgaccgcttcctcctcagattcaggccccccggttagcactcagaacagcgggtgagagcccatcgcgggaggcccactccccaccaggcacctggcccaggccaagcacgcagggagaattctgggaacaactgaagaatggagggtgaagggtcctgggcctgtctgaggacatccgggcctcatgtgaggagacgggcacacgtaatgagaccgttggaggtttgaggacatccagcccacatgtgaggagatgggcacacctgatgagacctggggaggtctgaggacatccagcccgcatgtgaggagatggggacacgtgaggagacctggggggccatctgatgagacctggggggcatgtgaggtgacctggggcacgtgtgaggggacctgaggcacgtgaggggacctggggtgcgtgtgagtagacctggggggcatgtgaggtgacttgtgggacttgtagggtgacctgggccgtgtgaggtgacccggggatgtgtgtggtggcctcaggcatgtgcaagatgacctggggtgacctgaggcagtgggagcaggatcccccggactctggggctggacattgccctccttggtgcaggacagtacctgagtcacaggactcctggagccgcggtggctttttaagccgctcttcttcgccatagaacacctgcttcttggccttcccggcagccacactggctacagacacgagagggatggcctggctctcctgggacacaagaaggaagttcagtgccaccccaggaacaccccacacccactgacaggtgtgggctcctcaaaggtgtgacaggtgtgggctcctcaaaggtgtgacaggtgtgggcccctcaaaggtgtgacaggtgtgggactctcaaaggtgtgacaggtgtgggcctctcaaaggtgtgacaggtgtgggcctctcaaggcaaagtttaagctacatttcaggcaatggaaagaggccgatcatcaacccagaaatccagttattcaagaaaaggactggtctgtttaaggcaaccaagctcagcctgcttttaccctaggccctgtctcaaacacttgatcaagtcaacatactgccccaaattgtcagaaccttaatactcttcattaaaacaaaagataatgtagaaaacaaaaagatattcccttaatgtcaacaactgaagacgacaagccctaaaatgtcatcagaattatgatttccaactgaaatgcacatactaaagactaatgcgtgctgggcctttactaaccgagctccacttgccccatgactaaagagagccctccgcatatcaggctactgttttgggcagtggggatggagcagggcacgaaaccctggtctcactcagttcccacgagagctcggctaggtggggaccgtcccacgtcccggccaagtgcctcccagggtcacaccgccaggaggagggagagccggggttgacagccttgtgcccttgacaatgcgctgtaccctccaaacgcgtcacagttcagggtcagctccgccccacccggttcagataggaggagctgtcaagggcaacacacagggagtgctggcaacagggaccccatgggacgggcatggggaggggcagcctctgctggacgcggacgtagggaccccacgggacgggcatggggagaggcagcctctgctggattcggctgtagggaccccatgggacgggcatggggaggggcagcctctgctggaccgtggccatagggaccccatgggacgggcatggggaggggcagcctctgcttgacatggctgtagggaccccatgggatgggcatggggaggggcagcctctcctggacagggctgtcagctcagtgtgcagcctgcagggccagaaagggaaggagcgtgtgtgtggctgccgatgtcctacagaacacaggtgaccaaaggaagactcatcacagagtcctgaatgggagctgcagaggcaccaggcggctgttcacaaccgtgtgggcctccagagggacaactccatcatcggagaaggaattccacctttcccaagtccaacggatcagagattttggaacacaaggccccaggagaatcaagcctccaaactgactagcaggtgctttaaggtaggagaataaacacagcacaaccagcccctcccaaagtcctaatgaccagcaactgggaagaccacagctgttgctggcactgccccaccaggcactgggcgcctgccgtgccaaccaatagctgtcccgatgccagctgcatggagcagcatggggctttgtgaggtggttttcacttacagcgttgaagagctctgtggtcaggccgaggtagttgtgcagagccagaaaggtcaccctctgcagccgcaccatgatgatctgcaagaacacgccagctgcgcggtgaccaccggcctggggtacagggcgggcccccggcagcaccacacagagcactgagaaccgtgccccaaaccctgcagatgccacagaccgaaccctctcagggtgaaaaaccccgcagacttgacacctcaccacggtcaagtaacacgttcacatcacggggaatgggacaaggggcacatgaagactgcattgtttttgcaagttttctataaatctaaagttactccaaagtgagaagtttaataaaaatgtaaaaatctctttgggggtagtgagggatcttaagacctctttgagattgtgaacattcatttttattttaagatatatattacaatttttttttgacatggtgtctcgctatgccgcccaggctggagtgcagtggcaccatctcggctcactgcaagctccgcctcccgggttcatgccgttctcctgcctcagcctcccgagtagctgggactacaggcgcccgccaccacgcctggctaattttttgtatttttagcagagacggggtttcaccgtgtgagccaggatggtctcgatctcctgacctcgtgatccgcccacctcggcctcccacagtgctggggttacaggcgggagccgccgcgcccggccaagagacggggtttcaccgtgtgagccaggatggtctcgatctcctgacctcgtgatccgcccgcctcggcctcccacagtgctggggttacaggcgtgagccgccgcgcccggccccagatttttaaaatataaccttcattattcccgaacccactcagaatcccacaacaccagtggtaagtcccgccaatgaagttgatttctctattcctctgaaatcaccttcatggctgtaaagctcagaactgagaaagtaagtgggcaataaacccactcaaatcccaaaccagtgcccaggcccccccagggtgacccacagcagctagaagagttgtctgaaaaagtgactcacctgcaccaccctcaccagagtttccggatatttctcaaaaactccatgaaaagccgcagctggaagccggaggatggtggacgggatggccgcgcggacggagaccgttttgtaaggtgcagcatggccctgtaacaacagctccatcagtccccactctgtgggcctggccaaccccccagggaatgccaaggctcctggaagccctggaggaggccccgcctgctgcccagtcacacggctccattctccctcccaggctgggctgtgcaaagtgctgcttttggcaccagctgcacacgttttttgactgtccaagacatgtgcggcgaaggactggctgacgatgaaatgtgggtgaggggaggcccgcaggcagccaccccaccagacctgggcactcaccatggggagttccaaccactcccacctgccactgaggctcacggaccagctcaccagcgtcctactctacgtccgacatcagcgtcggtacccctcgccaaagggcgtgccagacaccaacctgagcgggcttcctaaaaaggccaccgagagggtcaggagccaccactgtcaaatgcccaccgccacagtggggtcaccgcctaggacagggagcgcgcactgccgggtcgcacgaggcccaggtgaggagccacagtggctcaccgcgtggatgtggccagcagagctccacacggccaaggaaagagcccaggaaaagccccagtgagtgacgtggtttccatcttctagaaattggtgggctctagagagaaaaggctgtttttaaatcacgctgtgatctgcatgcaggcagattcttctggaaacttgttggctctagagacgaaaggctgttgtttacaccatgccgtcacctgcctgcagagacagatttttttttttttttgagacagagtctcgttctgtcgtccaggctggagtgcaatggcgtgatcttggctcactgcaagctccgcctcccgggttcacaccattctcctgcctcagcctccacagtagctggggctacaagcgcccgccaccacgcccggctaatttgttttttgaatttttagtagagacagggtttcactgtgttagccaggagggtctcgatctcctgacctcgtgatccgcccacctcggcctcccaaagtgctgggattaccggcgtgagccaccacgcctggctcagattattctggaaattagttggctctagagagaaaagccttctgtttacatcacgccgtcacctgcatgcagaggcagattcaccctttttggtgcacacctctagcattttcacccccaccacagaaacagaacaatcccaacctccaatgcccctggcagccttttcgcaacctcctttcttcccaccactgggtcttggcaatgctcccccgtcttctgtcccagtggttgtgcctttgtcaaaatgtcacataaatggaggcacagagtgtggaggcttccctcagcggtgtgacacactcgagattcccccacggtggcatgtctgacagaggtctctgccttgactcccaagtgctggctgtctcgtggaggcctcgcagggtctccgtccattcagcagtcgagattcccccacggtggcgcgtctgccagaggcctgtgccttggctcctgagtgctggctgcctcatggaggccttgcagtgtctcctcgtgaaggcctcgcagggtctccgtccattcagcagtcgaaggatatttgtgttgtttccactggggacaattctaaataaagctgcttgataaatatgcatctcccagtgtttgcgtggacacagttctcatccctcttgctaaatacctagggatgggacttgtaggttgtacggaacacgtatcctcacatttataagaaactaccaaactgtctcctacagcggctgccgtgctttgcattctcaccagcggtgagtgagtttccatggatgccctgtgttttgcattctcaccagcagcgaacgagtttccgtggatgccccgtggaatgagtttccgtggatgccccgtggaatgggtttccgtggatgccccgtggaatgagtttccgtggatgccccgtggaatgagtttccttggatgccccgtggaatgagtttccgtggatgcctgtcttcaccagcagttggtgccaccatgtcgcataataaagaatttagctggtcttgtcttcagttcccaggagaaagccctcaagatcttagaagctcctggaagtgtctttttattcacagtgcaattcacttgggtttatgctagcaggtgactcctggcggcaaggcccaacccagaagtttcaggagggagctggccatgcagggaagaccaagcatgtgactagatccaggggtgtcagcccaacctcccacctgcggggaggggaggaagctagacatcgagttggatcacacagccaaagttcaggcaaacgtccctgggtggcaacacacatcagtgtgccaggaggtatagggtccagccctactgtgcctgtgtgtttttttcttcatgtgcagagatgagagatcgtagaaataaagacacaagacaaagagatggaagaaaagacagctgggcccaggggaccactaccaccaaggcatggagaccggtagtggccccgaatgcctggctgcactgttatttatttgatacaaggcaagggggcaggtaagaagtgtgagtcgtctccagcgatacgtaaggtcacgtgagtcacgtgtccaccggacagggggcccttccctatttggtagccgaggcggagagagaatggggacagcttatgtcattatttcttctatgtatttctcggagagatcaaacactttaatactttcactaattctgctactgctatctagaaggcacagccaggtgtacagggcgtaacacgaaagtggaccaggagcgtgaccgctgaagcacagcatcacagggagacgtttaggcctccggatggctgcgggcgggcttgactgatgtcaggcctttcacaagaggtggtggagcagagtcttctctaactcccctggcgaaacgagactccctttcctggtctgctaagcagtgggtgtcttcccaggcactggcgttaccgctagaccaaggagccctctagtggccctgtctgggcataacagaaggctcacacttgtctttggtcgcttctcaccatgtcccttcagctcctatctctgtatggcctggtttttcccaggttataattgtagaacagagattattataatattggaacaaagagtaatgctacaaactaatgattaatattcatatatcatcatatctatattctagttccagtataactattcttattctgtatattttctttattatactgtaacagctcgtgccctcggtctcttgcctcggcacctgggtggcttgccgcccacaaggaggatggcatagctcaaggacacgggagcctcatggctggaccatgccagacctcactctgtgggtctcttgactgttttgactgatcctgattttcatccttttttttttaagacagagtctcactttggagtgcaatggcgcgatctcagctcactacaagctccgcctcccgggttcacgccattctcctgcctcagcctcccaagtagctgggactacaggcgcccgccaccatgccaggttaatgttttgtatttttagtagagacggggtttcaccgtgttagccaggatggtctcaatctcctgacctcatgatccacccgcctcagcctcccaaagtgctgggattacaggcgtgagccaccgcgcctggccgattttcatcctttgtagtacaaatgtgaattgttctagaatattgaatctgagggggtcacaggaatccctgaagttgtaaccagttggtcacaagtgtgagtggcctgggaactcccaagtttgcagttttggatgctattataattgctgttacttttaaatttcaattcctaattcttcattgctaatatagagaaatacagtttattttcgtatgttgataaaccataagttctagtagttgtcttatagaatccacaggattttcaatctagataatcatgtttgggaatagagacttttattttttcttttcccatctgcatgctttttctttctttctcttcccctactgctctgaggacctccaatacgatgctgaacaggagtggtaagaacacacacttggccaggcatggtggctcatgcctgtggtcccagcactttgggaggccgaggcaggtagatcacgaggtcaggaattcaagaccagcctggccaagatggtgaaaccccgtctctactaaaaatacaaaaattagccgggtgtggtggcaggtgcctgtagtcccagctacttgggaggctgaggcaggagaattgcttgaatcagagggggcggaggttgcagtgagccaagattgcgccactgcactccggcctgggagacagagcaagactccgactcacaaaaaaaaaaaccacaaaaaaacaaaaaaacaaaaaaaaacccacacacacactctggcttgttcgcaatcttcaagggaaaatattcagtctttcacgatcaggcacgatgtttgctttcatttttttagtacagatgtcctttattcgatttaggaagttctcttctggttgctgacagtttttatcgtgaacagatgctgaattttgtcaaatactttttctgcatttattaaggtaatcagatggcttttcttctttagtctgtcaatatggaacattacatcaactgattttcaactgttgaaacagctttgctcctggaataaatcccactgatcatgatgtattatccttttccatatactgctggactcaaatctctaatatttcattgaggatatgtatgtttctaatgatgagtgactggtttgaaattttcctttcttgtaatgtctgtctgattaggtattagggtattgctaccctcaaaaactaaactgggaaatagtccctcttctacttttccggagaagtttgtataaaattagcatattttgtccttattgtcctaaatgttgggaagtattccccagtgaagtcatctagatctggaattctccaggtgggaaggattttagctacagattcgatttctttagtagtagccattcagataatctatatctgagggaactgtggtagtttgtgcctttcaaggaatttgtcaatttaatctgcgtggctgattttatgggcataaagctgttcaaaatatttccttattagtccttttatgtctgtagggtctgtagacatgtgcactctttcatgtctaatatctgtagtttgtgtcttctcttcttttctacactagtctggctggaggatttttcattttactgacgtcttccaagagccagcttttggtttcattcattttctctcttgttttgcatttccaatctcatggattcctgctctttattagtttcttccatctgcttgctttgggtttcatttgtttttcttttcctagcttcttaagatagaagcttgggtcactgatctgagacttgttttattttctaatatgagcattgcccaggctggagtgccatggcacagtcgtggctcactgcaacctctgcctcctgggttcaagtgatttccagataatttttgtatttttagtagagatggggtttcaccatgttggccaggctgatctcgaacttctgacctcaagtgatgcacccgcctcggcctcccaaagtgctgggattacaggcatgagccaccgcgcctggccgtgttgtccatttttatccttggtaatattccttcatctcatctgacatcgactttgtctgatactaatatagccactccagttttcttttaattggggctttcatgatatatcttcttccagccttttttttttttgagatggagtctcgctctcttgcccaggctggagtgcagtggtgcgatcttggctcaccgcaaactctgcctcccgggttcacgccattctcctgcctcagcctccacagtagctgggactacaggagcccgccaccacgcctggctaattttttgtatttttagtagagacgaggtttcactgcgttagccaggatggtctcgatctcctgacctcgtgatccgcccgcctcggcctcccaaagtgctgggattacaggcgtgagccaccgcgcccggccttttttattttttgagaaactgtcttgctactctatcacctgagctatactacagcagcacactcagagcttccttcagcctcagcttcccaggctcaagcaatcctcccactttagcctcctgagtagctgggagcacaggtgtgtaccaccacactaacctaattttaaattttttgtagagatggggttgctatgttgcccagactggtctcaaactcctgtgctcaagcaatcctcccacctgagcctcccacagtgctgggattacaggtgtgagtcacttcgcccaggccaaccttctgttttccatctaagtattgatatttaaagtgggtttttcctgcagacaccatagagttggggcttggactttccatccaatctgacagtctgtcttgttgttgtatttagaccatttgtatccactgtgatcatttataatggctgggtttaggatataattttccggagaatgttgccttctttgttttagcaggcgattaagctggttgggttcagaccacaagtctgtatctgtggatggtggattccagtttctctgttttcaaagccttggttctgatgctttgctctgccctgaacatgcaccactcaggagtcaatctgagattcgaggtgaagtttgaatctttgtttttttttttttttttttgagacggagtttcactctaccacccaggctggagtgtagtggcacgatctcggctcactgcaacctccgcctcctgggttgaagcaactctcctgcctcagccccctgagtagctgggattacaggcacacaccaccacacttggctaaatttttgtatttttagtagagacggggtttcaccatgttgaccaggctggtgtggaactcctgacctcatgtgatccgcccgcctcagcctcccaaagtgctgggattacaggtgtgagccaccgcgcccagcctgaagtttgaattttttttttcctgagatacagtcttgctctgtttcccaggctgtggtgcagtggcatgatctcggctcactgcaacttctgcctcccgggttcaagcgattctccggcctcagcctcccgagtagatgagactagaggtgcgcgccaccacacccagctaatttttttgtatttttagtggagacagggtttaaccatgttggccaggacagtcttgatctcttgaccttgtgatctgcccgcctcggcctcccaaagtgttgggattacaggcgtgagccaccgcacctggccttgaagtatgaatcttaatacagtttcaaagtctttgttatgctgctctgggtctgtcctgagccttgtacaggttcacagacaaaatctgtgcatctacttccctggctctctcctccctgagatccacacactctctctggcccttgggggcccttcttctggtgcttttggaggattcccatcagggcttttgctccataactgggctaccatcaaggcaaggccatgagtaacagaagaaaacgaaaaagcaggaagcagaaccctcgtgggtggcggctccacgatgactatccacagtctactggctttattttcggagttctccaagaattgttttctgcattctgtccagagtttttcactgtaatcagcaggacaggctgttgtggcactaccttgccacagcagaactgtaactctcccatttattttagttaaaaataaaatcttaatttccttcttctttgagagcctgaatgaagatgcctaacacatcaccacagatactaaatcaaacagcagctgctcacctgtgtagaccaggctcacggctgctgctgttcaggagaattccaatgtaccttcctgcacgaggccacataaacgagaacccaaacaaggaacttagagggtgcccaatctcctggtgctgggctccaaagcacaactggccgacactcaggcctgctgcgggccccgcacatcgagcacaccagatactcagctcttggcacatgctaatcgatctctgagactcagcaatttttcttccacttggaattttgttccgttcctttcaaaacctttatgtagagcaagttcctccctaagagagctacaccacaccacaagaaacacaagcacagaacggttgagaggagtcatctgccagccccaacagccggggtccagcgactgaaatcacggcctgctccagactcaagggagagacacccccaccaaccgcatcagctgggcaagtctcatctccactctggaatcagggagaaaagcacgtgcgtgtgtttgggggcgggtggggaaaaagaataacaacttagcagctgttgctaaaaatggcttttgtgtgttttatttcaaatccacttgtttacttcaaaaaaccatgccttcataacctcaccccagatcaggaagctgtgaaaaccacagggagaggctggatgctgggaagcccaggtggacacgcagctcctctggcaggcaggggtccccgagggctccccacacttgcacatcttcagatctcggcagtgctgtatgtagcagccagcaatcacacccaacccagctgtcactcagccacggagaaatcaacggtggtgtcaacgactgaactagaacgacacccactcacgccaatgaatctcacgttcataatgttgctcaaattaggaaaggtgaggaatcctggtgtgatgccatttatgagatttagagtcaagcaaaattatactacatattgtataagtaccaaagaaaattcagaaaagtagctatctctgaagaaaagagaaggtgaaatgagagcacacgtgggtaatgtgaacagagccggcagtgtgcatctaacctgtgttctagctaaccagggttaaaactatataacctgggttcgagttaagatgcctgtttgctgtgtcatgcctacttgttttagagacagggtcctgctatgttgtctgggctggcctagaactacgaggctcagcaatctcctttcctctcccgaacagccaggactataggtgccaaccgccattcccagcaacatcacgcttttttgcgtatctgcggtattttgtaacaactttataaaaattaaaataataaagactatctcccattaaaaatggtgggttgggccaggcacggtggttcacacctataatcccagcactttgggaggcccaggagggcagatcgcttgaggtcaggagttgaagaccagcctggccaacatggtgaaaccttgtttctactaaaaatacaaatattacacgggcatgctggtgtatacctgtagtcccagctactcgggaggctgaagcacaagactcacttgaacccaggaaatggaggttgcagtgagccaagatcacgccactgcactccagcctgggtgacagagtgagactgtctccaaaaaagaaaggtaagttgaaggtaaatgcttatctttgtccccttgtggaatatacatgcttatctctgctctcttaaaaagatacaaacctccaaggataaagacaaaagctaagagtagataaaaaatgtcactgaaattttagcggctgatgaaagcaagtgacagggtcatggctggtggagccctctaaggaaagctgacacttggttttagaggtgcagaacctggacagagaggactggtcctcactgcagagccagaacgaggctaacatgcaggtgagacgggaagaggggcaggctaaccccaagtcactttcctgaccccaacaggctggaaatggcttttccccgtggccagaggactaccaggaactctctggagaaggtgaagcaagcaggtaagagcccaaggacatcaggtgtggctacgaatccaagaacagtgtccactccagacgggagcactcccagactcctcagtgagtgtccactccagacgggaacactcccagaatcctcaacaacagtgtccactccagacgggagcacccccagactcctccccaagtgtccactccagatgggagcactctcagactcctcagtgagtgtccactccagatgggagcactctcagactcctcagtgagtgtccactccagacgggagcacccctagactcctccccaacagtgtccactccaggcgggaggactcccagaattctccacaacagtgtacactctagacgggggcactcccagagtcctccccaacagtgtccactccaggcgggaggactcccagactcctccccaacagtgtccactccaggcgggaggactcccagaatcctcaacaacagtgtccactccagacaggagcacccccagactcctccccaagtgtccactccagatgggagcactcccagactcctcagtgaatgtccactccagacgggagcacccccagactcctccccaacagtgtccactccaggcgggaggactcccagaattctccacaacagtgtacactccaggcgggaggactcccagaatcctccacaagtgtccactccagacgggagcacccccagaatcctccccaacaatgtccactccaggcgggaggactcccagaatcctccacaacagtgtccactccagacaggagcatccccagactcctccccaagtgtccactccagatgggagcactcccagactcctgagtgtccactccagatgggagcactcccagactcctccccaacagtgtccactccaggcaggagggctcccagaatcctccacaacagtgtacactctagacgggggcactcccagactcctccccaacagtgtccactccagacaggagcacccccagactcctccccaacagcgtccactccagacaggagcactcccagactcctcagtgagtgtcccctccagacaggagcactcccagaatcctccccaacagtgtccactccaggcgggaggactcccagaatcctccacaacagtgtatactccaggtgggaggactcccagaatcctccacaacagtgtctactccagatgggagcacccccagactcctccccaacagtgtccactccaggcgggaggactcccagaatcctccacaacagtgtccactccaggcgggaggactcccagaatcctccacaacagtgtccactccagacgggagcacccccagactcctccccaactgtccactccagatgggagcacccccagactactccccaacactgtccactccaggcgggagcactcccaggctcctcagtgagtgtccactccagacgggggcactcccaggctcctccccaacagtgtctactccaggcgggagcactcccaggctcctcagtgagtgtccactccagatgggtgcacttccaggctcctccccaacagtgtccactccagatgggagcactcccagactcagacaggagcactcccagactcctccccaacagtgtccactccagatgggagcactcccagactcctccccctcctccaacccagtgccaccacagcagaacatacgcagattcctttctgagaagctgccctaaaaaaaagacctacagaccctgacctgtagactcccaaaccatgaaggaaagagccagcgtcctgctcagtcctcctgcagggagtgtcccctgttaacgagccctgaccccatgcacacgcagcctatatgcagctttcaggtggatcacgctgttttcgttttgtagttaacccatgtaactcccaccgaaatcaatatgtagaacatttccagtaatctagattaccttacgcctccccgggtcgatacccaacctaaacccctaacaggcaaccactaatgagaccttaaccccagcagggccaaacaccaggaccaagtccctcgaaccgcgcgttctaacaggcaaccactaatgagaccttaaccccagcagggccaaacaccaacaccaagtccctccaaccgcacgttttttgtaaaggaagttttttttggaacactagatggccacattgagtagctgcaagagagaccacgtggcccataaagctgaaatatttacactctggccttttacagagaaagctggctggccagcctctgtcctcaagtgtcagtacagctggtagctgagcctcaggtgagtgaaattacacagtgtgtgctttttgttgctggcctcttgggctccacattatttctgtgagatgcagctatgctggtttgcacacttgtgttcaataagaacttcattcacacataaagtgactgctggaggcagaaaagcccctgatcagaaagacagaagccaaaataaacagagaagaaaaactcaggtcagaaacaactcagggagcaaaagaaaacccatcttactttatccatgaagtaagaacaagataatttttaaaaattaaaacataagaacaaagatacttttttaaaaagaacattcagggccaggcgcagtggctcacacctgtaatcccagcactttgggaggccgaggcaggcggatcacaaggtcaggagtttgagaccagcctgaccaacatggtgaaaccccgtccctactaaaaatacaaaaattagctgggcatggtggtgggcacctgtaatcccagctactcgggaggctgaggcaggagaatcgtttgaacacgggaggcaggagttgcagtgagctgagatcacgccattgcactccagcctgggtgacagggcaagaccccgtctcaaaaaaaaaaaaaaattaacagaaaaaacctcttgaaatgaaaaatatgacagaaattaaaaattcaatggaagatttggaaaataaagttgaaaaaatctagaaagtataacaaaaaggctgggcatggtggctcatgcctgtaatcccaccactttgggaggccgaggcgggcagatcacgaggtcaggagatcgagaccatcctggctaacatggtgaaaccccgtctctactaaaaaatacaaaaaattagccgggcgtggcagtgggcgcctgtagtcccagctactcaggaggctgaggcaggagaatggcgtgaacccaggaggcggagcttgcagtgagctgagatcgcgccactgcactccagcctgggcgacagaccaagactccatcacaaaaaaaaaaaaaagaaaagaaaaagtacaacaaaaagacaaaggtggtgtagaataaagacaattctagatttctaaggtttccaaacatacacctccctggcatcctgtctcaggaagtgaatggaggatttgctccaccaaaacacgccggccgagaaagcagcagcaagagccctgtgtaggggaaggaagggtgggtggtcctgggatggcgtctggacagcaggcctggggagggtccgactgggcaagaggatgggggctcctagcaggggcgcttcccagagcaaaaaagcattcacggagccgctggttcaggcgtgaatctgtaatgggtgcatataaaaatcaccaagaggccaaaaataagccgctggttcaggtcgtgaatctgtaacaggtgcacagaaaaatcaccaagtagccaaaaataacacaactgttaattccaagaaaaagagaaagttgcaagaaaggaaatttaactatagtacactacatagctcagctgtgaatagtatccatgaagtcgaaagaaccgcccatgagcggtgcagatgggaacgtagcatgaggcatgggggcaatctacggagccacacttcatctcccatgacaggaagcatgggggccatccaccgagccacacttcatctcccacgacaggaagcatgggggccatcctccgagccacacttcatctcccacgacaggaagcatgggggccatcctctgagccatacttcatctcccacgacaggaagcatgggggccatcctccgagccacacttcatctcccacgacaggaagcatgggggccatccaccgagccacacttcatctcccacaacaggaagcatgggggccatccaccgagccacactttatctcccacaacaggaagtcagtgtgtctagaatggatgggttaggaaacagcaagaaaagctgctcagaaggaaccgaagcgttttcagtgtgaggggacagacggccactgttgataaaactttaagtatgtttttagaatctgtccatgttattttgcaagaatttaagttttgttaaaatgacaaacacaaaagtttgatgaggaaaaacgatgtcacggcagatgatcaactgatcacaatacagaattacctctctcagatatcacccccatttttttttttgagacagagttggagtgtcactctgtcaccaggctggagtgcagtggcacaatctcagctcactgcaacctccaaatccctggttcaagggattctcctgcctcagcctcccgagtagctgggataacaggcacccgccaccacacccagctaatttttgtatttttagtagggatgggtttcaccatgttggccaggatggtctcgatctcctgacctcgtgatccgcccacctcggcctcccaaagtgctgggattacaggcgtgagccaccgtgctcagccaatcacctcccattttttactcccactacactcagggaagatccattcccacccctaagggagaggggctgtgacaccaacgcggatgagacggatcgcagcagctgagaggaacccggcccgtctcagcgcacagctcccctctcctggaacaggcatggctgcactgtgataagtgaggcccaacctgaatatcacaacaagatcaagatcagaaagaacaaagaaataatggagaaagcctctaccccagtgaagctattttttgcttaaagagaaacgaatcatccaaggtaggtcgcatacagatgccccgtgctgaacgggtttacgtccacgtagaccaaagctcctgtggtcctttcccagtttttctcaggcccacaggtgccccttacacatccaggagtccctgagaagcccacctcagctccagagacacactaaccagaggctccaaagaggtgcacagaggtggatctggtggctgggaccccactctgccccaagccacgctgggggctccctcgaagatgagcaccggccttctaacggcaggtcagccttgctcaaaggaggtgggtgtcttctccctccccaggccggcagcctccccagcacaggccacgcgtcacgtgaagatacacaagtcccagggagcacaacgagatgccgaggtcccacccacgcctccaccccaggccccaaacagctcaaagcgcacctgtgcccatctgccggggagcagagtgagcaccctggacaccccgatgtctggctggagcttgttacgtcctttccgagcagaggaacataggatgggatcagaggacaccacccaggctccagtgcgaggtttcatgcaaggacctagcgcttggttctgcctgaatgcatccgagccagggttctggtgagctctagaaaactctcctaacaaagtctagagaaactgaggtagaagttaccttgatacacagctaacaatgaatgcaaaaggtgtaactcaaaagagtaagattaaaatcagttacctcttttgagttgagaggcatttagcaaaattcagctaatggacactaaagatttgtttcactgcatgtaggttttactcaaagaaaaaaagattaaacacacattaaattccagttaatgggccaagcgcggtggctcaggcctgtaatcccagcattttgggaggctgaggtaggtggctcacttgaggtcaggggttcaagaccagcctggccaacatggtgaaaccccgtctgtactaaaaatacaaaaattagccaggtgtgatggcacattcctgtaatcccaggtactcaggaggctgaggcaggagaattacttgaacctggaagatagtggctgcagtgagccaagatcgtggcactgcactccagcctgggcaacagagcaagaccctgtctcaaaaaaaacaacaaaattcaggctgggtgcagtggctcacgcctgtaattccagcactttgggaggccaaggcaggcagattatgaggtcaggagttggagatcagccttaccaaggctgttctctactaaaaatacaaaaattagctgggcatggtggcgcatgcctgtaatcccagccactcgggaggctgaggcaagagaattgcttgaacctgggaggtggaggttacagtgagccaagattgcgccattgtactccagcctgggcaacagagcgagactccatctcaaaacaaacaaacaaacaaacaaaaaacaaaaaaacttctagttaatggcttggcatgatggcttatgcctgtaatcccagcattttgggaggctgaggtaggcagatcacttgatcccaggagttcaagatcagcctggccaacatggcaaaacctcatctctatctctacaaaaaaatacaaaattagccaggtatggtggtgcacgcctgctacttgggaagctgaggtgagagaattgcttgagcccaggaggcggaggttgcaatgagcaaagatcatgccactgcctgggcgacagagcaagacccagcctaaaaaaaaataattctagttaatgttgggcacatggggtgattttactatttttgcacatttttgaactgtctcataataaaaagttaaaaatcatgagacaacatgatacatgattttttgttttgttttgttttgttttttgagacggagtttcactctcgctgcctaggctggagtgcagtggcaggatcttggctcactgcaacctctacctcccgggttcatgcgattctcctgcctcagcctcccaagtagctgggattactggcgcctgcccctacacccagttaatttttgtatttttagtagagacggggtttcaccacgttggccaggctggtctcgatctcttgaccttgtgatccacccacctcagcctcgcaaagtgctgggattacaggtgtgagccactgcgcccggcccggcagcacctttcaaaattacaagtctgcatccctgggaccctgcaagtccaccctaggatttatcctgcagatcaggctctggtatcggaaacgatggacacaggaaaccattcactgcaacgacgaaaagcaaaagactgggagccacagaaagacggcgccagcagggaagagcccagcaggacctgcaggaaacgggggtggctggtccctcgggagggccttgggcctgaggagaggagaaaacgccttccctctacaacactttgtgccttttgaatgctgaaccacatgcatttatgacccagttcaacaacagtcatttaagagacaaccaaaaccgttagccacatgcccggctattcttcaacgcactgtggccagaatgaagctccctcctctttcttccctccttcctggaccaaaccctgctcccctcacatcactgtggagaactggcctttaaccactaccagctgtccagacaagacagaaaaaccaggcctccggggccaacccaggggcgcccggagggccaggcagcgggggactcacggtgatgatgtccaggatgctgagcaggctgtggacgctgtctcccgccagaacctctttcaccaccacctcggtgccgtcctgcgcttggagagcagagtgggtgccgtcaggtctggggctgcgaccgcggggcctggcggaggctcagcccagcccagggcagtggggccacgggcctgcacctctgaggcgccatgagagcagcaggcaccttggatggagggcaggggacaagatggacctgctggcatcaggggtacaacacacaggaagcggcagcaaggaaaacagacggaggagaccccacctctccatcccatgactcgtcttcaatgtggggactgaggcaaaagctcgcagagcctgtttgtttgctgagctaactataaggactccgaggaccgattcagttattaccagcctaaattccagaactttgatataattttccattaggtaaaaaaagaaaagaaaccgcgctattttggtgatttaacaaagtaagcacttcatctcagcttgacccaggaaaattctttatgaagttgcccaaatctggccccagtcccctccatgagcccctcccatctagtccaaaggccagagggacacgggttctggtccttcaggagggccccgcacgagcggcaacgaaagccgctgcttcaccagctgggcggcctcatccccaggagctactggctccagcttcccccaagcccctttcccttctaataacccatcaagtccagccacagacaaagcgacaaacctgagaaccaaataatttgcccagcagcgcttttggtctagaaaccccgacaggcagtgccggagctggcgtgggatcacagcccactcccgggaccacagctggcaggagccctgcaggtcagggtgatgatcacacaaagcccagggtttgctgagtgcgtgctttaaatgagaacaagcaatgggaagtctgggtcgcaaactgcccagacagacaaagccacaccaccctccaggagagcaacacagcgccaaagaggccacggcagggtctggcccagcacccacccccgagcagcgattcaaagggtggaatttaacagaggcaggaaacaagtattgagctcctacgtggattcacacccgaatttttttttttttgagacagggtctcgctctgtcgcccaggctggagtgcagtggcgtgaacacagctcactatagccgcaacctcccagactcaagcgatcctcccacctcagcccccaagtggctgggaccacaggtgctaccaccatgcctggataattattttttattttttgtagagacggggtctcactacttcgtccaagctggtctctaagccgtgggctcaggtgatcttcccaccttggccttaattactttcttacaattaatttaattttgttagaaacctgaaaatagagcaagggttcaatggaccatggcaaatcaacacagtgacttactactaaactatcaaagggagtattctgaggacttggaagatacatttaaaacagctgcccagcccagtgcctcatgcctgtaattccagtgctctgagaggacaagatgggagaatcgcctgagcacaggaattgctgatgagcccggacaacaaactgagactccatctctacaaaaaaattttataagtgagctgggcatggtgacatacacctgtaatcccagctactcgagaggctgaggcgggaggatcgcttgagcccaggaagtccaggcctcagtgagctgagatcacaccactgcactccagcctgggtgacagagtgagaccctgtttcaaaaaactaaataaaatgtaataaaaaataaaaacggtgagttttcccccaaagaaattaaaatcaaaattttgcctagcttttcaatgagaaacgttttacagcccgagaagacagacgtggaggtaaatgcgcagccgcctgaccccgccccgccgccctgcgactcacagtgtcctggatgcagacctccagccgcccgtcctgcaccacacagatgctggggtccggctccctgggctggaagacgtgctccccttcctgcagctgcacaaagacgatgtgtttgcaaagctccaggaacagcggcttctcaaagtggcccaggaccctgcaagagccagagggcactgtgggacgcccttccaggggaggaggacggcctctccaagagtctcgagagcacacggtcactgaccccactggcgccaggctttgtgctgtgggtccacacggctgaccaacaaaccacacagcattactgccaaacacaaccgtcaacttctgaaattcccgtgagcctgttttccatcacctcagagaacttcttgacccgtgaacctgagccacacacacacgggaggaaggcaaaggtggcctccaggatggtgagctgggccagggagcggaaggggtgcagtccaggggccaggcagcaagacaggagcacagagcagaacccaggctccaggctttggatccaccacacccttcttgctcttgccctgggttcaccgctgaagatgaaacaccgggaaatcgttcaacagaacaagaaagatctggtgaaggagccagcagaccacgaggccccgccacggggcacagacaccagcagccccacgatgcgctttgccaaccattcccccaacacaagacggccaagctggagccaggccccagcgagaagcccggggctatgggagctgccgcagcccccggggctcatccccgctcttaccgaacgtttttcagcatgtacagaacttccgatggcaggtgagaattcttcacgtcaaactccgtgaggtcggcctccagcagggagggcgggggctccttgggctgcagggccgggtattccttcttgaaacgcagaatcctacaaggcagagacacactagccttgagcagaccaggcgggttcgaaacccacagcatcagtggctgacacaccaggcagctcagggttggggaggccagcaccatggggggcacctggggcaggatgtggtctgaaggacacacagtacctcttggccaaagacagcaccttggtcctcttcctggcccgctgccggggcagggcagtgttctccacaagggtgttggggagtgtggtcacctgcagagccaagggagagaccagccactgaccctgcaagccgcaaggtccaagctctttgccatggggatcagtcctcaggacctgcctgtgggcctcccacagtcccagcttcagctcctggggtctggctgtgccattttcccaccctgcctggcctgtgagggaatgttggcagcgatacagccccacacatccttgggatcgtcctcactgtccccaaacagccaaccctccagagcccccaggcttcatgcctgctggccccgctgccccgaaggctgacacccgctccatctttggctctcatactggtcaacacaaccctttgctacaaccctttaaaaatccaccactgtccccaccgaccttcccccccaacttcccctctgacctggggccactgcccactctgtcccatatctggaacagtcttcctcccttttctcaggcagtgcctgcttgactgcccagaatagcagtggcctgggtcacaccctgcatgctggcagggtcacctcactcaggccccactgcctgctgcccctcggtccagagctgtcagcctcatggctttcctcccaggccctcagcttccctgtcctctgtggggccactggatgatggccgacactcaacagaccgcctccactctgctccagaccaccctacgccctgtcccggccgcctaagcctgtcccagacccagcctacagcagccctaactcatctgccctttcacagcacttaatgcggatgagaacagatgagtcacagacacccacatccctcccctcttgagtttctcaattttctttttgttttttgtttgttcgtttgtttttgagatggagttttgctcttgttgcccaggctgcagtgcaatggcacgatctcgactcactacaacctccgcctcctgggtcctggctcaaacaattctcctgcctcagcctcccgagtagttgggattacaggcgcccgccacaaagcccagctaatttttgtatttttagtagagacagggtttcgccatgttggccaggctggtctcgaactcctgacctcatgatccgcccacctcagcctctcaaagtgctgagagtacaggcgtgagccaccgtgcccggccgagtttttcaattttctatgaagaacacgaattagttgtacaaccagaaaaaggtaacaaagattgctttaaagggatcagtctgtgcggtttctgtgaagcttctgggtggtctgttgagcacctcctgggcccttcaggagtgcagggaggcggccaggggaggcctccgacagcccaattggccaaagacgaggaagggttaaaccaaggctgcttattccccagatcggggcttgtgaaactcggatccctgagccctggcccagggatctgtgtctaggttccggaaccacccagacattcaaagtgagtcacgcagctttcagcttagagcacacatgccggtaaccagggaactcagcccctcaaatcccaggggatggactctgtcctcagctcagcatcccaaagcctggcagagacctccaagcttggcagcagagtcaggaacctctggccgagcgtgaggccctctgcacccactgggccccagtgatgttcctagaaagcagctttccgttctcacttattgttaaaataaacatccactctgggggccgacagggcctttgtgagcggcaagcgactgagggcatgagctgttccagtataataaaatatataaaataagaatagttatactacatatagatcttagatatgattatatatgaatatcattaatcattagcttgtagcaattactctttattccaatattataataatcctcactctataatcatagcctaggaaaaaccaggccatacagagataggagctgaggggacatagtgaggagtgaccagaagacaagagtgcgagccttctgttatgcccggacagggccaccagagggctccttggtctagtggtgacgccagcgtctgggaagatgcctgttgccaagcggaccgtgatctagcggtagcgtcagtgtcaaggaaaaacacctgctacttagcagacagggaaagggagtctccctttccccaggggagttcagagatgactctacccctccacctcctgtggagggcctgacatcagtcaggttcgcccgcagttatccggaggcctaaccgtctccctgtgatgctgtgcttcagtggtcacgctcctagtccgccttcatgttccatcctgtacacctggctctgtcttttagatagcagtagtcaattagtgaaagtactaaaagtctctgatatgcagaaataatggcataagctatctttctctctctctcctctctctctctgtctcggctgccaggcagggaagggcctcctgtcaagcagacacgtgaaccacgggaccttacctatcattggagatggctcacactccttaccctgcccctttgtcttgtatccaataaatatcagtgcagcctggcattcagggccactactggtctccgcgtcttggtggtagtggtccccaggacccagctgtcttttcttttatctttttgtcttgtgtctttatttctacactctctcgtctccgcacagggggagaaacccaccgaccctgtggggctgggccctacaggccttccctcccctccggccactgtgcaccacagacattcctgaagctgcccctccaggccagggggagtagaggcctgagagggtgaggggttattcttgggtaaaacacactggattcagctggaggaagcagacaccattcggcacaatttataatttcccccaaaccctgagcctggtggcagagctgggaagctggggagaggacagcacacaccaagcactgcccagcctgggggagcccacagcagaaggggtccctcccacaggggcctgctcgaggaagccgtgtgcagcctggggccccgagcaacagctaccttcctcatgatcttccggccgtaaaacatcactttgtctctcttccggaaccggtactgaggagtgggctgtgcttgtcctgcaggggagtaaagggatggcctgaggtagagccgtggcacaggcctggtcctggacatgcaggtgcagcacagtcagtcatactctcgtccctgccagtaactggccatactcagacagcatgagggaagagggcctgagtgacaggctcatctccaacaaagggggctctcccctcttcccactgaagccttgctcaggagaggagaacagaaagggctctgaacagacttggcttcctggaaccgacgggctcagcctgagcccagacgggccatcagattctagccaaagccaccatgcgcttgagggcccctcccaggggctcaaaacacatcccaagacacccacgctttcccccaaccccccgggccagagtcggaaccaagatactcacgaaattgtctaagccttctgaacatgaaaaggatgaggacaccaaccaaggccagggccaggagggctccaactgcaatccccgtcagctggccgagagtggaaacacggcgcccatcagcaaagccacaaacctaaccctagccctaagcctgcccccacccctggctgcccaaccacaggctgggcaggaatgagccaggggatggggacagggagaggtgaaaaaggccacggcccatccaggtctggctccagggaagcgtgaggtgattaccatggtggacggtgaaccttcctccgtgaaccacagtccccaagagtgcagggcggtgcccaggcagaagtcagcctgcagcagagagcatggggtcaggtgggcatggacaggcttcccagcccgaacttgttcagagcagcaggaggagagctgggagttaggggagaagtcagcagccctggagacttctgggaagaagtgatctcgcccggggtgccggggtcctctgagccccctgctaggaagcactcagagagcaacctggctccctcagtcactgggatacagtggggcagggccagcggctgccccaggcatcactaacacacccacatgctggtgatgcaatccttgggatgcaggtctcagggagcaggcctggccaaaggggaggccaaggcccccctctcagtgtcgcctcagccccagcaggagcagtgctcaaaacccctatgagccatctggattctgagaacattcaacaccagttcacatgccaaacaaggaggcagcggccgagaaggctctgtgtcctgcagtctcctggagcagcaggacttcagaagtccaggtccgcgggagggagggaagagagggtgagggcaggatggtgagtgaacgacagcagaggacgctggtggttccaagaagtgaaagagaaaacgagaagacgagaagacgacaccagccagacaggcagccctctccattcctgctggcatcacaccttcctcccaggcagccaggaaccggatagggcaggggaagccactggttcagcctgaaagtttctacacaagagccaaggcctaaaacaacacccacccccgcctcactgcagagagcaggactcccatccgtgccagaaaatccagggaagggccgggcgcagtggctcacgcctgcaatcccagcactttgggaggctgaggcgggcggatcatgaggtcaggagatcgagaccatcctggctaacacggtgaaaccccgtctctactaaaaattcaaaaattagccgggcgtggtggtgggtgcctgtagtcccagctacttgggaggctgaggcaggagaatggcgtgaacccgggaggcagagcttgcagtgagctgagattgtgctactgcactccagcctgggcgacagagcgagactccatctcaaaaaaaagaaaactcagggaagtcagaagagcactcagaaacgcatttaaagacacaattctgcaccaagacagaatgaggacgtgcccagaaagctgagcccttcgaacttggttcagaagcaaatacaagccctgggagcttctgcttcaggacaggggaacccctacgctcactctcaaccaggtggggagcagagaagcacctacgaccatgtccctcacttaaggaagcgaagtgagtccctcagcccagcaaccgcttctgggaccgattatccaaggaaggcctatcacgcgatggcccgtgacctggtcacaggctctcctgcggtggagcggctcagccttttctagcttttcactgttgctttaatgggtccagtgttctggtttaggaaataaggcctttgccatgtggctacagatgtttgactaagaaaaagattctagggctgggcacagtgtctcacgcctgtaatcccagcactttgggaggccgaggcgggcagatcatgaggtcaagagttcaagactaggccgggcacggtggctcatgcctgtaatccctgcactttgggaggccaaggcgggcggatcacgaggtcaggaaatcgagaccatcctggctaacacagtgaaacaccgtctctactgaaaatacaaaaaaatattagccgggcgtggtggtgggcgcctgtagtcccagctacttgggaggccgaggcaggagaatggcgtgaacctgggaggcagagcttgcagtgagttgagatcgtgccactgcaatccagcttgggcgacagagcaagactccgtctcaaaaaaaaaaaaaaaaaaagttcaagaccagcctggccaacatggcgaaaccccgtttctactaagaatacaaaaattagccgggcgtggtgcctgtagtcccagctacccgggaggctgaggcagaattgcctgaacccaggaggcggaggttgctgtgagccaagatcacaccattgcacaccagcctgggcgacagagcgagactccgtcttgggaaaaaaaaaaacacagaaaaaggttctaagcaaaaccatcaggcaaagtcctaaaggaactggaagtagcaactgtgaccttaggggaagaaaagacaaggcctcaggcaatgcccatgggccaccgctggctgccctcgctgtgaacaatgcccatgggccaccactggctgtctgctgtgacaggcgcgtctaacaagtgctggcagctgtgacaggcagcagagaggggccagatccaccactcccacagtcctcaggcgccaagaagccacggggccaaagagcgcggcagagcagacgccaagaggacccttctctgggtccagaaatgccccccaactgggaaatccaggcatctggtcccccgagttacatacctgtgggctgtcatctttctcttcctccatggccagaaacagaaaaaacagtcaggggcgaaaagcagacagcctgaagcaaacaagggcacacctctacccgctcatgctcacacctggacacttttccctgggttcctttcaagtcaaattatgtttcactgaaaggaaaatcctgctgaaaaagtctgttctccaggaagaaaagctgtcttttgagaagtgtctgtcatctgctaggagccacctccttccctctgtaaacagccctcacgtggctgtcccggaacccagaacagcagccagatggggcgtatccaagcaggtcaagaggagccaggcccagcgcggcggggatgggggcagc

SEQ ID NO: 745 - DNA, 90582 bp, Homo sapiens; identical to SEQ ID NO: 744

SEQ ID NO: 746 - DNA, 699 bp, Homo sapiens
gcggccgcggccaatcggagccgctcttgctgcgacgcagcggtcggaagcggagcaaggtcgaggccgggttggcgccggagccggggccgcttggagctcgtgtggggtctccggtccaggtgagtctgtcggattggggcgggcgccgcgcgcggccaggggcggggctggccgggttcccggggccgcgactacccgctctctcctcccgcagggcgcggcatgggcgtcctggccgcagcggcgcgctgcctggtccggggtgcggaccgaatgagcaagtggacgagcaagcggggcccgcgcagcttcaggggccgcaagggccggggcgccaagggcatcggcttcctcacctcgggctggaggttcgtgcagatcaaggagatggtcccggagttcgtcgtcccggatctgaccggcttcaagctcaagccctacgtgagctacctcgcccctgagagcgaggagacgcccctgacggccgcgcagctcttcagcgaagccgtggcgcctgccatcgaaaaggacttcaaggacggtaccttcgaccctgacaacctggaaaagtacggcttcgagcccacacaggagggaaagctcttccagctctaccccaggaacttcctgcgctagctgggcgggggaggggcggcctgccctcatctcatttctattaaacgcctttgccagcta

SEQ ID NO: 747 - DNA, 24027 bp, Homo sapiens
caaaaaacttcatttaatacaaatagttgcttaaacaagtatgaaaggctgaaagtcaaaatctgcctgagaaacttaacaaatctgcaagctggaaaccgcgtcttttccccactctctgccagacagaatcacccagtccactttcaggggcccagcagggaagctgatttaagagaagtcaacagcttttctgactacactgtggattccatcagtgcacaggcacctgcagggctgcagtaagcatctctgatgaggtggtcccgggcactcactcgcagtctccctcctggtttccttgtgggaaggggcttcatgatttcaagctcagttcccctcccactcccagaggtggagcgcatggtcatagaaggagcaggtggccaggaggctgaaggctgagtctgcttcttctgggttcacgccacagtcacgtgtggtggctgctgtagcctgcagccaggtgccattcttcctcatgccctctgtgagtggcttcattccactctggggtctggcatggccctccccatcgttatcctctctgcattcatgacagggtgttggcaactcgcttgcacccttcaggtctgccgtcttggttcctaggttgctaggaaaggaccacgagggggcccgctgcagagaacggaagagcagccaggaccagtcggctccatacaccagcgagtcgggcaatgtgtgagatgtcaggaccgtcgcctcctgcctctcctctggagtgagagatgggagaacccaggaaacacaacatcacccagagcctctccccaacctgtcacacctgacagggagactccaagaacagcccctcacaggtcagcaagtgtttcctgaggagccgttgtgtcatgcaaaggaaccagcaagacctgggcatatgttggagaagaaacagaccgtcatcttgcagtgcacacgcctgtgtgcctccaagagaagcatcaagcggggctacagaacctcacttgatggtgaagaatacggcaaaagccagagagggggaaagacctcagttaacacttaaaaccaaagaacaaaggagttttagccagctgggaaggaaggggatgtctgaggaacaggcagcatgtgtacagcagaggtgagaaagtccaaggctcgcacggggaaccacaaacaggcagccatggcactgtcagtgagtgacagtgggctggagcgtcccaagcatgcagggtccggcacgccctgtttcagagtctggattctggcttggaaaggagccactgacaaggttaagtgagcagtttctttatagaagttgctacggcaactggaaagaggccacaactgcctcccagagcacacagcaacagagggaatgacgaggcgtggccaaacccgaggcgatctggagtccaggaggcaaggccagggctggcaggggcagttgcagagagcaagtggaaggtgagccaggggctgcaaggctgggtggccacttgggctctgaaagggctgccatcgctacctctgaagtacagggattgatgccagcagtgaccggaatcagaaccagaatgagtgctgatggaagaagggctgagggcagaacaggaccgcactggattacaaaacgtgccgaggttgtatgggcctgggccggggaggcccaaccctgggcccagggcttcaactgggcagaggtggctccgaggaggagtgagatgctgaatgttcagagacagccacaggggccctcgagcagcatgtgtggggcgaccctcgggaggaagcccctggggaggccgttactgtcccttgggaggtagcgtcacagggcaggcaggacctccgctagtctttcatccagcaatcgctcaacacgtccactcgggccagcaggacctcttctacagcttaggaaaaggtaataaggcagagtctaagccctcagagagccacagcctgggaaaaagacagcgaatgagtggacggaagacactgttgcgaccccaagaatgggaggccctttctgattagccacaggccaacgtttcctccctctttttattttcaagacaggacctcactctgtcgcataggctggagtgcactgacctgggctctgtcttcctgcctcacctcctgagtagctgcgaccatcatgccccctagttttttctattttttgtggccacggagtctcactatgttgtccaggctagtcttgaactcccggctcaagcaatccgcccacccttcccagagtgctgtgactgcgagtgtcagccaccgcacccagacaatacaaattgttttaaaattaggccgggcgcggtggctcacacctgtaatcccagcactttgggaagccaaggcgggtggatcacaaggtcaagagatcgagaccatcctggtcaacatggtgaaaccccgtgtctattaaaaatacaaaaactagctgggtgtggtggcatgcacctgtagtaccagctactcgggaggctgaggcagcataattgcttgaacgtgggaggtggaggttgcatgagccaagatcgtgccactgcactccagcctgggtgaaagagcaagactctgtctcaaaaaaaaaaaattgtttaaattaaagatacaggctgggtgcagtggctcacgcctgtaattccagcactttgggaggccgaggcaggtggatcacatgagggcaggagtttgagagcagcctgggaaacatggtgaaaccccatctctactaaaagcacaaaaattagccaggcatgatggcgcatgcctgtagtcccagctacacaggagcctgaggcaggagaatcccctgaacctgtgaggtggaggttgcagtaagctgagatcaccccactgcactccagcctgggcgacagagcaagactctgtctcaaaaaaatacataaataaagttatgaaaaaggccagccgagcacagcggctcacgcctgtaatcctaacactttgggaggccgaggcgggttgatcacctgaggtcaggagttcaagaccagcctgaccaacatggtaaaacctcgtctctactaaaaaatacaaaaattagccaggcgtggtggcacacacctgtaatcccagctactccggaggctgcagcaggagagttgcttgaacccggaaggtgggagttgcagtgagctgagattgtgccattgtattccagcctgggagacagagcaagactccgtctcaaaaaagaaagaaaaagaaaaaaaggcctatacagagtacctgacaaaactggcctggaatgttgaactctcagacctgtcttagttcacctcttcaactttaagaactgaaggctggatgcagtggctcaagcctgtaatcccgacactgaggactgagttgaggcaggaggactgcttgtgtccaggtggtccgggctgcagtgagctctgactccaccactgcgctcccacctgggtgacaggacacaagaccctctctttaaaaaaaaaactaaaaactcaccatagccaaaaggtgaaaacaacccaaatgtccatcagaggatgaacagacagaatgtggtccatcattaccttcttaaaaagagaattctgacacatgctccaacaggggtgaaccttgaaaacgttaagctatgtaaagaagccggatataaaaagacacacgattctacttccatgaaatatctagaaaaggcaaatccccatagacagagtaaacggaggttatagaggctgggggagggatgtttggggtgatagaaaagttttgaaaataagtagcagtgatgattgcacagtattttgaatgtcttcttttattttttattttttttgagacggagtgtcactgtcgccaggctggagcgcagtggcgtgatctcggctcactgcaacctccgcctcccaggttcaaccgattctcctgactcagcctcccaagtagctgggactacaggcgcccgacctcaggtgatccgcccgcctcagcctcccaaagtgctgggattacaggcgtgagacactgcgcccggccttgaatgtctttaataccactaaattgtgggcggcaagccacccaggcaccgaggcaagagaccgaggacatgagctgttccagtaaaataaaatataaaacaagaatagttataccagatatagatcttagataatgattatatatgaatatcattaatcattagttggtagtaattactctttatcccaatattataataatcctcgctctacaatcataacctaggaaaaaccaggccatacagagataggagctgaggggacatagtgaggtgtgaccagaagacaagagtgcgagccttctgttatgcctggacagggccaccagagggctccttggtctagcggtgacgccagcatctgggaagacgcccgttgccaggcggaccatggtctagcggtagcgaaaaatgtgaaggaaaaacacccgctacttagcagacctggaaagggagtctccctttccccgggggagtttagagaaaactctgctcctccacctcttgtggagggcctgacatcagtcagacctgcccgcagttatccggaggcctaaccgtctccccgtgatgctgtgcttcagtggtcacgctccttgtccgccttcatgttccatcctgtacacctggctctgccttctagatagcagtagtcaattagtgaaagtactaaaagtctctggtatgcagaaataatagcgtaagctgtctttctctctctctcctctccctctctgcctcggctgccaagcagggaagggccccctgtccagtggacacgtgacccacgtgaccttacctatcattggagatgactcacactctttaccctgccccttttgctttgtatccaataaataacagtgcagccaaacattcggggccactaccggtctctgcacattggtggtagtggtcccccgggcccagctgtcttttcttttatctctgtcttgtgtctttatttctacactctctcgtcgccgcacacagggagaagcccactgaccctgtggggctggtccctgcactaaattgcacacttaaagtggctaaaatcatgcattttatgttacataaattttatcacaatttttacaaaagcagttaaaaggcaggagacccagtgtgtgcccaacagacaatgctggagtgtgtttaagaaactcaagcaaaggaaatgcaagtcaagggattaatgggcaagttctccttcaattatcaaggctacagagaaaagtatcaagtattcagaagtctaggaaacaccaccgagggcctctcctaagcgtctctcaggaggcaagctctatccaaacaggcggtggctgggaacagctgtcaccaggatggatgggagcacaacaaatagtcaattgcgagctgagacttaggaaaaaacaggtggggcaaggacagaaaaataatatgttaatgctgtgttctgagtaggaaaaaatgccattaagaatgggaagagatggccaggcgtggtggctcatacctgtaatcccagcactttgggaggccgaggcaggcagatcacaaagtcaggagatcaagaccatcctggctaacacggcgaaaccctgtctctaataaaaatacaaaaaattggccaggcagggtggctcacgcctgtaatcccagcactttgggaggccgaggcgggcggatcacgaggtcaggagatcaagaccatcctggctaacacggtgaaaccccgtctctactaaaaatacaaaaaaaattagccaggtgtggtggtgggcgcctgtagtcccagctgctcaggaggctgaggcaggagaatggcgtgaacccgggaggcggagcttgcagtgagccaagatcccaccactgcactccagcctgggtgacacagtgagactctgtctcaaaaaaaaaaaaaaaaatttgccgggcgtggtggtgggcacctgtagtcccagctactcaggaggctgaggcaggagaatcgcttgaacccgggaggtggaggttgcagtgggccgagatcgtgccactgcactccagccagggcaacagagcaagaccccatctcaaaaaaaaaaaaaaaaaaaagaaaaaaagaaaatcaccattttgccattaccataatttattcaagcaccaattgtctctgaattgggtaaaagtctgaaaagggagttattgacacaggttcaaagattctcaccacagattactgattaatcccaaagaggaaaatagtatctcttcagtgaagggattggggcaaacaccaccttaacaaagtgaccaaatttcacaaaaatggaacaatgtggcatcataggcccttgatgtgaggaactaaggagggcacagcgccactttcacaggtttcctggcaaaaatgcacgaccccggccaacatggtgaaacctcgtctccaataaaaatacaaaaattagccaggcgtggtggcaggtgcctgtattcccagctactcgggaggctgaggcaggagaatggcggcgtgaacccggaaggtggaggttgcagtgagccaagatagcgccactgcattccagcctgggtgacagagcgagactccatctcaaaaaaaaaaaaaaaaaaaagcatgaccccataccaaagactcgcctcagactcaggtgtgaactgaaagagaatgaaaacgatgcatcacgccacactgaagtgactttaccaatgccagacaaaactgactttaaaacaaaaaatgttactagatttaaagacagacactttatattgataaaagggtcagcacatctggaagataccagaattataaacatatataaaagagatccccaaaatacgtgaagtaaaaactgatggaaacgaggctggaaatacataattctacagttagagttggaggtagcaatagcccactttcttttatttttttgagatggagtctcgctgtgtctcccaggctggagtgcagtggcgcgatctcggctcactgcaagctccgcctcctgggttcacgccattctcctgcctcagcctcccaagtagctgggactgcaggcacccaccacagcgcctggctaattttttgtatttttagtagagacggggtttcaccatgttagccaggatggtctcgatctcctgaccttgtgatctgcccacctcagcctcccaaagtactgggattacaggcgtgagccaccgtgcccagccaacagaccactttcaatattgcccagacaggagattcagtaaggaaccagaagatctgaacattataaagccgagacctcacaggcacctacagggcactccagccaacagcagcagaacacacgtccgcaagtgcacaggggcactccccagcagagaccacactctaggccacaaaactaatctcagtaaattcaacaggaatgcacaatggaataacattagaaatcggtaacagaaagaaatgtgggcacttaaaaacatgtacattaaacaacacactcataaataaccaatggtcgaagaaaaaaaccacatgggaaattagaaagtaccttgagatgaatgaaaataaaaatacaacataccaaaatgtatgggttgcagcaaaagcagtgctcagaggaaaatgtatcaccattaataaagaaaaaagacctcaaattgttttaagatgagaaatattatggctgggcatggtggtcccagctactcgggaggctgaggtggaaggatggtttgagcccaggggctgggcacggtggctcatgcctgtactttgggaggccaaggtgggcggatcacctgaggtcaggagttcaagaccagcctggccaacgtggtgaaaccccgtctctactaaaaatacaaaaattagccaggcgtggtggcacaagcctgtgatcccagctactctggaggctgaggcaggagaattgcttgaagccaggaagcagaggttgcagtgagacgagatcacaccactgtacaccattctgggtgacagagcaagactccatctcaaaaaaaaaagatctcaaattgttttaatacaagaaatattatggcttggcatgggggtcccagctactcaggaggctgagatgggaggatggtttgagccccaggaggttgaggctgcagtgagctacaattgcaccaccacactccagcctgggtgacagagcaagacaccatctcaaaacaaaacaaaaaacgatgagaaatacaaagcacattcacagaactaacagaaacaatacagaagagatggagaaactaaagatgcaaaacacagaggaatacaggccaggcacggtggctcacgcctgtaatcctaacacttcgggaggccaaggcaggcggatcacgaggtcaggagttccagaccagcctgaccaacatggtgaaccccccatctcttctaaaactataaaaatcagccaggcatggtggtgggtgcctgtaatcccagctacttgggaggctgaggcaggagaatcgctagaacccaggaggcgaaggctgtggtgagccgagatcgcaccactgcactccagcctgggtgacagagcaagactccgtctcaaaaaaaaaaaaaaaaaagaggaataccatgcggaaatcgagtcaatcaagtccttgagtacaatccagtgcagagaagaaactggccttgggaacaggtgtgggtcacccaccgctgcagagggcagagagcatgtgggtggcccgagaggctggtgggcttaatggtgggaagatgaggtggttttgtgattgcttatttttggagtgaggggagagagaagaggcgaaagaggagagatcatgagctgcaagtcaggagggaagaggaggtcctggaggtttgagcagagagaagaaaatgtgaaccagttctgacagtgggggattactgcctagagaaatgttacagatcaccaggaatcccagggacctactagaacacaacgtggacagctgattccagccacgttctccggctcaaccagaatcagaggtgcttgttcccaacaaaacaacactgggttctgcccagagtgtgagaaagggatgaagggaatggagtgtgagctcacagggggcagcagaccacagagtcccagctgaccacaggcaggaagagcatgggagagcacagacaaggatggttatgggagtgatgggtggccaagcctccagactagaggtcccagtggggtcagaggtctgccgaaatgcaggaggcaccggaatgacggagctgggaaaccagggaaaactgtggttagagagcagagattctggagctgggacagttatggatcacgaccaagtctagggcgcgacgctgggagtgtgtaaaagctgagggaagagcccagcagagcaagggagcagggagctgagggaagagcccagcagagcgagggggcagggaactggtgccctgccctgaggcccagcagccacgggtccccactcacccattgccttttggcagttgaggatcttaaagccactgtgcatgcaggcggccaggagcaggtggtggtggaaagggtgccacttgattctccataccccaccctgcacaggcgtatctgccaacggctgcttcatgtttcgtgtgtcccacagtaggatgtgttcatcatagctgaaaccgaccaaccacaggaggcatataaggaaagcccaggctcacctgttccacaaggcccctggggggcacagaacgtctcccagagacctgtcccatgcatccctcgaggacaaagtcccctttaccaaacccatatacctacactccggcgaagcactggcagacgaaatgctgcaatggtgccaggaggaaaggcagcgaaagagggaagaagggcccaggagccccccggggacagcgaaagagacgagaagggcccgagagcctcctggggactcaccttcccgtggccaggatgtgctcccgatgagggctgctctggatgctgcacacacccatggtgtgtctgcaagcagaggcggcttctgaaccagtgtccagcacacagacccacccagggaacgggagggctggtgacccagggaacgcgggggctggtgtgggcaccgagtgctggcccttgggcagttaccttttgctggtgaagagaaatttgccgggtaccctggtgtcccagcccctcagaaggccatcgtcgccccctgtgtggagaaagagaagcatcaacaccactaatgacaggaaatgagtgttctcagttaggccgttgatgtctgtgaggaagctccccggggtgactgtctgtgaggaagctccccggggtgactctgtctgtgaggaagctcccctgggtgactgtctgtgaggaagctccccggggtgactgtctgtgaggaagctcccctgggtgactctgtctgtgaggaagctcccctgggtgactctgtctgtgaggaagctcccctggatgactctgtctgtgaggaagctcccctgggtgactgtctgtgaggaagctcccctgggtgactgtctgtgaggaagctccccggggtgactctgtctgtgaggaagctcccctgggtgactctgtctgtgaggaagctcccctgggtgactctgtctgtgaggaagctcccctgggtgactctgtctgtgaggaagctcccctgggtgactctgtctgtgaggaagctcccctgggtgactctgtctgtgaggaagctcccctggatgactctgtctgtgaggaagctcccctgggtgactctgtctgtgaggaagctcccctgggtgactctgtctgtgaggaagctccccggggtgactctgtctgtgaggaagctccccggggtgactctgtctgtgaggaagctccccggggtgactgtctgtgaggaagctcccctgggtgactgtctgtgaggaagctcccctgggtgactctgtctgtgaggaagctcccctgggtgactctgtctgtgaggaagctccccggggtgactgtctgtgaggaagctcccctgggtgactctgtctgtgaggaagctcccctgggtgactgtctgtgaggaagctcccctgggtgactctgtctgtgaggaagctcccctgggtgactgtctgtgaggaagctcccctgggtgactctgtctgtgaggaagctcccctgggtgactctgtctgtgaggaagctcccctgggtgactgtctgtgaggaagctcccctgggtgactctgtctgtgaggaagctcccctgggtgactctgtctgtgaggaagctccccggggtgactgtctgtgaggaagctcccctgggtgactctgtctgtgaggaagctcccctgggtgactgtctgtgaggaagctcccctgggtgactctgtctgtgaggaagctcccctgggtgactctgtctgtgaggaagctcccctgggtgactgtctgtgaggaagctcccctgggtgactctgtctgtgaggaagctcccctgggtgactctgtctgtgaggaagctccccggggtgactctgtctgtgaggaagctccccggggtgactctgtctgtgaggaagctccccggggtgactctgtctgtgaggaagctccccggggtgactctgtctgtgaggaagctcccctggatgactctgtctgtgaggaagctcccctgggtgactctgtctgtgaggaagctcccctgggtgactctgtctgtgaggaagctcccctgggtgactctgtctgtgaggaagctcccctggatgactctgtctgtgaggaagctcccctgggtgactctgtctgtgaggaagctcccctgggtgactctgtctgtgaggaagctccccggggtgactctgtctgtgaggaagctccccggggtgactctgtctgtgaggaagctccccggggtgactgtctgtgaggaagctcccctgggtgactgtctgtgaggaagctcccctgggtgactctgtctgtgaggaagctcccctgggtgactctgtctgtgaggaagctcccctgggtgactctgtctgtgaggaagctcccctgggtgactctgtctgtgaggaagctccccggggtgactctgtctgtgaggaagctcccctgggtgactgtctgtgaggaagctcccctgggtgactctgtctgtgaggaagctcccctgggtgactctgtctgtgaggaagctcccctgggtgactctgtctgtgaggaagctccccggggtgactctgtctgtgaggaagctccccggggtgactgtctgtgaggaagctcccctgggtgactgtctgtgaggaagctcccctgggtgactctgtctgtgaggaagctcccctgggtgactctgtctgtgaggaagctcccctgggtgactgtctgtgaggaagctcccctgggtgactctgtctgtgaggaagctcccctgggtgactctgtctgtgaggaagctcccctgggtgactctgtctgtgaggaagctcccctgggtgactctgtctgtgaggaagctccccggggtgactgtctgtgaggaagctcccctgggtgactgtctgtgaggaagctcccctgggtgactctgtctgtgaggaagctcccctgggtgactctgtctgtgaggaagctcccctgggtgactctgtctgtgaggaagctcccctgggtgactgtctgtgaggaagctcccctgggtgactctgtccgtgaggaagctccccggggtgactctgtccgtgaggaagctccccggggtgactctgtctgtgaggaagctcccctgggtgactctgtctgtgaggaagctcccctgggtgactctgtctgtgaggaagctcccctgggtgactctgtctgtgaggaagctcccctgggtgactctgtctgtgaggaagctccccggggtgactctgtctgtgaggaagctccccggggtgactctgtctgtgaggaagctccccggggtgactctgtctgtgaggaagctccccggggtgactctgtctgtgaggaagctcccctgggtgactctgtctgtgaggaagctcccctgggtgactgtctgtgaggaagctcccctgggtgactctgtctgtgaggaagctcccctgggtgactctgtctgtgaggaagctcccctgggtgactctgtctgtgaggaagctccccggggtgactctgtctgtgaggaagctcccctgggtgactctgtctgtgaggaagctcccctgggtgactgtctgtgaggaagctcccctgggtgactctgtctgtgaggaagctcccctgggtgactctgtgaggaagctcccctgggtgactctgtctgtgaggaagctcccctgggtgactgtctgtgaggaagctcccctgggtgactctgtctgtgaggaagctcccctgggtgactctgtctgtgaggaagctcccctgggtgactctgtctgtgaggaagctcccctgggtgactctgtctgtgaggaagctcccctgggtgactctgtctgtgaggaagctcccctgggtgactctgtctgtgaggaagctcccctgggtgactgtctgtgaggaagctcccctgggtgactctgtctgtgaggaagctccccggggtgactctgtctgtgaggaagttcccctggtgactttgctggaggagtcttaggttgccacctcaacaggaggtcccagaaacaacccccaggaaagtcatcactgtgccttgactctctagagactggaagcaggaggggaaagacggacgggaacagaaagaagcctgcaggaacagaagggaggaaatggaaactgaaggggccctgaaggccatcaggtgcaggcgaccattgttcacaggggccgttactaggtcctaggggctaaactgcctttgctaagggctccagtgaataaagccctggcttctaagaagaagagttgccagatcagagccctgaacagaaactgcacacaggaggcagcaagcacaaggactccacaccatgcacctgaaaggaaggtgccctctgtcatcttaaagcacttgtttaggggaacgaaaaggatgggagaagagaggagttggtgcactgaaccacaaccaatcttccaagaaaagcaatgcagacatggggtgaatggtggcacctgaaggaagggaagctcaagagcagggcccacagggagagtgaagaagatcagaaggaaaacgtctaggcctaaccacatcacccacccctgcatcatccagctcccactacccacccaccttccatccatctcaccatctatccaccccccgacctcaccctatccaaaattccaccatccatccacccatgcccccacccaccccccacccaccttccatccatctacccactatccatccaacaatccaccatccatccaccacccaccacccaccacccaccatccaaaaatccatccatccacccaccatccatccatccagccagccagtcactcacccaccatccatccatccatccatccaacaatccaccatccatcgacccacccgccctcccaccttccatccaacaatctaccatccatccacccaccacccaccacccaaaaatccatccatccaccccccgtctatcaagccagccagccagccactcacccaccatccatccatccaacaatccaccatccatccaccatccaccacccacgacccaccacccaccacccaccatccaaaaatccatccatccacccatgatccatccatccatccatccatccatccatccatccaacaatccaccatccatctatccagtcactcaccatctatccacgccaccaccaccaccatccaaaaatccaccatccatccaccacacacccaccaactcatccacccaccatccatccatccatccatccacacgccctcccacccaccatccatccactcacccactatctatccaaactctaccacccaccatccaaaaatccatccatccagtcatccaccatccatccatccagtcacccaccatctatccaccccaccaccacccaccatccaaaaatccaccatccatccaccacaaacccacccactcactcatccacccaccatccatccatccatccacccacacgccctcctacccaccatccacccacccacccaccacccatcaaataggtacttgctgaacacacactatggaccctcataatagacactacggatacacagtgaacatgacctacagttaaatgaaccagcggaatcagctgacctaggcatgaagcctgcagatgagcctcaagtatgagctgccattctgtggcaaatttgtacagagtaggcaaaggcttctttatacgtgagtctctccactctcgcatgccccacatatccactccatcaggaaatctgactggatataccttcacttctatccagaacccaaccactggtcctcacctccactactccaaacctgctctgggctgtctcatcacctgcccaatgtcaagtctccaggctgtgtccctccctcttgtggtctagactcacattcaccaaagaggtcatcgcaaattttaaaatgcaagtcagaatctgtcattcctctgctcaacatcctgcaacagctcccatttcattctgagtaggaaacaaagtccttcctggagcctgcacggccctgtgccctggcccattacctctgatttcaccctcttctattccgctactgcctcaggtcatcctaaccatgctggctactggctactcttctgccatagcagggccactcctgccttaggaccactgcccaccctgaccatgctctccaacagtataatctgcacctgctcccagcacccttggtcccctctcacctccttctaccttctttccaaagcactcattgcccctgacaggccatgcagtctccttccctattacatattatgccttgtgtttactgtctgtctccccgccacagaatgtaagctgggtgaaagcagggacttttatgtgaaaatcagccaggtgtggtaactcacacctgtagtcccagctactcagaaggctgaggcaggaggatcgcttgaccctgggaggttaaggctgccgtgacctgtggtcacgccattgcactccagcttgggtgacacagcaagacgtgaaccacccaccccatcctcaaaatgtatttatataaataaattttttttttttgagacagagccttgctctctcgccaggctggagtgcagtggtgcgatctcggctcactgcaacctctgcctcccgggttcaagcaattccactgtctcagcctcccgagtagttgggactacaggcgcctgccaccatgcccggctaattttttgtattttaatagagatggggtttcaccatgttggccaggatggtcttgatctgctgacctcatgatccgcccatcttggcctcctaaagtgctgggattacaggtgtgagccaccgcgcctggcctatataaataatttttttaagaaggctgagtgcagtggctgacgcctataatcccaacactgggaggctgaggcaggtagatcgcttgagcctaggcattcgagaccagcctgggcaacatggtaaaaccgcatctctactaaaaatacaaaaattagccgggcatggcggcaggtgcctataatcccaattactcaggaggctgaggcaggagaatcacttgaacccaggaggtggaggttgcaatgagccaagattgtaccactgccctccagcctgggcaataagagcgaaactccatctcaaaataaataaataaataaaaataataaaacttaaaaaagaaagcaggacttttgtctgtttagtttgctaaagtattctaatcacctagaatagggctcagcacatagcatttgttgaaagaatgaatcagtccagaattattcaatcattgccctacggtacctttgctctgaattagctcaaggtagaagaaccaacccaaggagagacctcaagaaatgagatctttatggctctcagacggttcaaggctgtgacaatgagcaacacaaataagaacgccgccttacacacgtgctcgtcactcggacaagcagaggcagcgtgagccacggcggaggtgaggcctgcctggggtggaaggacagctgctctgcgtcagtcttctaaggacaagattttaagctgggcatgtcaaaaaagcagaattcacccatgaaggaaacatcccgtgacgaaaccctgagactgagggaatgtggactatttcaggaaaaggtgactgagagcataggagccaaaacaaggccggagaagcaggcgtggaccagattccacaggccttgggtaatcgcatcactattttggattttatcctcaatgaaacaggaactgtgaggggttctaacaatgagtgagatgcgataaagtgtgtgtgtttttaaaacacttgcttggctactgtgtggagactggaacagtcaggaatgaaggcagggccatcacttgctgctctgctgtaacaaactagatgagacagtggcccggatgggtagcagcagggaagggtcagatcttttcttcggctgtttgcaaattcagcagctcctcttctgtcttttctcagagacccgcccctctcacctgccatgagttatctctacctgggaaagagatgctagccaaagctacctccttcctggaaacaccagttgttaatttctcactcccacatcagcatgccccaaatgcaaaccattcacaagacctggaaaggaatcttatttctctcatgcttcctttatttctggaagataaactatatccaaaaagggtgcagacaaacttgaaatccaacatggcgaagtcactattgtatccacaggtatcaggcaaaaagcacagaaactggacttccagtaaaagcataaaggatctgacaccgagcatatcagggaggcaggatggctctgcccacaggtgcctgctcctccaacaccctggccaacaccacccaagaccctgcactgcctgaggcaagctatactttgctctctaaagaataagtgggcggggcaaggtggctcacgcctgtaatcccagcactttgggaggccgaggcgagtggatcacgaggtcaggagatcaagaccaccctggctaacacagtgaaaccccgtctctactaaaaatacaaaaaattagccgggcgtggtggcgggcacctgtagtcccagttactcgggaggctgaggcaggagaatggcgtgaacctgggaggcggagcttgcagtgagccgagatcgcgccactgcactccagcctaggcaacagagcaagactccatctcaaaaaaaaaaaaaaaaaaaaaaagaatagctaagtgggccgggtgcagtggctcacacctgtaatcccagcactttgggaggccgaggcgggaggatcacgaggtcaggagatcgagaccatcctggctaacacggtgaaaccccatctctctaaaaaaaaaactacaaaaaattagctggacatggtggcgggtgcctgtagtcccagctactcaagaggctgaggcaggagaatggcgtgaacccaggaggcaaagcttgcagtgagctgagattgcatcactgcactccagcctgggcaacagagtgagactctgtctcaaaaaaaaaaaaaaaaaaaaaaaaaaaagaatagctaagtgatgagcgccaactatagcctttgttccagaaagtacattctccaaaaaagaaaaaaaatagtggccaggcgcagtggctcacacctgtaatcccaacactttgggaggctgaggtgggcgcatcatgaggtcaggagatagagaccagcctgaccaacatggtgaaaccctgtctctactaaaaacacaaaaattagctgggtgtggtggcaggcgcctgtaatcccagctacttgggaggctgaggcagtagaatcgcttgaacctgggaggtggagattgcagtaagccaacatcgtgccactgcactctagcctggcaaaagagcaagactcagtttcaaaaaaaaaagtacactttccataaaaggtcttcaagatcccaacataactggaatcacagctgtggcacaggcctccctctctccctccgccccttcctcagcaagccttccatcagaggtgaccggtggaggaatactgacctgaatacacaatttctggatgccagtaattgaaagcagcaatccaggcctcgaattgatgtgcctgccatgaggccactttctgcagcctgggcctcgtctcattcaccatcaggaggtggagctgccctgtggagtcactgctgatgatcttcaagggctggtccccggccctagacacagggaacccatgaagaagcccggcagaatgttattcgtcagcctcttctggttcccaaacaagtcctgagagacggtctccacagccctgggatgcggatatgccccttaagagactggcggctaagatcacaaccactgctaagcttgtcaaagacaccagtgtcgacttctctaggtaaaaacactatcgctatgtatctaaaatgggggacctttttttcataataggactggcagtgatgatgtcagggctgaggagcacagtcgcagctcgctgaaggtggctggagccctctagcctgaaaagtggaagtggttctcagagaaagactcaggacccctgaccaagcctggcccttaccttccagttttcccagtggaccaatctagggacaaagccagacactgctcctccagggcaaggctggacaatggctccagcacgtggctcttctactggagaagaagaaactccatcaaagggaagtagccgccccagaacccccaaaagacttttcctctcctgcagggaagtcatcgttccctcatttacaacctatgcgaatgaagtacatcagtcactgagtcacacctccacctaacactgaaacccctgctaggggccccgagaagacctggggacactggagctcacactcctcacacttgcaggacaactttcccacaggcttgatcttggggcatggtctccctccctttcacacccccttgccatccttgcgctcctagatgctgtcgagatgcctgtgcaggctccagaccacagtggcacacacagtttcccaccccaggcctccagggccactggaacactcgcctcccgagacagagacaatggggaaactcctctggtttccacttcagaagccgcgagcagccatgagaacgtggttgctctttatgcagatctatataaatttcatttcctaaacagcctggccagtgcttaactccatccctgctcccagcaggctgctgtaccaaagccctttcctgggttcatgcactcctcccttgggcccacagctttcctgtggctgctctttccctcctttctaagacagggcaactgctctaagctgccttaagcaaggccttttcctacacaggccctcggttggcccagccccgcctgcagcatctgcatcggagtgagggcgtggtttcaggctgtttacatcaccccactacgggacatccccgttctcctccccgacagctatcagatgaagtcactttgttaatgcatggctccagagcactgtgagaaactcggaaaaattcacacaggactcacgtgcttttccaataatcagtgagaaatgccatcttcacacaggatgctcactgctactctgggccccagcatcaacctaagaatgcttgcccaggctctccttagagaactttcagatccactgacaggtcaatgaacatcctgtcacttcagcccttctgctggtgacacatgaggtgacttcctcttggagttggatgtagaacgcaatacaacttaaaaatagactccacattatcttagaacgtttatatatagctcaccattgaagagagatcgttttagaaaaatgtctgtatcagcacagcctcctccccaaccctctctattcaggtcccttctgccccacagaacaagtgcaagtcactgacctcagattccaccaggcggagcagttgtatggatccactggcatctgccaagcccaagagggcatgtccagccaccgggatgtgacacctgaggagagggcccaccataagcacaccaatgtgcccggagcacaggcgtgcactgtgcgtcccggtaaccacagtcacgcttcccttaacaacggggctgcagtccacgcaaacccagctgggacatcctactacacaccttgattatatggtatggcccactgctcctatgccacaaaccttacagcatgttactgcaggcaagtgtgacacaacaggaagtggttgtatatctaaacatagaaaagatacagtaagaatacaatataaaggataaaaaacaggtggccgggcatggtggctcacacttgtaaccccaacactttgggaagctgaggtaggaggatgacttgaggtaaggagttcgaaaccagcctgagcaacatagcaagaccctgtttctacaaactaacaaacaaacaaaaatgaggtgtggtaaggccaggcgtcgtggctcacgcctgtaatcccagcacgttgggaggctgaggcgggtggatcacgaggtcaggagatcaagaccatcctaataacatggtgaaaccacgtctctactaaaaatacaaaaaaataagccgggtgtggtggcgggcgcctgtagaccgagctcttagggaggctgacgcaggagaatggcgtgaactcaggaggcggagcttgcagtgagccgagaccgcgccactgcactctagcccgggcgacagagcgagactccgtctcaaaaaaaaaaaaaagaggcatggtggcatctacctgaagtctgaagtctcagctactcgagaggctgagacagagaattgcttgagcccaggagttcaaggctgcagtgagctatgatcacgtgactgcattccagcctgggcaacggaacaaaaccctgcctcaaaaaaaaaaaaattaaaaaggataaaaactggtacacctgtatagggcatctccattacgttaaggcaccaccatggtatacgtgctccattgttgaccaaaacataattatgccacacaccactgcatttaaatctcagctccaaaagtgggctagagcctacaactgtgttctcaaacaaaagacgccccaggttatgaagtcagaaaactcccatcacttccccggctggaacatgacaaaggaaataagccccaggtaaagcactccccaggtggaagataggcgggacagcaaagaaacaaatccaaagttgagatgcaatgcctgtcttgttgaaggcatcaggcatcaggcttccctgattgctactcatgacaaattctacacccagtgggattatcacagttataccatttcatgtccaggattgcagaagtatcttttctttggacctcgaccagagggtgaatagagttgttgtcattgaaactgtacaggaagagacggcctaaacggacctgaggctccttaacttccattccaccctacaaaaaatgcagaggtagtctctgattatcccaagacacgaaggaacccaaaggatgggaaaagggatccaaggaactcaaaggtttgccatgactaaaggagtggaattctgcctggaaggagaacctctggttttctgagctggagaaacgtctattaatgagtaggtgaacactcctggacccagtagagaaggctccttctaaaccggccaacagggaccagctatggctagggtaaccacagaacccagtttgcctgggacagtcctgacttacgcctgttgttccagtgcccaatttggatcctaatatgtacccaccagaagttaagatataattcccactttctctttactgtacattccacccattcccttgggccacacctgtatatagaagacgttctgctctcaagattttaaagttggccgggggcggtggctcgtgcctgtggtgccagctactcagggggttgaggcgggaggatgccctgagccctggagtccgaggctgcactccagcctgggtgacagtgcaagaccttgtctcagaaaaaagtaatttcttttttttgagatgtagtcttgctgtatcgcccaggctggaatgcagtggtgcgatctcggctcactgcaagctctgcctcccgggttcacgccattctcctgcctcagcctcccgagtggctgggactacaggcgccgccaccacgcccggctaattgttttgtatttttttagtagagacggggtttcaccatgttagccaggatggtctcgatctcctgacctcgtgatccgtccgcctcggcctcccaaagtgctgggattacaggcgtgagccactgcgcccggccgagaacaatttttttaaaaagattctaaactgtttccagcctacctcctggccaaagggccaatatcccctcttcatctcctgggcgattcggtgcgcctttcggcctcaacctcgtggccggccccgccctcccctcccgaagccgcggcgcgcgcaccttgttctgggggccggcaggccggtcctccggccgccgcagctggtaggtcccgcacgccagcaggtgcctgcagccttgcagcgggcaccactccaccgagtccgcggtcagctcggtgtccaccgtttgcagggcgaaacagcccatcatccagccctcggggaagggcgcggagccggcagtagaggcgggtcggcggggccgggctgggtactgcgcggggcggcgaggccggggccggccggacgagcgcagagccccagggacaccgtcagcgcgggccgcctctctcgcgactccttccgggg

SEQ ID NO: 748 - DNA, 54291 bp, Homo sapiens
cggggctccggccgcctctgacgagtcccggatttaccagggccggtgggatcccctcgggctcccgccttagcatgctggccgggacatctggtgaacatggcctctgctactgcggcagcagcacgacggggcctcggccgggctctccctctcttctggcgtggctaccagaccgagcggggcgtttacggctaccggccgaggaagcccgagagccgcgagccccagggcgccctggagcgccccccaggtcggggatggggcccgggcggtgggagcgggggctgggacgcagaagcctcccctggccgatttgcggtggggtgtcggggtcggggaaccggctgccggcctgaacgcgcggccggtggggaggagggggaggtgaggggagcagagggtaggtgtgggtgctcagtgttggggtcatcccccgtccatcctctgtaactgaggatctttgaggtccacgcttgggtggtcttcccatcttgctggtccggacctggtttcggaagggcttttctttcctttgttggaaacgtgtgagaaactctttttttctttctctttttgtttccttttttttttttttttttttttgagacggagtctcgctctgtggcccaggctggagtgcagtgctgcgaccacagctccctgcagcctcgaactcctgggctcaggctatccttccacctcagcgtcccgagtagctggggacacagagggatgaccacgcccagcttttttttttttttttttttttttttcatttttagtagagatggggtcccaccatgttgcccaggctggtcttgaactcttgagctcaagctgatcctgcagcctcggcctcccaatgtgttgggattacaggctgagccactgcacccagcctagaaaaccagctctttaatgaggcggagctgtgggagaagtaaagttttaaggtctcccaaggatacatttccaggaccatctctgaggcttcttttatgtgagcaggtgggggggtccaagactgcattgcttgggagaagtgggcagttagttccagtcttggaagacagcatgatatttattatgtatttgtctccttgtagctagtctgttactttaatttcagagtttaactcttaactctgctgaatttggaactatgtgctggtggggtttctttcttttccttttagccactctattgacaccttgatatgtgctggtggttttaatgaattaacagtcatgaatatcagcttttggaacttctgttgcatgctcatttgcgagactaattttgagtatttggtttacgctccaaaattattgtatcattatttatcctcacggagtagaagataagtacagattgcttattagaggaaaatcatttggcatctttgatctgatcattagattaatgttgaagatccccttcggcatctgggcacctgaccttggaatgttccatcaatcacacactagaacttcaatattttgctcttcacttcggagggcatttaaaataaacctcatatctctgtctctctctctttttttaatcctaaaatggagtctggctttgtcgcccaggctggagtgcagtggcacgatcttggctcactgcaacctctgtcttctgggttcaagcgattgtcctgccccagtgttccgagtagctgggattacaggcacctgccaccatgcccagctaatttttgtatttttagtagagatggggtttcaccatgttggccaggctggtcttgaactcccgacctgaagtgatccactggccttggcctcctaaagtgctgggattacaggcatgagccaccgtgcctggccaagagggaacctcctttttgcagagccgaattccccttcctgtctacttgctcattagggagctccaacttgacctcatctttcttcttgggccttcctgaaagtgacaagatacaatgaacatacgctcctgagctacaggcttcaagggcatgtagtctgcctcagtcctgtcctacaggacaaaaaccaaatgttttgtcctgtagcataacactgcccatcagctttctaggtggaaatacctgtgtccttggtacccattgcctggctgctaatccaatgccatatatatttttaggctctgttagggcagcaacccacctctggtaccaaattctgtattagattggaagagttcaggtgctgtgatatacaaagagaagggatatcttctttccttccccttacggtcatgacccagaagttgcatacattgctgctacgttcccattgtccaaaacttagtcacatggccaccaggttatggggaaggctgggaggtggctctttgttctgggtggccatatactgggctctctattactatcaaagagagggttcagaatggaagttaggaatcgtagcagtctctgccacagaggtatagtaatctgagatgagcaatccacctttatctttttcacctcatatttcacatcaaatctttttagtttttattttttaaattttatttattaggccgggcgcggtggctcatgcctgtaatccctgcactttgggaggccgaggtgggcggatcaccaggtcaggagttcaaaactagcctggccaacatggtgaaacctcgtctctagcaaaaatacaaaaattagctgggtgtggtgcagacgtggggccaggcacagtgactcacgcctgtaatccccgcactttgggaggccgagacagacagatcacttgagacagggtcttgccatgttgcccaggctggtctcgaactcctgtcctcaggtgaaatgcttgcctcggccccctaaagtgttgggattataggcgcgagccaccgtgtccagccccaaataatttatacttcctaaggaatgaaaagagggttctatatacgcaatttatttgtgacatatagtacatttgcattttgtatgtgcaaacgtaacattaattatcaagtatctttatatgttaggcaacatattaaactattaccgtgttttatttttattttttgagatgagatctttctatgtcacctagtctggagtgcagtggtgcagtcacagctcacttcagcgtgcgccgggttcactggccttctttcttcatatgtttatcttggctaaaataaatgtctacataggatgaccacatcattcactaagacttcccttgtattaaggctttaaagagatattgagcctgggtgtggtggctcatgcctgtaatcccagcactttgggaggccgagctgggaagatcacttgaggccagaagttccaggccagcctggctgacatggtgaaaccccatctctactaaaaatacaaaaattgacctggtggtgtgtgcctataataccggttactcgggaggctgagtcaggagaatcacttgaacctgggaggctgaggttgcaatgagctgagatcaagccactgcactccagcctgggtgatagagcaagactctgtctcaataaataaataaataaataaataaataaataaataaataaatacaaataaataattaaatagatattgaatttgcctctagtaaccttttggatggcagtggtttcactagttacaatttgacccatgatgagtgttctttgtaactaggtatttgtaacagcttgtactttcacctctgtaaaccttgatttccaaggaaacttgaatttatttatcaacaatgccaatttaaaatggaggtgggtttaggagtagtgattcatgggtgttcttccttttttttttttttgagatggagtttcgctcttgttgccgaggctggagtgcaatggcacgatctcagctcaccacaacctctgcctcctgggttcaagtgattctcctgcctcagcctcctgagtagctaggactacaggcatgtaccaccacacctggctaattttgtatttttagtagagacagggtttctctgtgttggtcaggctggtctcgaactcccgacctcaggtgatccacccacctcggcctcccaaagtgctgggattacaggcatgagccaccgtgcctgacctgtttatttgtttttttgagacacagtcactccgtggcccaggctggagtgcagtggggtgattttggctcactgcaacctattcctcctgggttcaagtgattctcctgcctcagtctcctgattagctgagattacaggcatatgccaccccgcccagctaatttttatatttttagtagagacgtggtttcaccatattggccagggtggtatcgaactcctgacctcaagtgacccaacaacctctgcctcccaaagttctgggattataggcatgagccactgcacccagtccatgaaaatattagctcttttacttttttttttggacagggtcttgctctgtcacccaggcaggagtgcagtggcatgatctcagctcactgcaacctctacctcccgggtttaagagattctcctgcctcagcctcttgagtagctgggactacaggtgctcaccaccatgcctggctaatttttgtatttttagtagaaacagggtttcacatgttggccaggctagtcttgaactccggagctcaagccatctgccctcaaccaggcttttctgaaggctgcagtctctggctagcttttttctcataagctatctctcaattccgagtttcaaaatctggaaaagctcagtctggcccagcttgactcagcctctccagcagcaaggcagactggagtaatgcgtgcatccccaccaggccccacagcttggcatgggagggtgcaaagtgagggagaagaagctgcttcagctcttgtactctaagtttgagggctctgaaaagcttttatcatgaagcatgactcttgatctcaggacttcattcaaataataacaaatatttcttgagcgtctaccatgtgttagtcttctgagccagaagcatgcctctgatattctcctttatttttaagaggagtgcaggcgtgtatctgctgttgttttctctattctctctggcttcgttacggacttaaacatcaaatctaattcctgtgaccttttgcagatattatgaacagtaaactgtttgggcggtattacgcctaacgtaaaggtattcatttttctcttacagtaattctttcatttctgcagtaatagaaagttttgctttttgttttgttttgttttgttttgttttctttgagacactctgtgtcgcccagactgagtgcagtggcacaattacagcttaccatagcctcaaactcctgggctcaagtgatcctgccacctcagtctcctcagtagctgagatcacaggcacgtgccaccacatccagctaatttttgtatttttttgttttgtttttgagacggagtcttgctctgtcgcccaggctggagtgcagtggcacgatctctgctcactgcaaactctgcctcctgggttcacgccattctcctgcttcagcctcccatgtagccaagactacaggtgcccgccaccatgcccggctaattttttgttttttttttagtagagatggggtttcaccgtgttagccaggatggtttcgatctcttgacctcatgatccaccctcctcggcctcccaaagtgctgggattagaggcgtgagctaccgcgggtcttgctatgttgccccaggctggaatgcagtggccaaaatctccactgcactccagcctgggccacggagtgactatgtctcaaaaaaacaaataaacaggtcaggcctggtggctcatgcctgtcatcccagcactttgggaggcagaggtggtataagaacaatagcaaacatacagggcaatccccattcccattgcaaaccagcggccatattgaaaacgtccccttagaggccgaagccagtgggttacttgaggtgaggagttcaagaccagtctggccaacatggtgaaatcccatctctactaaaaatacaaaaattagccgggtgtggtcgcatgtgcctgtggaggctgaggcaggagaatcgctggaacctgggaagtagacattgcagtgagccgagatggtgccactgtactccggcctgtgtgacacagcaagactttgtctcaaaaaaagaaaaaagaaaacatccccttagagaagaacctatgtcaatgcatagagatcactgcttctgtttctttttcttttttttgagacggagtctcgctctgtcacccaggctggagtgcagtgacacaatctcagctcactgcagcctccgccttctgggtgcaagtgattatcctgcctcagcctccaagtagctggggttgcaggtgcttctcgccatgcccggctaatttctgtggggttttttttggttttggttttgtttttctgagatggagtcttgcttatgattttttttgtatttttagtagagatggggtttcagcgtgttagccaggatggtctcgatctcctgaccttgtgatccgtccgcctcggtctaccaaagtgctgggattacaggcatgagccactgcgcccatccaatttttgtattttttgtagagacagggtctcactctgttgcccaggctggtctcaaacccttgacctcaagaggtcctcctgccccagcctcccaaagtgattacaggtgtgagccacaatggccatccagtaataggaagtattttatgaataattctattgctgtgctctcattcttttaaattttatttttatttatttttctatccttccagggaaaaagaattaaatcttttaatttcattctttattataaaggtaatacagttgaagtacgttttatctagagcatttgaaattggaacttgatcagttaattccatttatttttattttacttcttttttttacttcttttgttttttcttttaaaacaattttgacagagcgagactctgtctcaaaaaaaaaaaaggaaaaagaaaataaagcaatctgaatgcaaaatctctagatttttctgatttcttcccctaattttactttttcccacagcaacagtcttagggacaaatagaactgattcttataagcacaaagtcaactgatgagagcagtgctgcatatgctagagagaagccacaaaccaaagcttttagagtgagtgcatcaggcagcaagtccgctaaatggctgcattcgaaagagctttattgccgagtgcggtggctcacgcctgtaatcccagcactttgggaggccgcggtgggcggatcacgaggtcaggagatacagactatcctggctaacacggtgaaaccccgtctctactaaaatacaaaaaattagctggatgtggtggcacaggcctgtagtcccagctacttgggaggctgaggcaggagaatcgcttgaacccaggaggcagaggttgcagtgagccgagatggtgccactgcactccagccttggcaacagagcgagactctgtctcaaaaaaaaagagctttattgtacatgttcactgtggaaaactgtgagaatacagtaagcaaaaaatagcaaatctgcctgggtgtgatgacgtgcacctgtaatcccagctacttgggaggctgaggcaggaggatctctcgagcccaggagtatgagtccagcctgggtaatatagccagaccctgtttctttttttctcgggacggagttttgctgtgtcgcccaggctggagcgcggtgacgcgatctcagctcactgcaagctccgcctcccgggtttacgccattctcctacctcagcctcccgagtagctgggactacaggtgcccgccaccacgcccggctaattttttgtatttttagtagagacggtttcaccgtgttagccaagatagtctcgatctcctgaccttgtgatcctcctgcctccgcctcccaaagtgctaggattacagacgtgagccaccaagcccagccagccagaccctgtttctgataaaaaaaaaaaaaaaaaaaaggaagaaaaaagaacaagtcggcaatttctacataggattatcacttaaatttttgatcagtttcttttgtttatgaaaaatatatgtgtgcatatatataagtatatataattacatatactaatacatatactataagatgaaatatatattataaactactcatatgtacatacacagtgtaacaatgtaggtgcatgctttatatgttgtggtcattcattaagtgttttttgttttttttttttgagatggagtttcatgcttgtcacccaggctggagtgcaatggcacaacctcggatcactgcaacctctgcctcctgggttcaagcaattctcctacttcatcttcctgagtagctgggattacaggtgtctgccaccaggcctggctaatttcttgtttttagtagagacagggtttcaccatgtgggccaggctgatcacaaactcctgacctcaggtgatgaggtcaccttggcccgccttggcctcccaaagtgctgggattacaggcatgagccactgtgcccggccattcattaagtctggatgctttttcatcaatcattcttctacaatattattttttaatggctgtcggcaatttgagatgagttaatgccattgcttgttcctcagaggatgggtttataaagagagaactaatgatagggagatgtcaatgaagaatgaggagggcctacgtttgtcttcaagattggagggtgcgggtgagggccactgagtaccttcacgtcgtactcatgctctctagggacagccaagttctgattaaacccaggagtgtgaggaacgttcagagaggtttgtttttcatgaaacagagtgccagaggtctcggtggaaggaggtggagacagagagggaaggggttggagatagggttggtggaagaagaaacctgcccgaagaaatggtagtctgagggagcatgtgttgccagggtgaatggaggacgtgcctgacatgagagaggacttcctctttctgctggtgccaaactgctacatgcctcatgttctttgtggcaaggagggttattttgtgccaacttctgtgtcagtattctagtgtatcattagcagcctggctagtgagtacttagaaatagaagcagtgggccagtcacagtggctcatgcctgtaatctcagcactttgggaggccgaggcgggtggatcacctgaggtcaggagttggagaccagcctggccaacatggtgaaacctcttctctactaaaaatacaaaaattagccaggtgtggtggcacgtgcctgtaatcccagctactccggagactgagatgggagaattgcctgaacctgggaaacagaggttgcaatgagccatgatcgtgccgctgcactccagcctgggcaacagagcaagactccacctcagaaaaaaaaaacaaaaccaacaaaaaccccacaaaaattagccgggcatggcggcacgcacctgcaaccccagctacttggagactgaggcaggacaatcgcttgcacccaaaaggcggaggctgcagtgagctgagattgtgtcactgcactccagcctgggtgacagagtgagactccgtctcaaaaaaaagaaaaagaaatagaagcagtgatctctaggcattgacatgggttcttctctaaggggatgttttcttttttctttttttgagacaaagtcttgctgtgtcacacaggcgggagtgcagtggcaccatctcggctcactgcaatgtctacttcccaggttccagcgattctcctgcctcagcctccacaggcacgtgcgaccacacccgactaatttttgtatttttagtagagatgggatttcaccatgttggccagactggtcttgaactcctgacctcaagtgacccactggcctcggcctctaaggggacgttttcaatatggctgctggtttgcaatgggaatggagattgccctgtatgtttgctattgttcttataccactaatcatgagttggggggagatcgctcagagagaaagtagactgagaaggtggccttgggcagagctggggagtaccaatattttatgtattttattttttagatatgggatcttgctctctcacccaggctagagtgcagtggtgagatttccagctcagtgcagcctcgaactcctgggttcaagctcctccctcagcctcttgggtagttgggattataggtgtgcaccaccatgcctggctaccaatatttagagttgggcaaagagaagtccctcaaaagtgactgaggttgagtagctctggagttagaaagaaaaccgggttcctgcaatgctgtagagcccagggaagaatatgttcttaaaaggagagagtaggagctgggtgcggtggctcatgcctgtaatcccagcactttgggaggccgaggcaggtggatcacaaggtcaggagatcgagaccatcctggccaacatagtgaaaccccatctctactaaaatacaaaaaataagctgggtatggtggcatgcacctgtagtcccagctactcaggaggctgaggcaggggaatcacttgaacccgggaggcagagattgcagtgagccgagattgcaccactgcactccagcctggcgatagagtgagactccatctcaagaaaaaaaataaaaaaataaaaggtgagagtggcccacagggacatgctttagacatagtctgtctggattttagccacaaatataaaggtttcctacttcatatgacactgatggagaacttgaataaggttcaaaatagaacccttagcaatttataggactaacccccaggctgaaatcagttcgtttcctgggatggtttgattcatttatttgagctattatggatccacctaactggtgtatgagtgcaaacacatcctgtgtgtgttcaatacctctctgttctttcctcactaaacctgctacaagtaaagaggtgtgctttggctgggtgaggtggctcacgcctgtaatcccggcactttgggaggccgaggtgggtggatcatggcatcaggagatcgagaccatcctggctaacatggtgaaaccctgtgtctactaaaaatagaaaaaattagctgggcgtggtggcgggtgcctgtgggcgcctgtaggcgcctgtagtcccagctactcaggaggctgaagaaggagaatggcatgaacccgggaggtggagcttgcagtgagccaggatcacgccactgcactccaggctgggcaacagagcaagactccgtctcaaaaaaaaaaaaaaaaaaaagttgtgctttggcagtgcatagaatacaaacccaagtgcatgggtggctctgaaatcattccacagcaacacttgttcataaaatggaccttataagttttaaaatatgtgggccaggtacattggttcacgcctgtaatcccagcacttcaggaggcatggcaggcagatcacgaggtcaggagatcaagaccatcctggctaacacagtgaaaccccatctctgctaaaaatacaaaacattagccgggcgtggtggcgggaacctgtagtcccagttactcgggaggttgaggcaggagaatgacttgaacccgggaggcgcaggttgcagtgagccaagattgaaccactgcactccagcctgggtgacatagcaagacaatgtctgaaaaaaaaaaaaagaaaagaagaaaaagaagaagtttgaaaatatgctaacaattgtctctgggttctgaaaataaaaacacaaattgtaaaaatgtgtttcttggccttctttgagaggccaagatgagtgaatcgcttgagctcaggggttcaagaccaacctgggcaacatggttaaactccatctcaaccaaaaaaaaaaaaattagccagatgtggtggtgcacgcctgtagtctcagctactcgggagactgaggcaggaggatcacttgagcccaggttgcagtgagctgtgatggttcttggccgggtgcggtggctcacgcctgtaatcccagcactttgggaggccgaggcgggcagatcatgaggtcaggagattgaggccatcctgcctaacatggtgaaaccccgtctctactaaaaatacaaaaaaattagccaggctacttgggaggctgaggcaggagaatggcgtgaacctgggaggcagagcttgcagtgagccgagattgtgccactgcactccagcctgggcgacagagcaagactccatctcaaaaaaaaaaaaaaaaaaaaaagtgatggttctactgcactccagcctgggcaatagagcaagaccctgtctctaaaataaataaataaataaaaagtaaggtgtctagggctgtaagagcttctttgaaaatctgatttttgtgatttgtagtcatctcctaaactgtttgcatttttaaattttcccctgatttagttgatcatggccttgccaggttggtgacagtatattgtgagcatggtcataaagctgccaaaatcaaccccctcttcaccggacaagccctgctggagaatgtgcctgaaatccaagccctggtgcagacactgcagggacccttccacacggcaggtatggcttctgcacagcaggcgggagctcggagctgcacaccaggccaggctcctgcctctgttcttgaagaagcagcatccccactggagctgaggctcccgcaggtgtgaggagacccgaggggcatgttgaagtacggtccgggaggagcattcttgggattctagaagttctgaggaggcctgttttctcaaggttcaaaaacatttaattggctgggcacaatggctgacacccataatcccagcactttgggagcccgaggtgggagagtcatttgagcccaggagtttgagaccaacctgggcaacatagtgagactgtctctacaaaaaaaaaaaaaaaaaataactgggcatggtggtgcacgcctatagttccaggcactctggaggtagagatgggaggattgcttgaacctgggaggtcaaggctgcagtgagccttgatcgtgccactgcactccagcctgggcaacagagtgagaccctgtctgaaaaaacaaacaaacaaaaaaccttgaactctaaagtgccatatgcttagcatatgtcaatttattctcaaaatcactcccaaaagtagttattgtcctctttattttgtagatggagaaacaaagaggacttatatgactcatagctgctcagtggcagaggtggggtgaaatccagggctacttccattccaaagctgatacccgcctcattctgttttctttcccagcctgggaacttagaaaaagttgggcctgcatcatcagtcatgatttcagggtcctacctcatgttactttttgaagttaatcttgcaaatatcaaattctgattgtgtgcatcagtgagtcatgtttcagtcatctaatgccgtgtaataaactaccccaagacgtaatggcatttaaaccctcaatgatcattttagtgtctcttagggttcggggggttacctgggctttgcaaggtggtagttttctctcttttttcttttttttttttgagacgggcctccaaaggcccttttcttgagcctctgcagaaagatttgatttctcagcacctcataaaagcaaacacgttaatgtggaaaacataaagcgacatgattaatggctcagttggaatatagtggtgatgcatcttaacttcctcaaaagaccaatactttaaatctttttatacaaaaaagaaatacaatgaactttgttgtaagaaaccatgagttggccgggtgcggtggctcatgctggtaatcccagcattttgggaggccgaggcgggcagatcacgaggtcaggagattgagaccatcctggctaacacagtgaaaccccgtctctactaaaaaaaataacaaaaaaattagctgagtgtggtagcaggcacctgtagtcccagctactcgggaggctgaggcaaaaaaaaggagcatctaatagcaaggcgtgaagccgggaagcggagcttgcagtgagccaagatcgtgccactgcactccagcctgggcgacagagcgagactccgtctcaaaaaaaaaaaaagaaaccataggccagaggtgtccaatcttttggcttccctgggccacattggaattagaattgtcttgggccatacataaaatacactaacactaatcatagctaatgagctgcaaaaaaaaatcacaaagaaaatctcacaatgttttaagaaagtttattcatttgtgttgggccacattcaaagctgtcctgggccacattcaaagctgtcctgggccacatgcagcctgtgggctgtgggttggacaagcttgctaagcaatataaagtaaaggttggggccgggtgtggtggcttatgcctgtaatctcagcacttggagaggccgaggcaagaggatcacctgaggacaggagttcgagaccagcctggccaagatggtgaaaccccatctatactaaaaataaaaaattagccagacgtggtggtgtgcacgtgtagtcccagctactcgggaggctgaggcaggagaatcacttgaacctgggaggcagaggttgcagtgagccaagatcgtgccactgcactccagcctgggcaacaagagcaaaaactccatcacacacacacatacaaaagaaattactgtagaaacaaaacttggcataaagcagcagtaggctctgtccttgtgaaggaagtgggggctttcccccttctagttttactgcttcatgacctttgaccatatttttagttttttctttagaaaaaaatcgagataagcattaataataacccaagttatttatttatttatttattttgggacagagccttgctctgtcgcccaggctggagtgcagtggtgtgatctcggctcactgcaacctctgcctcccaggttcaagcaattgtcctgcctcagcctctcgagtagctgggactacaggcgcacgctaccatgcccggctaatttttgtaattttagtagagacggagttttaccatattggtcaggctgggctcgaactcctgacctcaggagatccacccgccttgcctcccaaagtgttgggattacaggcgtgagccacggcacccggccaataatgacccaagttattaagaacaaagcactctgcgttgaagtaattattttggtatgttccagaattaacttgccacatgatttttttttttttaaattttttttaaatatgaaaatttattttgcataggaaacaataatctctggtaaaaatcattactgcatataacaaaacaatgccttcaattaaagggggaaagtgagtttttaaacattggggttaatttagaagaaaatacagtatataataatctcaacatcatgttaaggaacatgattattttttaagatgacccctttgattgtatttcacaggattattgaacatggggaaggaagaggcctcacttgaggaagtgttagtctatctcaatcaaatctactgtgggcagatttctattgaaacctcccaacttcagagccaggatgagaaagactggtttgccaagcggtttgaggaactgcaaaaggagacgtttaccacagaagagcgaaaacatctgtcgaaactaatgctggaatctcaggtaaaaaggagcatctaggccgggcacggtggctcatgcctgtaatcccagcactttgggaggccgaggcgggcggatcacctgaggtcaggagttcaagaccagcctgaccaacatggagaaaccccatctctactaaaaatacgaaaattagccaggcatgctggtgcatgcctgtaatcctagctactcatgaggctgaggcagcagaattgcttgaacccaggaggcagaggttgcagtgagccgagattgcgccattgcactccaccctgggtaacaagagtgaaacaccttctcaaaaaaaaaggagcatttaatagcaagggcataggtcagcctcactgcctataaagatatatagcctggctgacatagagaaaccccgtctctactaaaaatacaaaaattagccaggggtgatggtgcacacctataatcccagctaatcaggaggctgaggcatgggaatccttggaacctgggaggtggaggctgcagtgagctgagatcgcgccactgcactccagcctgggtgacagagcgagactctgtctcaaaaaaaaaagatatataactactgaagagagggaattgagccattaactctgagcttaaatccctcgttacttcaacacaacagatcatataacacacaccattttattattttatttttcctcagagatccttgttctgagcatatcactttattctaagtagcaaaatgttggttgccaaaatattgacctattggctctcctcagagtcaaaatacttctcgtgtatgtgtctactcactctataaaagaccttacttaagacttacttaagaccttacttctgactgggcacagtggctcgcgcctgtcatcccagccctttgggaggcttaggtgggcgtattgcttgaggtcaggagtttgataccagccaggccaacatggtgaaaccccgtgtctactaaaaaaacaaaatacaaaaaattagcctgatgtggtggagcatacctgtggtcccaactacttgggaagctgaggcaggagaatctcttgaacccaggaggcggaggttgcagcgagccgagatcacaccactgcagtgagctaagattgcaccactgtactccagtctgggcaacagagcaagactctgtccaaaaaaataaaaaaacatagttcttaaggttttatttatttattttatttttatttttttgagatggagtcttgccctgtcgcccaagtagctgggattacaggcacgtgccaccacacccagctaatttttgtatttttagtagagacggggtttcatcatgttggccaagatggtctcgatctcctgacttcatgatccacccgcctcggcctcccaaaatgctaggattacaggcgtgagccaccacacctggccttttaaacaaaattttttaaaaatttatttaaaatttatttttcttttgttttcttttcttttttttttttttgagatggattctccctgtcgcccaggctggagtgcagtggtatgatctcagctcactgtaacctctgcctcccaggttcaagccattctcctgcctcagcctcccaagtagctgggactacaggtgcatgccatgatgcctggctaattttttgtatttttagtagaacggggtttcactgtgttagtcaggatggtctcgatctcctgacctcgtgattcactcccatcagccttccaaagtgctgggattacaggcatgagccaccgcgcccagcctaaaatgtgttagccaggatggtctcgatctcctgacctcatgatctgcccacctcggcctcccaaagtgctgggattaaggcatcagccaccgtgactggcctaaaatttcttttaatatgtgagaaaaaaaagtcttttggtaacaggacatactgtcaccattcagggctatgtacagttgcagttcttgagacagtcttgctctgtcacccaggttggagtgcagtggcacgatctcggctcactgcaacctccgcctcctggactcaagcaattctcctgcctcagcctcctgagtagctgggattacaggtgcacaccaccacacccggctaatttttagattttcagtagagacggggtttcaccatgttggccaagtctcaaactcctggcctcaagtgatccacctgccttggcctcccgaagtgctgggattacagacgtgaaccaccatgcctggcctggtcttacttcttaagaactaaagatacttaagttcagaacttaatctgagatgatcaaaagatgacatgtggaagacaggctcagtacaaatgaatggaactgaacctctgctggggctgtgaccaggactctggaatgtcaagatggcaagaagccccttcctaatagtttgggtagttggatagtttgcagccttgattcataccgtagagccccgtgtgaaaactggggtactgggaagaggcagcagaaatctaaggcctggattccagtccagaagaacacacattctaagggggtttccttggggtgagttattctgccgctcaggttattctcctcagcccctcctactgtcccggatcctaggaaaaccatcccgctgtgtccgtgttatgtctctctccgggatatgtagtaaagtggcattgctgtggccacttggggagtgtggggccatctcacaacacacacagacttatctgccttccactggagaagctggctgtctcctggcagctcacgtctgacatgatgttctgcaggagtttgaccactttctggccaccaagttctcgacagtgaagcgatatggaggcgaaggggctgaaagcatgatgggctttttccacgagctgctgaaaatgtcggcctacagcgggatcactgatgtcattattgggatgccccatagagggaggctgaatttattgacaggccttctgcagttccctccagaggtaaggttactcgctgtgtttctcagtagcactatatgattgattgtaacagaataaaactgctggtttcattctggtgataaatgatggtgatggtgatggccgggcactgtggctcacacctgcaatcccagcctgttgggaggatgaggcaggaggatggcttgaatctaggagtttgagaccaccctgtggaacaaagtgagactttgtctctaccaaaaataaaataagttagccaagcatggtggcacgcacccgtgttcccagctactcaggagactgaggccagaggatcacttgagcccaggagtttgaggctgcagtgagctatgatctcaccactgcactccaggctgggcaacaaagcaagatgctgcctgaatataaataaatttttaaaaagtaaaactcatggtgatcattcattttaggaagtcaactaaggctgggcaaggtggctcatacctgcaatcccagcactttgggaggctaaggcaagaggagtgcttgagcccaggagttcaagaccatgggtaacctcgcaaaactctgtccctacaaaaataaaaattaggtggcatggtctctacaaacatgaaaattaggtggtgcacctatggttccagctacttgggaggctgggatgggaggatctcttgagtccaggagatggaggctgcagtgagctgagactgtgccactgccctccagcctggaagacagagccagatcctgtcttaaaaaaaaaaaagaggaaaggcaactaagcatatgagcagttggtccaggaggtagcttagacagtttagttaattgacagagttggtatttggattggttttccatgtatacttacttatttatttattgagacctaatctcgctctgtcacccaggctggagtgcagtggcgtgatctcggctcactgcaacctccgcctcccaggttcaagtgattcttatgcctcagcctctctactagctgggattacaggtacctgccaccacacccaactaattttttgtatttttaatagagacggggtttcaccatgttggccaggctggtcccgaactcctgacctcaagtgatcttcccgtctcagcctcccaaagtgctggaattacaggcataagccaccactcctggctttaaattttcttttttgttgtatgatttcaactcagcacttcttccctagactccattgtgatgaatgccatttttttccttttgaatgtatccacaatagctgatgttccgtaaaatgcgaggcttaagtgaatttccagagaatttctcagccactggagacgtcctgtctcacctgacctcctctgtggacctgtactttggggcgcaccatcccctccatgtgacaatgttgcccaatccctcgcacctggaggccgtcaaccccgtggccgtgggcaaaactcgcggcaggcagcagtctcgccaagacggcgattactctccagacaactcagcccagccgggggacagggtcatttgcttacaggtacttggagcttctgaaattgaggccagaggtggggaaaactgggaagaatgtgtgggttgggagggctgaaagcacatggcagacattcatgatgaaactgagatgaccttttggaaaaagattctgggattgttttaaaaactaacaggagattcatgaggtttagtcttcaggcaactggctttagcctggggcttccacttctgttttccttgcatggcttatgaattaacttggggtttgggctggcaaacctgctccttcttagagcacagatgtcattatctctctggaagtatggccttcttggaaactttgtggttcccatacatataacaagacaagcgtgaaaaaaaaaaagactttaagtgtggttttacttcgtttcttgtttactttattatcttttcttttttatggctttttttttgagaccgagtctcactctgtcactcaggctggagtgcagtggcgaaatctcagctcactgcaacctctgcctcctgggttcaagtgattctcctgcctcagcctcccgagtagctgggactacaggcacgtgccaccacgcccagctaatttttgtatttttagtagagacagggtttcaccatgttggccagcctggtctcaaactcctgacctcaagtgatcctcccacctcagcctcccaaagtgctgagattacaggcatgagccactatacctagcctattttttttttttgcttgtttatttgaaaatgaaagtctttggtattaaggcacataacacaaattatcagtgtggttcgttctttttctaccctgtctcccagtttttggtaacacaacaagtatcttttagaggtttgggctgtggtcatgtttcttctgtgagtattcatttaaatatgaacctttaactacaggagatcatgaaacctggatttcagaatcagtcttcaaattccacagaaatagataaatatataaggcaatcaaatattctatgtttgtaaatgccacgttatcctatgcattttaatttttcacaggccagaaacttgtagtgaataaattgggagtaggcagaattggatttcattatgatatggccggccctccctcccttccttccttccttccttttttccttccttccttccttttttccttccttccttcctttttccttccttccttccttccttccttccttccttccttccttccttccttcttctttctctctctttctttcaagatgggttctcaatcttttgtccaggcaggagtgcaatggtgcaatcatagctcactgtaggctcaaatgcctaggctcaagcaatcttcctgtctcagcctcccaagtagctgggcctacaggtgcatgccatcatacctggctgatttattttattttattttgtggagacatgatcttgctgggttggccaagctggtttcaaattcctagcttcaagcaaccctcctgccttggcctcccaaagtgtagatattacaggtgtgaaccactgcacctggcctgatagggtgtttctaaatagaaatcttgaaatcattagccagacattctgtttacctttcacataatttataatactctattttaatccttcatttttacccagtacattgagctgatcttaagattgtggtggcgggcgcctgtagtcccagctactcgggaggctgaggcaggagaatggcgtgaaccccggaggcggagcttgcagtgagccgagattgcgccaccgcactcccgcctgggcaacagagcgagactccgtctcaaaaaaaaacaaaaaaagattgacttctgaaataaaaggtgaaaaggccattttctttaaaatgatgataaatgaggctggtcgctgtggctcatgcctgtaatcccagcactttgggaggccaaggagggtggatcacctgaggtcagaagtttgagaccagcctgaccaacatggtgaaaccccgcctctactaaaaatacaaaaaattagccgggtgtggtggtgcatgcctataatcccagctactagggaagctgaggcaggagaatcacttgaacccgggaggcagaggatgcagtgagctgagatcgtgccatttcactccagcctgggcgaaagagcaagactctgtctcaaaaaaaaaaaaaaaaaaagttattccaacctgaaaacctagatttcttaatcccttatgtttcttttctccccacccgctccccttgcctcatgatttaggtccatggtgatgcttctttctgtggtcaagggattgttcctgaaacattcacgctgtccaatctcccacatttcagaattggtgggagtgtgcatttgattgttaataaccagctgggttacaccactccagctgaaagaggaaggtcttctttatactgcagtgatattggtacgtaacacagggaggaactgatattgctgaagccgacatggaattcctagggaaacctctggtgcacacagaacaatgagcctcactggttatccctcctttcatttaattaattaattaattaattaattttttgagatggagtcttgctctgtcacccagcctgtagtgcagcagcacgatcttggctcactgcaacttctgcctcccgagttcaagtgattctcttgcctcagcctcctgattagctgggaccacatgcgtgcaccaccatgtctggctaattttttttttttttttttttagatggagtcttgctctgttgccctttccagcttgtactccatgctggagtacgtgatctcggcttactgcaacctccgcctttcaggttcaagtgattctcatgcctcagcctcccaagtagttgggactacaggtgtacaccaccacacctgtctaatttttgtatttttagtagagacggggtttcaccatgttggcaggctggtcttgaactcctgacctctggtgatctgcctgcttaggcctcccaaagtgctgggattaaaggcgtgagccaccatgcccagcctatcagtgtgatttttaaatccaaagaaataagacaaggatggagccacagtgtgccatctcaaatttcttataactggatgggtgatctggtacaagtcagagatcaacacaatgagtacaacaccagagttgttatctctaggatattcaaacttggagtgcccaggggcttagtgataagggatgtgttcaaccactaaacttggtgaaatagtatagttagaaataagatgtgaaggctgggcacagtggctcacgtctgtaatcccagcactttgggaggctaaggcaggtggatcatctgagcttgggagttcgagaccagcctgaccaacatagagaaaccccgtctctaataaaaacacaaaattagctgggcatggtggtgcatgcctgtaatcccagctactcgggaggctgagacaggagaatcacttgaacctgggaggcggaggttgcagtgagccaagatcaggccattgcactacagcgtgggcaacaagagcgaaactccatctcaaagggcaaaaaaaagaaataagatgtgaagaatcaaagtcagcttcttttttatctgtggaaattggtaggtttttttgttgttgttgttgttttgagagtcttgctctgttactcagactggagtgcagtggtacaatcatggctcactgcagccttgacatccctggctcaagagatcctccctcctcagcctccttagtagctgcgatttacagacacatgccaccatgcacagctaatttttttttttttttgagatggagtttcgctcttgttgcccacgctgcagtgcaatggcgccatctcggttcaccacaacttgcacctcccgggttcaagcaattctcctgcctcagcctcccgagtagctgggactacaggtgtccaccaccacacccagctaaattttgtgtttttagtagagacggggtttcaccatgttggtcaggctggtctcaaactcctgacctcaggtaattcacctgcctcagcctcccagagtgctgggattataggcgtgagccactgcacctggccacagctaatttttaaaataatttttgtagagattgagtcactgtgttgcccaggctggtcttgaacctctggtcttgtgtgatccctcttcagccttccaaactgctgagattacaggcgtgaaccactgtgccaggctgaaattggtcatcttaagataaagacagtgctgttattacccattcccagtttcacagtttacaaggctgtttgatggtagcaactattctccttttatacaaacagcctggactggatgcctcttgggcttgtctatgtgaatcctttatgattagtctgatgaagattctttggagcaaatttatctttttctaaggtacatcctttaatgacccttttatctcagggagaaagagagtaatgataataacagtaacaaaataaatattaactactatgtaccaggcactgttaggcattacaattgtttgtgcattcactcatcgaacctttgcaacatcactaagaggtaggagccccattcccgatttatagataagtaggttgagatttgtagctttaccgaggtcacacaataagtcccagagttggaacttgccagctggtctccaaagctggggttgttaaccaaaccaatatctacctgtgaggattgggctgtcttttgatgcaggaagtagggcttagagagggccagtgtcattctgggttaactgtcctgtttcggcttggtcttctgtccttcagggaagcttgtgggctgtgccatcatccatgtcaatggagacagcccagaggaagtggtccgtgccacacgactggcttttgaataccaacgccagttccgcaaggatgtgattattgatctgttgtgctacaggcagtggggccacaatgagctggatgagccattctacaccaaccccatcatgtacaaaatcatcaggtacaattataaacccttgtgtgatatgccccctaaaaattaaaattactattattattcttttgagatggagtcttgctttgtcacccagtctggaatgcagtagcacgatcttggctcactgccatctccacctcccgggttcaaatgatcctcctgcctcaagtgatcctcttgcctcaacctcccgagtagctgggattacaggcgtgtgccaccgtgcctggctagttttcatactttttagtagagatggagttttgccatgttggccaggctgatgtcaaactcctgacctcaggtgatctgcctgcctcgccctcccaaagtgctgggattacaggcatgagccaccatgcccaggcaggacatgaaactttaagagctaaagctgacacagttctgggctggagtgcaggtggcacagtcttggctcactgcaacctctgcctcctgggttcaagcaattgcaattcttgtgcctcagcttcctgagtagctgggattacaggtatgcatcaccacgcctggctaatctttgtatttttagtacagacaggggtttcgccatgttggctaggctggtctcaaactcccggtctcaagtgatccacctgccttagcctcccaaagtgctaggattacaggcatgagccaccgtgcctggcctcccatactcttcacacttgacatggttcctcattgaatagaaaaagggcaatagaaaactcagcagatgggaagattgaagcagggggaattaagcaaacctcgcccaaatctatttactgcagtgtcggcaggaccagaaatagaacctcagtgattcatttctacaaaccatagctgcagacctgcctggcaccttggtgagaggtaactcagaagattctaatgaatgttcagaaccatgctgtccaagatggaagccactagccatcagtggctattgagtacttgaaaagtggccagtcctgattaatgtgctgtaaggataatacacacaccatatttcaaacacttagcatgtaaaatataaacccaaaataatatttttaaatttattagatatggaaatgacaatataatgagtatattgacttaaataaaatatgttattgaaatgccgggcatggtggcttatgcctgtaatcccagcactttgggaggccaaggtgggtggatcacttgaggtcaggagtttgagaccggcctggccaacatggtgaaaccccatctctactaaaaatagaaaaatttggccaggcgcggtggctcacgcctgtaatcccagcactttgggaggccgaggcgggcggatcacgaggtcaggagatcgagaccatcctgactaacacggtgaaaccgcgtctctactaaaaatacaaaaaattagccgggcgtggtggcgggcgcctgtagtcccagctactcgggaggctgaggcaggagaatggcgtgaacccgggaggcggagcttgcagtgagcccagatcgcaccactgcactccagcctgggtggcatagcgagactccgtctcaaaaaaaaaaaaaaaaaaaaagaaaagaaaagaaaagaaaaagaaaaattagctggcgttgtggcgcgtgcctgtagtcccagctactcgggaggctgaggcaacagaatcgcttgaactggggaggcggaggttgcagtgagctgagattgtgccactgcattccagcctgggcgacagagcgagactcggtctcaaagaaaaaacaagaagaaaagaaattaatttcacctgtttctttttatcttttctaacgtgactgccagaaaattttaaattactcatggcttgcatttcatttctgtcccatggtgctgattcagatggttaatgtgacggagggggaatttgttactttggaacttccttttctagatactagaaaataaaatagattcccctcctccaagtttatttccttatagatataaattaaagcagaggaatacacgttttatgagcgtttctgatccttggtaccagaaagaggactgctctcagaagaactaattgtgttctgtttagctctgaatttagcagctgaatgactcagtgaacctcagggttctattttattttatttatttttttgagacacggtcttgctctgtcgcccaggctgtagtgcagtggtatgatcacggctcactgtagcctcgacttcctgggctcaagcgatcctcccgcctccacctcctgagaacctgggactacaggcgcttgccactatgcctgactagatggggtctcacagcgttacccaagctggtctcgccatctgcccgtctcggcctcccaaagttctgggattgcaggcatgagcctcctcacctggccccagggcgttagctttaaaatctatcctgctttcttctctcttttatcaggattaaatatgataatatatgtgaatagactttatagttgaaagtatgacatgaatgtagagtgacatttattgtaacacccaggtgttgatgattgtagttaaaggatgatagatgcaacctgaaagattgcaactttcagactggagcaactttgggttccatacctttttagataaaggggggtgctgattggatagacagtgtgggtcagtcttggaaataattgtcagaatttaccaaatcatagaaaaactctgttaattatttctatttggatgcagacaaaaacttataaatttgttttctctcagttgcctggaaaagaggttgttactatgagtgccttcatttattaaattaatttattatatttaacattgtttatttattttgtttctgttttataaacttattgagatgaacgtgacataatataaaattggctgtcttaatgcgaacaactcagtggcatttatttaccttcacaaagtggtgcaaccatcacttctgtcaagttccaaaacatttttcctgaatgcctttttattttatttttatttatttttaattttatttatttggtttttgagacggagtttcacttttgttgcctaggctggagtgcagtggtgccatctcggctcactgcaacctctaccacttaggttcaagcaattctcctgcctcagcctcctgagtagctgggattacaggcgcccgccaccatgccaagctaattttttgtatttttagtagagacagggtttcaccacgttggccaggctggtcccgaactcctgacctcaggtgatccacccactttggcctcccaaaatgctaagattgtaggtgtgagccactgcacctgtcgaatgcctttttagagtgctgacactccaccgcccttgacagtgactctccttgtctctattagattgttacaggtcagactgatttttgtttcttctctttcttgggcagagctcgaaagagcattccagacacatatgcagagcacctcattgctggcggactcatgacgcaggaggaggtgtctgaaataaaatcctcctactatgccaagttgaatgatcacttaaataacatggcccactacaggccccctgccctgaacctgcaggcccactggcagggcctggctcagccagaagcgcaaatcaccacctggagtacaggtgtgcccctcgacctcctgcggtttgttggcatgaagtctgtagaggtgccaagagagctgcagatgcacagtcacctgctgaagacacatgttcaggtgggcagcctccaaatggctggttattgcttctccttcctgctcagcaaaggagctgacgttggtctggtgttttcagttgtctgattcatttgacaaatatttattgtgtgtcgttaggttctagaaactgatcctagtgttgttttggtactgatagtcagttacctcagattttctcttcttttctttttcctccatgtatttatttatttatgcatgttcatacattacatgtacctggaatacatgcacactataagaaatacagagatacaagaatgtctgtttttatttttccaaccagtgagtagaaaacactttgtttcaggtggcttaaataaaagaaacaaaagtcaacacacataccccaaggtagccccctaaacatgctcatgttttacgtattgtcttaggatcactataggatgacaaaccaccctggtggacctgggacttaggggttttctggaatgtgggactttaagtgctaaaacaaggagagcaaagagttaaatgtctttttctttcttaagcttggatgaaggaactttgccctctaaattattttattttatgttatttttggatggaatctcactctgtcacccaggctggtgtgcagtggcgtgatctcggctcactgcaacctccacctcccaggttcaaacgattctcctgcctcagcctcctgagtagctgggattacaggcatgtgccaccatgcccagctaatttttgtatttttagtagagatgggttttcaccatgttggccaggttggtcttgaactcctgacctcaattgatccatccactttggcctcccaaagtgctgggtttacaggtgtgagccaccatgcctaacatgaattattttcaaacactaacttggccaggcacggtggctcctatctgtaataccagtgctttggaaggccaaggtggaaggattgcttgagcctagaagttcaagaccagcctgggcaacatagtggaccttatcgctagtaaagattaaaaaatttgcctggcatggtggcgcatgcctgtagtctcagctcctcaggaggctgaggtgggaggattgcttgagcccagaaggtcgagcctgcaatgagctgagattgcaccactgtactccagcctgggtgacagaataagatcctgtttctccaaaaagaggaaattaaaaaaaaaaaaccaacccactaactttaagtttttattataggtacagagactattacaacaaactattaatatgtactcatcactcagcttaggaaataggatgttataaatacagttccccacatacccctccttgatccatctcctcccacctccgcagaggtaaccactaacctaagcacgtgtttgttttgcctgttttaaaattgtatataggccgggtgtggtggctcactcctgtaatctgagaactttgggaggccaagccgggcagattatttgagttcaggggttcaagaccagtctgaccaacatggcgaaaccccttctccactaaaaagtacaaaaattagctgggcgtggtggtgtgcacccatagtcccagctacttaggaggctgaggcaggagaatcacttgaaccagggaggctgaggttgcaatcagccaagatcacgccactgcactctagcctgcgtgacagagtgagactgcctcagaaaaaaataaataaataaaaactgtatataattgctctccttctctaatgtatccttttgtactctgtttttattcagcattgtttttgatgcttaatttcgttgctttttttttttttttttttttgagatcaagtcttgctctgtcgcccaggctgtagtgtagtggagccatctcagctcactgcaacctccgcctctcaggttccagtgactccctgcctcagcttcctgagtagctggtatcatagagacacgccaccaggcctagctaatttttgtatttttagtagagatggagtttcaccatgttgtccaggctggtcttgaactccttacctcaagtgatccacccgcctgggcctcccaaagtgctgggattacaggcatgagccaccatgcctggcctgcattaaattttttgtactcattgtgaaaaaggaaatggactcttagacgttccttttttttcttcctctgaattttacagtccagaatggagaagatgatggacggaatcaagctagactgggccaccgcggaagctcttgccttgggttctttacttgctcaaggtaagaattttcttttttttttctgttttttttttttttgagtctcaccctgtcgcccaggctggaatgcagtggtgcgatctcagctcactgcaacctccgcctcccaggttcaagcgattctcctgccccagcctcccaagtagggcgcaccaccatgcccagctaatttttgtatttttagtagagacggggtttcactatgttggtcaggctggtctcgaactcttgacctcgtgttccacccgcctcggcctcccaaagtgctaggattatgggcgtgagccaccgtgcccagccaaggtaagaattttctgtctagctagtagagagtacttttaatcacgtttgctacctgttacctttgcagtttatttgagttataactacctcccattgtgttcattgaccagagaggttctaaagcatgttaatttttctttcctgacaatattacttatttgtagtataagtcatgctgacaaccttcatcagagtatagacataggacagttatgcctgggaaacaaagggctagtgctggatgtactggaaagatagttttctctaaaaattgcagggcacatgatacctctccactcttatgcaatctcatcttaactatagacttttgaatattggacagcatatattaataactatctgttatcctaaggaaaattctcaggattaagccagtatataagaatttacagtcaccacaccttattattaggttatttatgggaatctgactttttttttcttgcttgcttaaggttttaatgttcgtctaagtggccaagatgttggtcgtggaactttcagtcagaggcatgcaatcgtggtttgccaggagacggatgacacctacatccccctgaaccatatggacccaaatcagaaggggtttctagaggtgagatgtttctatagctgttgtaaaatccaggtgccaacgattacacttccaggattcttagaacaagtaggaaggagtgctggcaactttgggttcagtacttttggaagtaaaggagtgctaaatgggtggatgaggtgggtctgtcaatttggaatgcaagtaacccctagagagtaggctggagctttcttcttctggtgacatatctgtaatcatgtaaatgtcaaatcaatgtgtgttttgtcaactcaaagttgacattatcatctgcatattgctgtaattcattaaagttagtcaaagatatggataagtcagtattccttgcctacttaaggatagcaaaatcgcacatcctcaaggttacctgttccctaaggtatgattggcttgacgaatgtacacataaccgtgtatttctttcttttttttcggagacttaatcttgctctgttgcccaggctggagtgcagtggtgccatcttggctcactgcaacctccacctcccaggctcaggggatcctcatgtttcagcctcccgagtagctgggaccacgggaatgaggtgccattcctggctaatttttttatttttagtagatggaatttcaccatgttgcccaggctggtcttgaactcctggcctcaagcagtccacctgccttggcctcccaaagcactggaagtataggtgtgagccactgcacccagccagatataaccatgtatttctgtgtggcagcctctgtgccctctgtagtgccttaaggatagtagtggagtcttttcatttatttatctcaaacaattattcaagtgtctagcacatgatgtttatgaaaataacttattccttaaggtaagttgagtggcatgtcatcttctttcctactctagccattagtttgagaacatcatcttgagttactgacaccttataaaaaattcacttggtggccgggtgtggtggttcacgcctgtaatcccagcacttcgggaggctgaggtgggcagatcacacggtcaagagatcaagaccatcctggccaaaatggtgaaaccccatctctactaaaaatagaaaaattagctgggtgtggtggcatgcatctgtagtcccagctactcaggaggttgaggcagaagaatcgcttgaacccaggaggcggaggttgcagtgagccgagaacacaccactgcactccagcctggtgacagagcgagactctgtctcaaaaaaaaaaaaaaaaaaagaaaattcacttggcaaaagccacattttaggaagataactgaagggatatggagctcatcttttctttaagttagtccaaaatctacccttggatcaagtcagattgccaaactagatactgaaatgtttagcattcccctacctcagatgaggctttcattgaattgtgctttgatatttattatcagttttgaattttgctattgaaaaagtcccaattaaatgccttgtgtctgttttgtggatactgttgaagatttaatttagtttcattcattcattcattcgttcatttatttatttgagacggagcctcactctgtcacccaggctggagtgcagtggcgtgatctaggctcactgcaacctctgcctcctgggttggagcagttctcctgcttcagcctcccaagtagctgggattatttggcctcccagagtgctgggattacaggcgtgaaccaccacgcctggccgaagatttaatttattatttagacctggcacggtggctcacacctgtaatcccagcactttgggaggccaaggcaggcagatcacttgaggccaggagttcaacactggcctggccaacatggcgaaaccctgtctctactaaaaatacaaaaattagtcgggcatggtggcacacgcctgtaatcccagctactcaggaggttgaggcaggagaattgcttgaacccaggaggcagaggtagtgagcggagatcataccactgccctccagtttgggcaacagagcaagactctgtctcaaataataataagagtaatttattatttaataccatgtcctctatgtgaagaccctgggagaaactcctgcttgatcttggtagtgagagtagctatattttcctgagtagtgatctgccttcattgtctaatagtattgaattttgtaactgaccagcattcccttatcaataatggcttctaggaagggacagaggtcaggcagccttcatgataagtgaataggtccttggggtgtgtttttcccccaacttcgttgtacatctcaatctgtgtgtgtgtgtgtgtgtgtgtgtgtgtgtgtgtgtatgtatgtgacaggtcctcctctgttgcctaggctggagtcccacagtgcaattatagctcactgtagcctccagctcttaggcacaagcaattgtcccgcctcagcctctcaagtagctgggactacaggcaagcaccaccacgcctggctacttttaaatattttgtagagataggagtctcactgtgatggccagtgtcatcttgaattcctggcctcaagcaatcctcctgccttggcctcccaaagtgctgggattatagatgtgagctgccgtgcccagcctagagggtttttatttttttaagtaaaagctttattgagctataactcatacaattcaacctctcagtgtgtacacttgagcagtttgtagtctattcacagagttgtgtaatcatcaccactatctaattttagaacattttcattaccctagaaagcaagcccatgcccgttagcagtcactgcccattccttcctccctccagcccctggacaccactcatcgactgtttgtttctattgatctgcctattttggatgtttcatgtgactagaacggtataacatgtggccttttgggactggcttctttgacttggcatcatgctttcaaggtccatccatgcatgcagcatgtatcagtacatccttcttttttttgagaccaagtcttgctctgttgcccaggctggagtgcagtggcgcaacctcggctcactgcaacctcagattcctaggttaaagtggttctcccacctcagcctcccaagtagctgggactgcaggtgtgcgccaccaggccctgctaatttttgaatttgtagcagagacagggtctcgccacattggccaggctgatctcaaacttttgacctcaagtgatcatctcagcctcccaaagtgctgagattacaggtgtgagccaccacactctgcccgtccttcctttttattccaaaataatattctataaagatgtagcttaaacatatatttttttaaaatttgaaagaaacaaaattaccaaaatgttgtgtacagtaaggaactttttctcatctttattttttcttttgagacagggtctcactctgtcacgcaggctggagtgtagtgatgcaatcactgctcactgcagcctcgacctcctgtgtccaagtgatcctcctagctccctttttccatcttgaaccatctgagagctagttgccatcctggtgccccctactgtgtatttccacaaatggggggacatccttctccatcataacacaccaaaatcaggaaatgaacacagacatgactaccatgtatttctcaaaccaagatcaacaatttttttttcttttttttttttaggcagagtctcactctgttgcccaggctggagtgcagtggcacaatctcggctcaatgcaacctccacctcccaggttcaagcaatcctcccacctcagcctcttgaggcctgcatcaccatgctcagctaatttttgtattttttgtagagactgggtttcaccatgttggccaggctggtctcgaactcctgacctcaggtgatcctcctgctttggcctcccaaagtgctgggattatgttttgcatttaattgtaatgtctttttaaccttctcagagataaaatttgtattctgctttttttaatgttaacatatcatgatggttcttttgatttaccatgcaaatacgatgttagaataatgattttaaccaaaggtaggactttattttttaactttcctcactttgtttcatgataatttttttcttttttgagacaggatctcactgtgtcacgcaggctggagtgcagtggtgcgattatagctcactgtagtttcaacctcctgggctcaagtgatcctcccacctcagcctcccaagtagttgggactacaggcatgtgccaccatgcccagctaatttttgtctgctttttttagagatggggttttgccatgttgcccatgttgatctcaaactcctgtgctcaagcgatcctcccatctcggcctcccaaattgttgggaggccaccacgcccggccacaggtttttgaaaagcttataagacgcagttgtatacctagctccagaagagggtcatctgagaagtatatgtgcttatccttgaagaaactctgtaatacccatattccagcctcttttatcttttcctctctttgtcccaacttttctcatctgcatcactgacaccaagcagcaaatctcttctcaaaagaatgtggtgatgaggccgggcgtggtggctcatgctgtaaccccagcactttggggggccaaggtgggtggatcacctgagctcaggagtttgagaccagcttggccaacatgctgaaaccctgtttctactaaaagtacaaaaattagctgggcatggtggcgggtgcctgtaatcccagctactcaggaggctgaggcaagagaatcacttgaacctgggaggcggaggttgcagtgagccgagatggagccattgcgctccagcctgggcaacaaaagtgaaactccgtctcaaaaagcagaaacaaacaaacaaaaagaatgtggtgatgaacgagagcaaggctccctctccgcaccacctcccttcgataagttcgcaggagcccagtgctctgccgtggccctcacatgcagcgtttccttctcttctctgggattaggtcagcaacagcccactgtcagaagaggccgtcctgggatttgaatatgggatgagcattgagagcccaaagttactgcccctgtgggaggcacagtttggcgatttcttcaatggtgcccagatcatctttgacacattcatctctggaggttggtgtcagcgtatagggtgggtacaggtgggggtccctgcgtggccccagcctcgtggggacaaatgaatgaaaaggggccactgctgccttgagactcccgtgtgcggcggcgcctccagggagttggggtcaccctgttatgacgggagtgtggccactgtcaggttaatgtgttactgggacaaaaacccaagctctctctcagcaggagcactggtgccacccagcacctgtgctcaggggtcagtagggccatgaaaacccgctccagtgtctgaaagcttccgaagcagtacctgctcaccgtaaaaattagaagtaattgaagtaaacgtctaagtcttctccccagaccctgaatcccattttccagggatgcccactcttgggttttgaatacctgccttaaatctttcctatagttatgcttctctgtaacattttcactgggaggaagaaaagtgcctgagggcctggacttctgacttgtccagagactgttctgtcgtgcccaccaccccctgtttcaagacagtggcctgtgttgtcagctgggctgtgagagctgcccattctttttcttttctttttttttttttttgagacggagtctcgctctgtcacccaggctggagtgcagtggtgcgatctcggctcactgcaagctccgcctactgggtttgcacgattctcctgcctcagcctcccgagtagctgggactacataggcgctggtcaccacgcccggctaattttttgtatttttagtagagatggggtttcaccgtgtcagccgggatggtctcgttctcctgacctcatgatccacccacctcagcctcccaaagtggtgggattacgggtgtgagccactgtgcccggccgggagctgcccattcttgtaagagtggtgcctgcggtggtattggagcggcatgtgctgtccaggaagctgggaacgttcccctttgagtttgtcttccactcgtaaaagcccagggcctgtgccgtgataggttatggctttcttttttgagacggtgtctcactctgtccctcaggctggtgtgcagtggcatgatctcaggacactgcaacctctatctcccggggtcaagtgattctcccacctcagcctcccgagtagctgggactacagacatgtgccactacagctggctaatttttgtatttttagtagagacggggtttcaccatgttggccaggctggtctcgaacacctgacctcaagtgatctatccgcctcagcctcccaaagtgctgggattacaggtgtgagccaccgtgcctagcccatgataggttttcattcaatgaaatggacatttccctaagtatagcataacagttctagaaggtgcatgtaatgaaagcagttttggggggccaggcagaaaactaacattgatttccccagctgagtcgtgtcaggccactttgtccccgcttcgtagagctcttactccccacgtggtacttttccaggagaggccaagtggctcctacaaagcggcatcgtcatcctccttccacatggctacgatggggctgggccagaccactcatcctgtcgaatagagcgtttcctgcaggtaagggtaacgtcttccggagtcaatgaatcattttcctgcttcctagagcttttctacctcctgcggatagcttaacgcccacctaactgtaacacagcttagtatttgagtgaaacagatttgatgcaatgtcaattttctttggaaacgtaatgcctcaggtataattgtatcacggttttatggcaattaaagttctcttgtgccaggatcagcagttcttataccaggctgatcatcagaatcccccagagagcttttttatttttatttttttttgagatggggtctcgctctgttgcccaggctggagtgcagtggtgcgatcttggctcactgcaacctctgcctcttgggttcaagcgattctcctggctcaccctccaagtagctgggaccacaggcgtatgccaccatgcctggctaatttttgtgtttttagtagagattggtgttcttccatgttggccaggctagtctgaaactcctggcctcaagtgatctacccgcctcagcttcccaaagtgctgggattacaggtgtgagccaccaaccctggctggttattaaaacatttgaaatatcctgccagaaatagccattgtcctcatttggtgtgaatcattacaaatgtctccttttgcatgttatttccttatagtttattatgaagactttcagatatacagaaaagttggaaagaatttactgtgaatactcatatgcccactccctagaattcaccattattttttattatacttgttttttcacatatctattcatctgtcattctggtatccttcaatgcatcttatgttttgattcatttcaaaataaatggagacattagccgggtgcagtggctcacacctgtaatcctggcactttgggagaccaaggcaggtggatcacttgagatcaggagtttgagaccagcctggctaacacagagaaaccccatctttactaaaaatacaaaaattagccatgtgtagtggctcatccctgtaatccaagctactcgggagcctgaggcaggagaatcgcttgaacccaggaggcagaggttgcagtgagatcacgccactgcactccagcctggacaacaaagactctgtctcaaaaaattaaataaataaataaataaataataaatagagatatcaatacatgtcaccccaagtacttcagcatgcatatcgttaatgattttggcatgcgtgcagctaaaatgtataaacagatgatagcttaatagataggtagacagaacaacagatagatggatagttacattaatgatgacatcgagaattttatttaaaaagagattagagtaatggtagataaactaaagcatgacatgtgaaatgcaaaactactagttgttgaagaaacagaggaaatgagtaggtgggggatacagtttcggagtcatcagccactagatgacattgacagtcatgagtctggaagaagtcatcgaagcagcgagcacagtggaggagagaaggtgcctgagctctgggccctgggatagtccaacctcagaggatgcagagaagaagaagaagtgagatgaagaaggagcaaccagtgaggtgggaggaagatcttagaaagcaagcgaaggaaacatatcagggaagagggagtgtcagtgtcaattaagatgaggagtgaagtaatcccagcactttgagaggccgaggtgggaggatcacttgagcccaggagtttgagaccagcttgggcaacatagtgagaccctgtctctactaaaaataaataaataaataaatagatgaggcataagaatgaaccactgaatttagaaatcaagagtccatttgttggttgatgactgcggttttgatggagtggtagggacaaaagtctgtctgggacatattaaggactatctagagcaacttgtccaacctgtgtccatggaccacatgcggctcagaacagctttgaatgtagcccaatacaggctgggcgtggtggctcactcctgtaatcccagcactttgggaggccgaggcgggcggatcatgaggtcaggagatgaagaccatcctggctaacacggtgaaaccctgtgtctactaaaaatacaaaaaattagccgggcacggtggcaggcacctgtagtcccagctacttgggaggctgaggcaggggaatggtgtgaacctgggaggcggagcttgcagtgagctgagattgcgccatgcactccagcctgggtgacagagcgagactctgtctccagaaaaaagaatgtggtccaatacaaattcataaactttcttaaaacattatttgtgattttttttttttaccttattagccattgttagtgttagtgtattttatgtgtggcacaagacaattcttcttcttccggtgtggctcaggtaagccaaaagatcggacacccctgattcctgattctagagaaaggaaagtgtatttatttaaacatttttaattgacaaatgtacaattgtatatatgaatagtataaaatgtgatgttttgatacagctatacattgtgaactgattgaatcaagctaattaccagacccgtcacctcacatactcaccatttttggggaagagaacatttaaaatctatcctcttagtaattttcaggtatataatacgttaactacagttaccatcctgtacagtagatctccagaacttattcaagggaggaaagttggcctagcatggtggctcacacctgtaatcccagcactttgggaggccaaggtgggtggatatcttgctcaggagtttgagaccagcctgggcaacatggtgagaccccatttctgctaaaaataaaactaaaaaaattagctgggtgggtggtggtgcgtgcccataatcctcactacttgggaggctgaggtgggaggatcacttgagcctgggaggcggaggttgtagtgagctgaggttgcaccactgcattccagcctgggcaagagagccagaccctgtctcaaaaaaaaaaaaaaaaaaagggaggaacatcaacttaactcttttgaggagtattgctgtaaatagaacaagaaaatgagacagtagctggtgggaaaatttgtgtcaagagttccttttgtgttttcttttatttttgtgatggcgtcttgctctgtcacccaggctgtagtgcaatgctgcagtcttggctctctgcaacctctgcctcccaggttcaagcaattctcctgcctcagcctcccgagtagctgggattataggcttgtgccacgatgcccggctaatttttgtatttttagtagagatggggtttcaccatgttgaccaggctgctcttgaacccctgacctcatgtgatcctcccaccttggcctcccaaagtgctaggatttcaggcatgggccaccgcgccaggcctttgttttgtgttaaaggtaggaaataaggcctgtttggtgataggcatgatccagtagacaagaagagaatggtgatgtaggggtgctgatagaataactgagtgatttccttgcattggtaaaatggggtgggctctagtacatgatggattaaattagctttagacagcagcatggttggtggcaataaatggaaggcagagaagatgagtgcaagtgagaatgtgtgtgtagatggtctgaggacatgctgttaggtcattagctgagagtggtgatgcaggaggaggtcctgagtttaaaggtgtgaattagtcacctgggaaagaaggagaatgagtgagttagggaaatagagtttaagagtctaaggtcactaagggcccatctcagactgttggtcaggattctaaagtaagaccattggtgtgattttgtgttgtctccagctactttctctgcagacatggaacaggcagaaagtggggattaactaggtttatgggttggagtgaagggtcatgggaatcaagggtgtatgcaaaaagaagatgatcatgattgaggccaggcatggtggctcatgcctgtaatcccagcactttgggtggctgaggcgggaggatcgcttgaacccaggagtttgagaccagcctgggcatcataacaagaccccatctctacaaaaatattaaaattagtcaggtgtggtagcaggcacctgtagtcccagctacttgggaggctctggtgggaggattgcttttgagtccagagtttggggttacagtgtgctatgatcatgccactgaactccagcctgggtgagagaacgagactctgtaacaacaacaaaaataattgtccagattttgtcaactctctttctttcctttcactgcctttggggaagggttaggagttatgcctcagctttctgtcccaccaggatcttctgagatttaacttccttgccctcaatttttcaacctttctattagctgcttttgatttttgtcttaaagcacgcgtgcacacacacacacacacacacacacacacaatcgttttattacattaggaaagtgagattctgatagtgcttccttcccctgtcttaaccctgtagtaatcagaatatgtattttttttaaaaaagtcctttccagattatctttgctatcagccgtgtttgggaacaattgtgttagatgacacagaattgggccagtggagaaagccatcagagctctcctttggttaataccgcaccgttcataaattcacctgctgatatttttctgtaatgttgggcaatagcttttctgctataatcaagaacacctgtgtttccctttggccagcccattgtcactacgactgaaatagatgatctgaacattcttctcctttcttgccacttctctcccagatgtgtgacagtgcggaagagggggtggacggagacactgtgaacatgtttgtggttcacccaacaactcctgcacagtatttccacttgcttaggagacagatggtccggaacttcagaaaaccactcattgttgcttcccctaagatgttactcaggctcccggtaagcagaaggtggtgaataagccttcctccttttgtcattttttgcactccatttttccctattttccatatctaattatatttaaattacagaaacacctttttagtttcaactgactttgctactttcattttttttgttgttttttgagacgcagtcttgctctgtcgcccaggctggagtgcaatggtgcaatctcggcccgttgcaacctctgactcctgggtttaagcgattctcccgcctcagcctcccaagtagctgagattacaggcatgtgccaccacacccagctaatttttgtatttttagtagagatggggtttcgccatcttggccagactagtctctaactcttgacctcaggtgattcgcccgcctcggcctcccaaagtgctgggattgcaggcgtgagtcaccacacccagcctgctttcattttttaaacagccttttaagactacctggaaagataggtaggttttctgtcaattgtaatgaaggacagggatagcagatgttatactagtgccctcctgagcagaaatactatttagaaaagcttttaggctattaggctgggcatggtggctcatgcctataattccaggactttgggaggcctaggcaagaggattgcttgagcccaggagtttgagagcaacctgggcaacattgcaagaccccatctctgaaaaaaaaaattggccggtgtggtggctcacacctgtgctgtcagctgctcaggaggctgagatgggagcatcttttgagccctggagttcaaggctgcagtgacgtatgaccatgccactacactccagcctgggcaacacagcaagacattgtctgaaaaagaaaagaaaaagttttaaagcccatatggtctaagcactattttttttgatagcagcaatttgggaattcaaagtattttgttgaaaatgagtggcattatttgtcattcttttttttttttttctttttgagatggagtcttgtgctgttgcccaggctagagtgcagtggcgtgaaatttatcattttatcatttaacacatacgtaggtttacctatttatctgttaagtgtacattgtttttcaaatcacaaaaatatgctagtttccaaatagaaatgttcaaaataataaatactactaagcatatatttatcccatctgctatacttttttcaggttcatatgagttttaattagaattagtattaaatttttttttttttttgagacggagtctcactctatcacccaggctggattgcagtggtgctgtctcagctcactgcaacctccaactcccgggttcaagcgattctcctgcctcagcctcctgagtagctgggattataggcactcgccaccatgcctggctaatttttgtatttttagtagagatggggttttactgtgttggacaggtggtctggaactcctggcctcatgtgatccacctgccttggcctcccgaagtgctgggattacaggcatgagccaccgtgcccggccgggagtattacagtttttacatttatttggatatgactgctgaggtgaaataagacgtttagaatttggccattcaagaatatcttgtgctgctcacaaaggttcgagagtgtatatttggaattgaggggtactgaagaaaagctgcgagtgatttgcttccaccccttggttggttggttggttggttggttggttggttggttggttggttttttgagacggagtctcgctctgtcgcccaggctggagtgcagtgctgcgatctcggctcactgcaagctccgcctcccgggttcaggccattctcctgcctcagcctcctgagtagttgggaccacaggcgcctgccaccacgacctgctaattttttgtatttttagtggagacagggtttcactgtgttagccaggatggtctcgatctcctgacctcgtgatccgcccgcctcggcctcccaaagtgctgggattacaggcatgagccaccgctcccggcctgtttgaacagtttcttgagatggagtgtcgctctgttgcccaggctggagtggagagcgcgatcttggctcgctcgctgcaaactccgcctcccaggctcaagcaattctccagcctcagcctccccagtagctgggattacaggcttgtaccaccatgctcagctaatttttgtatttttagtagagacagagtttcatcatgttggccaggctggtctcgaactcctggcctcaagtgattgggctgactcggcctcccaaaatgctgggattataggtgtgagccactatgcctggcctcgttgttttaagcagtttttagcattcagaggggagtagggaggtactcattctcaggggcgatattttcatggccctaaaatcagtgcctccttaaactttttgcactaggtaccttacttgactcaccctagcctggccctgggagtcagtatctagtcaatagccaggaaatggatttcagtagtcttaccaatagcagccattcatttttagttcacttatagtggtctaccggttctttctcacccagtgtttcgcaaacaaccttatatatttctaggtgacctcataagcctggaagcatcaccaaacatttaggaagagttaatgcaatgcctttagcaccatttttctgatggggctcttttttttcttttttttgttattttgagagtctcgctttgttgcctaggctggcatgcagcggcataatcttagctcactgcaacctttgcctactgagttcaagcaaggcctcagcctccgacgtagctgggactattaggtgtgtgccaccacacccagcaattttttttttttttttttttgagacagagttttgctctgtcacccaggctggagtgcaatggcacaatatcagctcactgcaacctccatttcctgggttcaagcaattctcctgcctcagcctcccaagtagctgggattacaggcatgcaccaccatgcctggctcatttttgtatttttaatagagacgaggtttcgccatgtgggccaggctggtctcaaactcctggcctcaagcaatatgcctgcctcggcctcccaaagtgctgggattacaggcatgagccaccacgtctggcctgattcttaaaattatgtcgtggcaccaggcaaaaggtaatcttttcttaaattcattttttaatttttattgtcatccttgtgcaggggccatgctaatcttctctgcagtgttctaattttagtatatgtgctgccaaaatgagcacagaaggcaatctttttactttttttttttcttgagatggagtttcctgttacccaggctatagtgcaatggtgtgatctcagcccactgcaacctccggctcccaggttcaagcaattcttgtgtctcactctccccagtagctgggattacaggcatgcaccaccacgcccagctaacttttataattttagtagagacggggtttcaccatgttggccaggctggtcttgaactcctgatatcaggcaatctgtccacctctgcctcccaaagtgctgggattataggcatgagccaccgcgcccagtctttttcttttctttttttttttttgagacaaggtctggctctgtcacccaggctggagtgcagtggcatgatcatggctcattgcaacttccgcctcccaagctcaaacttctagcctcccacctcatcctcctgagtagctgggactacaggcatgcgctaccacacctggccaatttttgtatttttttgtagagatggggtttcaccatcttgcctaggctggtctcaaacttgtgagttcaagcaatccacctgcctcagcctcccaaagttctaggatcacaggctggagccactgcaactggccagttttggtttgttttgtttcggatgaggtcttgctctgttgcccaggctggagtgcaatggtgcgatttcagctcactgcaccctctgccttctgggttcaagcaattctcccgcctcagcctcctgagtagctgggattacagacacccgccatcatgcccagctaatttttgtatttttatatttttgtagagatgggatttcaccatgttggccaggctggtctcaaactcctgacctcaggtgatccgcccaccttggcctcccaaagtgctgggattacaggcatgagccacggcaccttttttttttttttttttttttttaatagaggcaaggcaccagtggggatggtggagtagggggtgcaaagggagtctcgctatgttgcccaggcgggtcttgaactggcctccagcgatcctcctgccttggcctcccaaagtgttaagattccaaaaggctatcttatgtaacctcagaaacatagttttaccctgaagtatacagaactgatattttttggcaaggcattgcgtctattaggacatgggtctccttgcagtgctaggctagaactttggtactcgtgtttgatagcggcccttgtaagtgacagcatcacctctttctgttgcttgctggatgtgtggcctcttctccctcgtaggcagccgtgtcaactcttcaagaaatggcaccaggaacaacatttaacccggtcattggtgattcatctgtggatccaaaaaagtaagatatgtatctctgttttcatattctgtggcagaattttaattaatgggaaaagtagttcacattaagagatcacaggtgatgcagatctcccctctcctatttttatttatttatttatttatttatttatttatttatttatttttgagactgagtctggctctattgcccaggctggagggcagtggtgcaatctcagctctatgcaacctccgcctcccggattcaagtgattcttgtgcttcagcctcccaagtagctgggattacaggtgcccgccaccacaccctgctaatttttttatttttagtagagatggggtttcaccatgttggccaggctggtctcgaactcctgacctcaggttatccacccacctcagcctctgaaagtgctgggattgcaggcgtgagccaccatgcctggcctcctctatcctaagtcctttaagtcagtggagtatgagttaagtgtgggtgggaaagtggactttgtaggcgcatgttgctgaagaagggtccccaggaatagcctgtgactgaactcggctgcagagacccccaccaccttgttcatgaggactttaaatctgcactgtctcccgtttcttctgacataattctctttttttttttttttgaggttgagtcttgctctgtcgcccaggctggagtgcagtggcacgatcttggctcactgcaagctccgcctcccgggttcacgccattctcctgccttagcctcccgagtagctgggactacaggtgcccgccagtacgcccggctaattttttgtatttttagtagagacagggtttcaccgtgttagccaggatggtcttgatttcctgacctcgtgatccgcccgccttggcctcccaaagtgctgagattacaggcgtgagctactgcacctggcctcttctgacgtaattcttactttaaaaaatttctcccccaccctattgttccttttctgtccaacagggttaagaccctcgtgttctgctccggcaaacatttctactccctggtgaaacaaagagaatctctgggggccaagaagcatgactttgccatcatccgagtagaggaactctgccccttcccgttggattctttacagcaagagatgagcaaatacaaacatgttaaaggtaagaggttgttctcatttgggttttgatgttcagatacccaaaacccatttcagctcttttaaatgaaaagatgtggtgggggttattagaaaattgaatcttgggccgggcgcggtggctcacacctgtaatcctggcactttgggaagctgaggtgggtggatcacaaggtcaggagattgagaccatcctggctaacacggtgaacccccgtctctactaaaagtacaaaaaattagccgggcgtggtggcgggcgcctgtagtcccagctccttgggagcctgaggcagaagaattgcttgaacctgggagacggaggttgcagtgagccgagattgtgccactgcactccagcctgggcacaagactctgtgtcaaaaaaagacacaaaaacatgaaaatttggtacaggcggggcgcggtgcctcacgcctgtagtcccagcactttgggaggccgaggtgggcggatcacgaggtcaggagatcaagaccatcctggctaacacagtgaaaccccgtctctactgaaaatacaaaaaaattagccgggcgtggtggcgggcgcctgtagtcccagctacttgggaggctgacgcaggagaatggcgtgaacccgggaggcggagcttgcagtgagccgagattgcgctactgcactccagcctgggcgacagagcgagactccgtctcaaaaaaaaaaaaaaaaaaaagaaagaaaatttggtacatatatggggcctgtccgagggtcatgggggaggagggagagcatcaggcagaacagctaatggatgctgggttaatacctaggtgatggatgatctgaggagcaaacctccgtggcacacatttacctgcataacaaacctgcacatcctgcatgtgtaccccagaacttaaaaaagaaaaaagaaaatgcattgaatacacctaaactacaaaacacagcttagcctagcctgccttaaacatgctcagaacactcacattagcttatcgttgggcacaatcatttaacacaaaatctattacatttcataatgaagtgttgaatatctcagataatttatcgaatactgtaccaacagtgaaaaacagaactgttgtatgggtacttgaagtacagtttctagtgaatgtgaatccctttcacaccatcgtaaagttgaaaactccatcgtaggtgggatcatagtaaattggggaccgtctgcatgtgtctacttgaggtgctgaaagaatttcttctctcatagatcatatttggagtcaggaggaacctcagaacatgggtccgtggtcgtttgtttctccaaggtttgaaaagcagctggcctgcaaggtaatcacacgttttctctggtagtgttttgtgttttgtgtgcatgttgtttttcttttctttctttctttcttttttttttttgagacagagtctcactctgttgcccaggctggagtgcagtggcgcaatctcagctcactgcaagctccgccccccgggttcacgccattctcctgcctcagcctcccaagtagctgggactacaggcgcccgccaccacacccagctaaattttttttgtatttttagtagagacggggtttcaccatgttagccaggatagtctcaatctcctgacctcgtgatccgcccacctcggcctcccaaagcgctgggattacaggcattgaggcacggagccctgtccctctaatctcttctgcgtaactcattatttgaaagaggtgatttatggttaaacaagctaagagaaatacatgcactgtcttgttggaactaagcagagctctgatctagtcaaaatgtcattttatttcttctctgctgcacttatagctccgtctggtgggccggccccctttgccagtacccgctgtaggaattggcacagttcacttgcaccagcatgaagatatcctcgccaagaccttcgcttgatgatgacttttgaagaaacactatttctctttaagaaaatggccattaaggccgggtggggtggcacatgcctgtaatcccagcactttgggaggccaaggctggtggatcacctgaggtcaggagttcgagaccagcctggccaacacggtgaaaccccgcctctactaaaaatacaaaaaatagccgggtgtggtggtgggcacctgtgatcccagcttcctgggaggctgaggcaagagaatcgcttgaatctgggaggcggaggttgcagtgagccaggatcacaccattgctgtccagcctgggtgacagagcaagactgcgtttcaaaaaaaaaaaaaaaaaaacccattaaaagaggcctccttcctccactctctcaacccctctgttgggtaacatgaaaagactgtattcctctaagatgttgggattgatatacgtgatttaatctgcaataggtggaataaccaggggaactggttatgaatatgtgaatgcaaccagcaaatttatccttgaaggtgtgatggtagaaataggaaaacaacaaaagaaaaacaataacaaaaaaagaaagtgtgatggctgggtgcagtggctcacgcctgtaatcccagcactttgggaggcttaggcggctggatcacctgaggtcaggagttcaagaccagcctggtcaacgtggtgaaacgccgtttctactaaaaatatgaaaattagttgggtgtggtggcatgcgcttgtagtctcagctactccggaggctgaggcaggagaattgcttgaacctggaaggcagaggttgcagtgagccgaaatggcgccactgtactccaacctgggcgacagagcaagactccatctcataaattaaaaggaaagtatgatagtgttatggattttagctctgagtgagctggaaaactaggtcattatctagatgatttcagacttgaccctaattgaccatatatgaccaggaaacacttctgagtttacagctccgtggagatgacctcaacactgcctcttgatttgtttgatgcatgtcactttcattaattttccccctcctttttgaaagtcctgtggcagtactaatattttcattttatgtaatctctggtgctgctttccagtcactgtatgaagtgtctccccaacactagcaaatctaggtcctactaaatacaaatctctgggtggatgatcttctagtactgtatttttaaattaaggagttttagttataatgaaattgatttgtagtctgttttgccgtaaacttgtttttctttaaattgttcttacagtgatatcttactatttttaactgtctggggtttctgatatggggatttcagcccctggttaatcagtcttgtccctacaagtccctgatgcagtatgtttatttgtgatgtttaaagaacatttcttggctgggcgctgcggcttgcgcctgtaatctcagcactttgggaggctgagatgggtggatcacctgaggttgggagttcgagaccagcctgacaaaacatagtgaaaccccgtctctactaaaaatacaaaaattagctgggcgtggtggtgggtgtctgtaatcccagctattcgggaggctgaggcaggagaatcgcttgaacccaggaggtggaggttgcagtgagctgagatcctgccactgcactccagtctgggtgacagagcaagactccatctcaaaaaataaataaatagaaagagagagagaggaaaaaaaaagaaaagaacacttctttatttgagggactttcccaacaccaggtgcttggggatttcttagagatcaccaaccgactccctcactgtgaaattaaaccaagtactggaaacgtaactaaacagcgaaccatgtagcttcacctgactcagtgctgggggcctctaccatctactgtgcttgtgtcatgatgctttttctctgaagtggtgtgggaagtaccaggggactggcagaagcccaggccctctctacttttaccagcaactgatcatgtctttcagaatccatgtacatataggctgttctagccacagtggtagatttatgattcacatccgaaagtgtgccttagttatcaatttaacatttctctagtattcatatcccttttcttaccatatacctcagtgtatccttcctgtgtcaagccttataaatcatgtaatttagtgccactcatgtaaatcagtaaaatcacaaaggtctatttaatgaaaacgatttaccaatgttgtttttttttaacaagaaaaaaaataaaagcacattgtcattttttttcctca

SEQ ID NO: 749 - DNA, 35764 bp, Homo sapiens
aagggcggagtctgcgcggggttgggcggagcctgcgcggggccggtaggatcgcgtcgggagccggtaccgaggcccgagccgcgggagtcgagcgaaggcagcgccgaggccgcggtttccccctgggcctccccagcagcagccatgggcagtgagtagcggcggctggagcggggactctggctgggaacgcaggccccgcctgggctgcgggcggtggggctggcgctcgctcggagtcgtgggggccagggatgcgcgggccgctccgggcctcagcggagggcacgggccgggggcctccgccgaggctcccctagccgtgcgaggccttgcccggcgggtaccgggacccggaggcccggggtttgcgtttgatagagggcgaggatggcgctgggaggccattggttttgggggcggggagttagggcaccgggtgaacctggaccactttttaatttttcaggagttaaagaaatcccgtgtttttattccctcgtcatctttccttggcatgttgcattgaagaaagctcccctaactcgtttaattttaaaaaaagtgatgcatggcgtgtgttttagggaggaaaggagtgtgcattggtaacagcgttttccttaaactgttcattctgtagcgtttactgaaaactgtaaggttttataagccttagggacaaggccttatgttataggaatgtttttcagggccctccccgtaacactcaaccccacatatgtgcacgtagctacttgcatagctgtgaagatgttcgttggatgatgggtcgtgcatacccaagcagggcacccattggccaactagtggacatttgggggaaattagaaaggagtaggagagacccgtggtaaaattttgcatcacaaggatagacagggggcagccaaaagctttgcttgaacatgaataccccttacagatgatcataaagtgtcaagaaatctgagagtggcttggattgaggtggagaggaaaagggatggagaggttctaggaagcctcctgatgtgattgatacttgtttcgcgttagcaatgaatgctttcataattcagatttactttccagaaaatccaaaatattaggttgctgcaaaagtaattgcggttttcaattacttctcaaaaaccgcagttacttttgcaccaacctaatagtacttgggtaacaaacatctgcccatgacaattagttaatccttctgtcaaacatcagtgactggtggggcgcagaggctcacgcctgtaatcccagcactttgggaggccgaggagggcggatcacccgaggtcaggtgttcgagaccagcctggccaacatgatgaaaccccatctctactaaaaatataaaaatcagcctggtgtggtggtgggcgccagtcatcccagctccccaggaggctgaggcaggagaatcccttgaacccgggaggtggaggttgcagtgaatggagatcatgccactgcacttcagcctgggcgatagagcgaaactccgtctcgaaataaacaaacatatatcggtgactgcccatcatttgtagaggcttttttaaaaaagataatatagtcaactttaggcaactacagaaacgtaatcactcacgtcagctttaagacaattttgggatgttggtatatagaatccagtgtctgtaggggaagaaaagccgcagagcctaactaatacctagctgcggcttgtctttctccacattgcagaccctttggcaaaggacagaagcttgagagattgtcattttcaccctccagttctctggcaggacttgacttaagccgtgccagaagacagtgtctatccttaaagaaccttgatttatcttacctttatatgttataagagtagtctgggaaaacaatactttctgatgaaatgtaattgttaattctctgggttgattattttacacaagcaagtacttttctattacctgggagagtaactaggcaatgaaatgtggtctgatgaaatcaaacagagattacataccttttttttttttttttttttttttttttgagacggtctctctctgctgcccaggctggagtgcaatggctccatccgggcttactgcaagctccccctcctggggtcacgccattctcctgcctcagcctcctggggaggggggactacaggggcccgccaccacgccctgctaatttttttttttgtatttttagtagagacgggggttcaccatgttggccaggctggccttgagctcctgacctcaagtgatccgcctttctcggcctcccaaagtgctgggattacaggcgtgagccaacaagcccggcctacatactttaaaaaggtaactacaggggctgggtactgctcacgcctgtaatcccagcactttgggaggccgagacgggcggatcacgaggtcaggagttcgagactagcctgaccaacatggtgaaaccccggctctacgaaaaatataaaaattagccaggcatggtaccgtgcgcctgtaatcccagctatatacgaggctgaggcaggagaatcacttgaacccggggggcggaggttgcagtgagccgagatggcggcactgcactccagcctggaccacagagggagaatccgtctcaaaaaacaaaaacaaaccagttaactataggggccaggtgccatggttcatgcctgtaatcccagcactttggaaggctgagatgggaggatcgcttgacgttaggagtttgagacaagcttggccaccatggtgaaatcccatctctagtaaaaataaaaaaattagctgggcttggtggcactcgcctgtaatcctagctactcgggaggctgaggcaggagaatcacttgaacctgggaggtggaggttgcactgagccgagatcgtgccgctgaactgcagcctgggcaacacagcgagactctgtctcaaaaaaaaaaaaaaaaagttaactataggaggtgattccatgatttttttgtcacctatgcatttcggcatctttcagttgtttaaggcagttctctacagaagagcccatttgccgttgtgcttcctgagtgcagaaggcaccctcctgtcttcctcctctgatacctgctttcttctgtcatgcattgtctcacgggtaccacggtagagtacatttgctcccttttgacgtcgtgatgccctttgaacagccccctttttgtatatgtaaaatgattggatacaagtgtgaggaagaaagtatgatgccctttgaacagccccctttttgtatatgtaaaatgattggatacaagtgtgaggaagaaagttctggaaaaaggttgcttggattgcttcacttctactgaccagccatcaaaccatttggacttctttgtccctggaatgatatctcttcctttacatatcatttgaaatggagaacagtatgatgatttaatttggggcttaagggtggggtgaattgctggtgaaagagaatctttgtatttgattttctagaaagacagatctttttttaacttcataataataggaacatttattatttttctttttacagtcaaatttttagaagttatcaaaccattctgtgcagttctaccagaaattcagaaaccggaaaggaaagtaagtataatattttagtaatatagagggtagctcaagggcttgttctatgaaaccagcaaaattcatttccttacctcagtccttctctgttggtaattggaaaactattggtgttcatcctccttgcaagaggcacaaagtgaataaaaataatataaatctgtttaaatctagataggttaactcatgctttcaaaaatgactgttctttaagttgtgacatttccaaattaagtgtttcttcggcctatgtgttagttaagacaggttattctcctgtctgtagtgatcctttataaatcctgtagtattgggtgtgtattgtgtttgctaatgatgtcacctactggactagaaataacccagtctgctcgataggttttgatgagtacagctgttttatgtaaatgaattgcatttgcacaaatatatacctcccatttcttgattcattcgttggaaagaaaaatgacaggaatgcattcagaagatattgtgactgggtcaaatcgttcttccatcattgcaaactttcagagttcaggtatttaaattctggaaatattgttaatcctagattggccaatttctagaaattcttcatcaaactacaaatttctcatcaaactaacaggaatagggacatagagataggtaaaagaattttaaacttactatttgatttagaagtatttatttatttatttatttttgagacggagtctcgctctgtcccccaggctggagtgcagtggcgccatcaaggctcactgcaagctccgcctcccgggttcacgccattctcctgcctcagcctcccgagtagctgggactacaggcgcccaccaccatgcccggctaatttttttgtatttttagtagagacggggtttcaccgtgttagccaggatggtctcgatctcctgaccttgtgatctgcccgcctcagcctcccaaagtgctgggattacaggcgtgagccaccgcgcccggctagaagtattttattgctttgagattgtaaaaatagttgttccattaacatttaaggcatcctgagaaaccctggctttgcagtctataaaatattcatatggcactgtcaccagcaggcccaccttcgcacagtgcagtgttcaccgaatcgcgtgcacattggatccctgttttgctttggctccttttcagtttcatttaacaccgtacaatgcagatgagaactgcctgtatttaagttaccttttttatgaaaagtaaagaaacttatatttaggaagttcagctgtttgttgtagctgctactgaggtgaaagggacattagaaaacaatctaggcccggcacagtgactcacacctgtaatcccagcactttgggaggctgaggcaggtgctcaagagatggggaccatccttgccaacatggtgaagccccgactctactaaaaatacaaaaaaattagctgggcgtggtggcgtgcgcctgtagtcccagcttctcgggaggctgaggcaggagaatcgcttgaacctggggtggtagaggttgcagtgagccgagactgcgccactgcgctgcagcctgggcaacagggtgagactctgtctcaaaaaaaaaaaaaagaaaaaaagtctacctaggatagtacttcaaaaaggggcatttaagagtgaataataggatgtcacgatggggaactttagttacgtttttgtgtggatttgtgctttaaatttgctgtttcgaaaaccaaacaccacatgttctcactcgtaaatgggagctgaatagtgagaacacgtggatacagggagggggaacatcacacaggggcctgtgggggtagggggaaaggggagggagagcattaggacaaatactaatgcatgcggggcttaaaacctagacgacaagttgataggtgcagcaaaccaccatggcatatgtctgcctatgtaacaaaccggcacgttcagcacatgtatcctagaacttaaagtaaaatttaaaacaataataataaaataaaaatatttaaggtaaaaattttgaagtaaaagagaaactgaaaaatctagatttgaaaattctttcctcagtaaaagtagatttaaaaaaatataagcttaattttttagaacatatttctctttttaaatttgtataaatataagtagcacaaatgcagttttgttacatgaatgtattatgtagtggtgaagtctgggctttgagtgtatccatcacccagataacgttcattgtacccattaagtaatttctcatcatccatcttttcctgccacccctgtacccttcggagactccacttctgtcattccatattctatgtccatgtgtacacattgtttagctcctacttttaagtgagagcccacagtgtttgactttccacttctgagttgtttcacttaagataacctcctccagttcgttccatccaggttgctgcaagggacatggtttcattcttttcatggctcagaagtatttcattatttatatacagcatatcttctttatccagtcatcaagaagcatctgtgcatgtgtgtctgtatatatgtgtgcgtgtgtgtatatgtatgagagagaaaaaaatgtttgtaaaactttgtacctaataaacaaaaatgcttcctttataacacataacggacattcccaatttctgtgaattaggccccaaagaataacctcaaaactctgctgccccccaaaaatttgctgtttcttggttttgattgatgattctttacattttgttgtacagatccagtttagagagaaggttctgtggactgctataacgctcttcattttcttagtgtgttgtcaggtatgtaactatactattaaataaatgtctgcaccattgttctaaggttttgattggttagaatttgagaattttttttgttaaaataaagaatacattgagctcaatatattgagcattattatcctttttattttttattattaatttttttttgagatggagtctcactctgttgcccaagctggatgcaggggcatgatctcggctcaccgcaacctctgcctcctgggttcaagtgattcttcttccttggcctcccaagtagctgggactacaggttcctactaccatgcccagctaaagtctcgctctgttgcccaagctggatgcaggggcatgatctcagctcactgcaacctctgcctcctgggttcaagtgactcttcttccttgggctcccaagtagctgtgggactacgggtgcctaccaccatgcccagctaatttttgtatttttgttttattttattttttgagatggagtttcacattgttgcccaggctggagtgcagtggtatgatctcgactcactgcaacctctgcctccccagttcaagtgattctcctgcctcagcctcccgagtagctgggattacaggtgcatgccaccaagctcagctaatttttgtatttttagtagagatggggtttcactatattgaccaggctagtctcgaactcctgacctcaagctatccaccttcttcagcctcccaaagtgttggtattataggcgtgagccaccacgcccagctgaatttttgtatttttagtagagatggggttttgctgtgttgttcaggcttatctcgaactcctgacctcaggtgatctacctgcctcagcctcccaaattgctgggattacaggcgtgagccaccacacccttttttatctggcaattttttgtttttaaatagagacggggtctatgttgcccaggctggtctccagctcctaggctcaggtgatgctcctgcctcagcctccctagtaggtaggactgcaggtgtgccccaccatgtctggctaatttttcaattcttttgcagggaaagggtcaagctaaaaccaaatttttgcaatcttgggttgtactgtgtttaaaaattactaaaatttgatgatagtgtttttttggtttttgttttttggtttttttttgagacagggtctcactctgtcacccaggctgcagtgatcacttcagccttgacttccccaagcccgggtgatcttcccacctcagccttctgactagctgggactacaggcacgagccactacacccagttaatttcttttggtattgtagagatgaggttttgccatgttgcccaggctggtctcgaattcctgggctcaagccatccatctacctgtatctcccacagggctgggattacatgcctgagccaccacacccagcccaatgatactttcaaataaaatgttgcagacatattaagttcacagtgtgagtataaaatgtggcctgcctatgttttagggttattgtaaagattaaataagataatttaggtcaaggtggctgggcatggtggctcatgcctgtaatcccagcactttggcaggccaaagtgggaggattacttgacgtcaggagttgagaccagtctggtcaacatggtgaaactccgtctctactaaaaatacaaaaattagccaggcatggtggcgtgcacatgtaatcccagctactcgggaggctgaggcaggagaaccacttgaacccaggtggtggaggttgcagtgagctgagatcacgccattgcactcaaacctgggcaacagagcgagatgctgtctcaaaataaataaatacatagatacatacatacatacataccagataatttaggtcaaggttttttggggagttcgaaaatctattgaaatacttgtaagaacttttaaaaaattatattaggaagcagtagaacagattaggtacataatctggagaaaacctaactatattttctttctgaaggatgaaatgatctgataattaaagtacttttactactgtacttgttttaaatttgttttaaatggtcagggagagaagtttaaagaaacaaagaaaaatacaaagaaaaaaaagaatagtcatccatatttctaccattgactttcagcatcttagaaactcctctccccaccattaaaaaaaaagtcaaccttgtggaggtataatatatatacagtaaagtacacctgtttttaggcatacattttgaagagttttgacaaatttgtacacccacatgactacaacctctgtggatatagaacacttctgtcatccccgaagttcactgtaacctttctcagtgaatctccacaggcccaggctaccactcatctgcatcctgtgactgtactttgatttgttttttctagagcttcatgtaaatggaatcatacagtagtatattctttagtgtctaacttcataatctttttgagattaattcatatggtcgttacgtcagtaactcattcctttttatttctgaatactgttctgatgttgaagttatcacagtttattcattcattcgcttgttagacatttgggttgtatccagattttggctacaacacatcaatttgctatgaacattcatgtataagtctttctgtggatatttttcatgggtgagtccttagaagtacagctgttgggttttatagtaaatgtatgctcaacttataagaaattgtcagctcttttccaagtggttgccccattttgtttgtttgtttgtttgtttgtttgagacgtagtctcgctctgttgcccaggctggagtgcagtggcacgatttcggctcaccgcaagctccgcctcccgggttcaagcgattctcctatctcagcctcctgagtagctgggatttcaggcacgtgctaccatgcccagccaatttttgtatttttcgtagagctggggttttaccatgttggacaggctgttcttgaactcctgacctcaggtgatctgcctgcctcagcctcccaaagtgctgggattacaggcgtgagccaccacgcccggccctcggttgccccattttgtatttccaccagccgtgttctggagttccagttgatctgcatcctggtctacttttagtatttttgattattttaatagtagtcatcttgccaggcgcagtggctcacgcctgtaatcccagcactttgggaggctgaggcgggtgaatcacctgaggttgggagtttgagaccagcctgaccaacatggagaaaccccgtctctactaaaagtacaaaattgagctgggcgcggtagctcacacctataatcccagcactttgggaggccaacgcaggcggatcacgaggtcaggagatcgagaccatcctggctaacacagtgaaaccccatctctactaaaaatagaaaaaattaggcgggcgtggtggcgggcgcctgtagtcccagctgctcgggaggctgaggcaggagaatggcatgaacccaggatgcagagcttgcagtgagctgagatcgagccactgcactccagtctgggcgacagagcgagactccgtctcaaaaaataataaataaaaataaataaaaatacaaaattggctgggcgtggtggcaaatacctgtagtcccagctacttgggaggctgaggcaggagaatggcgtgaacccgggaggcggagcttgcagtgagccgagatcccgccactgcactccagcctgggcgacagagcgagactccatctcaaaaaaaaaaaaaaaaaagaattcatgaacctgacagcactcaacatgggtagaggggccgagagctgctccaggggtgtgggcagtgagcttttgtagcagaagtaaagaattgcagaagtaaagaaattacttgattggctacagctaggcgtttgcctcatttgattatgttccagtgagaggtttctgtgtagccaataggctggttgactgtctgtaattggctgaaactcattcagaattaaatatcctctaaggtcattttcagttttcttttgtgagacttcagggtacagaaacaaccacaggctaatggccacctgcttagagtgccttaacaagttgaaactgattattatattaaatatagtgcaaagtttggaactctgcaactgtgacagattcatagaaaataagctcctattgttgcccacctgttgttgtacatgatcctctagctatggaatttactaagtgaaataaaattagaaaccaattttaataatcctactggttgcaggaaaggagggtataccattaattatgggaggttggcttgctgtttcccacagagcgcctaaccatggcggattaaggaaggtcgttgggcggagtggccgctctccacttgtggaatattttgagatggagtctcactctgtcacccaggctggagtgcagtggcatgatctcagctcactgcaacctccgcctcccggattcaagcgattctcctccctcagcccccggagtagctgggactacaggcacgtgccaccacgcccagctaatttttttgtgtgtatttttagtagagatggggtttcactgtgttaatcaggatgatctcgatttcctgacctcatgatccacccatctcgacctcccaaagtgctgggattacaggtgtgagccaccactcccagctgtttttgttttgttttttgagatggagtcttgttttgtcgcccaggctggagttcagtggcacgatgtctgctcactgcaacctctgcctcccaggttcaagcgattctcctacctccgcctcctgagtagctgggattacaggcacgagccgccactccctgctaatttttgtatttttagtagagatggggtttcaccatgtcggccaggctggtcttgaactcctagcctcaagtgatgtgcccacgttggactcccaagatactggtgttacaggcctgagccatcgtgcctggccctcacctctcactttaaatgaagagtgtctacagctgccaggtgcacataaaatatccatgtttcatgctttaccagttttattacccagctgataaattcagactttcagggaggtttaggttgaccaggtgagttgtttaaaattgctgccagcatcttttgtaactttcttaaaaatcagtttcatatagagaaggtttttgaaatgtctttgtctaatccccacatggttaaggaggggttaaggccaagtgctgtatcctaaatatgggttatataataggaagcaatctgaacttaagttgttttttgttgttgttttaatgaaaagttaatgtcctcattatggaaaatttgatacatatgaaaagaatacagaagaaaaagtcaaccataatcccaccatctacagataattgctgtttaggatttaaaaagatatctcctcctagtttgattttctgtgcatctatttacagtgtcatagtttatatatacactttcgtacttcgtttttatactagggcttcttaacagtcgcactcctgaatttgaggtaggatgattccttgccccaggggtctgtcctgtgtatttcaggatgttcagcagcactctggcctctactagccatcaccccctgttctgtgaaagggccatatatgcaaaatgacccgcaaacactgaaggagctgcgaaaccaatgaatgagggagacaaatccagtttgtcagtagagggtgattttacagacagaagcatagtttggggcagcagtaagacagggaaaggcctgcattcttactcccagacccagggctaatctatcatagggaaggggtgtatgtgctttgtgcaggacagttgaaggcagctttccagaacatgcaagaatgctgtgtgtcacagcctgttatttgtgtaatagcatcaacgttgcttggatctcagggcaggatttatggcgagtacatgttcttacactaaggactgtaaataaagcaggaatcaggaggtatccctgagaccagggttgagcagaagtcaacatggtagattagcatccaagatggagtcactttggtctccaccttggcccctagttgtggcaaccaaaaatgtctctagatattgccaaatgtcttgggtgggggctaaaatcacccctagtttagaactgctattttatatttagttttatgacataagtacttcttccatgttattacagattgagtaagcataatttttagtggccatgtaatattccattgtggatatcatcttcagtcttacattgagaagagtgaccttggctgtctttagtatatagagctttgcaaaatcattctacgaccaggcaggtataatattccataatctactggtgggagtgttttttaaattgtggtaaaagtatagaaaatatgccatcttcatcatttttagatgtgcagtttagtaacattaggaatgttcacattgttgtaccaccacactccataagcgatgtatttactagtgaatgcaccaagtgatgatttgttgtttttatttttattttcactttctggttcttttaattattttttttattaacccttatctatgtgatggaatgtttttctttttattttctttttaataaacagctttaccttgaagatatgcttgtttttgttgaagaacataagaatagtttttaaaaaagtattgcaagcagtaagtgaataccttgtaaattaagtgcacactttatactttttttttttgagacagagtctcctgtcacccaggctggagtgcagtggcgtgatctcagctcactgcagcctttgcctcctgggttcaagcgattcttatgcctcagccttatataatacagtttcataaactattttgtgtactattttagatcccactgtttggaatcatgtcatcagattctgcagatcctttctactggatgagagttattctggcttccaatagaggtatgcgtgtcttttctgtctccacactcctactcacagcaaacagatggaaacatgtggattagcaatgagttttcaatgtctacagggagggggaggatatcattgcctagaaaagcctagtatgtagataatgacaacaccgtgtgattaatgtaatcatagagaaatctgttcttgggttttcatggactggaaaaccctgatcttcagtgtcaaagaaggtgatgtccagataacattggaattggagtccaggtggggcgccgtggctcacccctgtaatcccagcactttgggaggccaaggtgggcagatcacctgaggtcaggagtttgagaccagcctggccaacatggtgaaaccccgtctctactaaaaatagaaaaattagccaggtgtgggtatgcacctgtaatcccagctactcaggaggctgaggtaagagaatcgcttgaacctgggagatggaggttgcagtgaactaagatcgcaccactgcaatccagcctgggtaacagagtaagactctgcctccaaaaaaaaagggagtccagtgtgtgagccaatcggggagctcagctggagctgagcctgaagcctcaagcagcattgttcatctgggaaattgtggctgaggatgctggacagtgagagtagcaaggggtacaaccagtcgtgaggtttcttacatttaggaacagtggttgcctcttttttggaaacacttttttcaggcgatcctcccacttcagcctcctgagtagctgggactactggtgcgtgccacaatgcctggctaatttttgtagttttgtagaggtgaggttttgccatgttgcctaggctggtcttgaactcctgggttcatgccatcctccctcaaagtgctgggattacaggtgtgagccactgcacccagcctggacatactttaaatcgatggcagatttttttttgatgtttttaggttataaaggtaatattgatttattattttaaaaatgcactagcaatttatatacagatttatatgaagctgaaaagaaaagtgtcacttctgaggggagctctggaggatttggtagattggtgactatcaattgaggccttttctttgcacatacattcacttacatatatctatatacttcttataactgaaaagtaagatgtcctgtatatactattctgctactttgtttacttaatatcttacatgagctattaatggccatgttattattccattataaggatacgctgtgatttatttgatcattcattcaacaaatacttactgagttcatattgtgtgtcagcctttgtgcaaggtgccgagattagagcagtgaacaagacaatgtcccagttgtcatggagttgatatttgctgtttggggaggtacctggggtggggaaggtgctctaggaaggtgatctttgaagacagctgcaggaagtgagagaggaggccacatgaagacctgagggaggcatattctagggaagagccagtgcaaaggccctgaggtgagcctgtgcttggtgtgttcaaagatcattgaggaggggccaggcgcaggggctcatgcctgtgatcccaacactttgggaggctgaagcgggaagatcacttgaggtcaggagtccagaccagcctaggcaacaaagtgagaccccatctctactaaaatcacaaaaattagccaggtgtggtcgtgtgtactgtggtcccagctacttgggaggctgaggtgggaggatggcttgagcctgggaggaagagattgcagtgagccgagatcacgccactgcactctagccggggcgacacaaccagaccctgtctcaaaaaaaaaaggaacattgaggaggtgagtgtggggtggaagaaatgaaagaagagggaggagtgatgggacctgatgttgcagatgtatctaagtcagatcatgaagggcttggagaccgttggatggagcacattttaaggaagatgggaaacttctgcaggccactaggttcctttcttgtcatatattacgtttttttccccccgattttatatcattataaagaatgctacaatgaaggctatcacaccgttctgtaactttttgatagaatgaatttctagaagttcaactgttgggtcacaagataggcatactgaaatttttgatagagaaagctaaattatcttccaaaacagttgtttgattttacactctcagcgacagtatatgagaatgaccatttctctttcaacagtggatattattagtattttagtctttgttagtcagagaggtaaaagctggcatcagttatttaattttgatttctttatagattggtgagtttgaacattgttttctgtttttatggaacatttgtatttcttctataagtggagttttattagtgtgttagattccttttgttgtaagtaataggaaactagatgctttcgtagtccgtagatgtgatgattggatcttcacgctcgtgtgtgagatgtgcctctctccagccttgttaggatgttggaacattacccatctgacatgaaaagaaaaaagaaaaaacattgttttaaataaaggagaaaaattaaggaataggaaatcactgactagcttaaacagaaacatgatacttgctggaaggatactggttattttttggaatctacagtggagatgaacagctaagccccaggaagaaggggagcaaggccagcccttaggcctcagcagcagggattggtgaacattttccattctctgtgcgattcagctccacactcccagatttattttattttattttatttttttaaaccaaatttcgctcttgttgcccaggctggagtgcaatggtgcgatcttggctcactgcaacctccacttctcaggttcaagcgattttcctgcctcagcctcctgaatagctgggattacaggcacaagccaccatgcgccactaatttttttatttttagtagagatggggtttcaccatattggccaggctggtgaattcctgacctcaggtgatccacccaccttggcctcccaaagtgctgggattacaggtttgagtcactgtgcctggccccagattatttgtttaaaattccagatgcccagggttctcaccaggcaggatcagcttcagttagagttccagggttgcacagtacaggtttggatgctgggggcctactcctgtgctgcattttcctgagaaagcttcagcaggagcagacacatcatgtatctgctgtttcctttttaaattgtttttttccttttttttttgttttattttttttgagacggagtctcgctctgtcacccaggctggagtgcagtggcgcgatgtcagctcactgcaagctccgcctcccgggttcacaccattctcctgcctcagcctcctgagtagctgggactacaggtgcccgccaccacgccctgctaattttttgtattttttagtacaggtggggtttcaccatgttagccaggatggtcttgatctcctgaccttgtgatccgcccgcctcagcctcccaaagtgctgggattacaggtgtgagccaccgcgcccagccagtttgttcactttttaattgatttgtaagagctctttgcacatgagagataagaactttttgtcatttgtgtttaatttttttttattcttttgggacaggctcttgctctgttgcccaggctggagtgcagtggtgcaaacagctcactgcagccttgacctcttgggccaagtgatactcctgccttagcctcccatgtagctgggaccacaaccgggcaccaccatgtctgactagtattttaattttttgtagagacagcatctcactttgttgcctaggctgctctcaaactcctggcctcaagtgatctgcctgcctcagcttcctaaagtgttgggatgacaggcgtgagccaccatgtctgccttaatagttttattttaaccattatgctgccttttgccacgtggaagttttgtagttgtatctaatcatatcttccatcttttcctttgtggcttctagattttttgccatgcttagaaagactttcttgcccaagatgataagctactcacccatatttccttctagtatttttgtcatttatcctttatgtttaaattttctatacatggaggctgggcacagtggctcatgcctgtaatccctgcactttgggaggccgaggagggcagattacttgaggtcaggaatttgagacctgactggccaatgtagtgaaaccccatctctaccaaaaatacagaaattagctgggcatggtggcttacgccagtaatctcaggtactcgggaggctgaggcaggagaatcgcttgaatccaggaggtggaggttgcagtgagccaagatcgtgccattgtactccagcctgggtgacagtgagactctgtctaaaaaaaaaaaaaaaaaaatttctatacatgtagcatttgttttgatgtgaggcatgaggcatgaggtaaggaatctaggtttaatttcctaaaaatggccaatttttttgccaaggtccatttttttctctactgatttgaaatgccatatttcttatatcaaatattcattaaagcttgattaagtctatttctggactagagctatttgcaataataaattttggtgatctaacttaagaaatctatctaatatctttttttttttttttgagacagagtctcgctctgtcacccaggctgaagtaagtgcagtggcacgatctcggctcactgcaacctctgcctcccaggttcaagtgagtcttctgcctcagcttcccgagtagctgggactacaggcgcccaccaccatgcccagctaatttttgtatttttagtagagacggggtttcaccatattggccaggctggtctcaaactcctgacctcatgatcctcccacctcgtcctcccaaagtgctgggattacaggcgtgagccaccatgcccggccatttttttttttttttttttttttaagacagaatttcgctcttgttgcccaggctggagtgcaatggcgggatcttggctcaccgcaacctccacctcccgggttcaagcaattcacctgcctcagcctcccaagtagctgggattacaggcatgcaccatcatgcccggatacttttgtatttttattagaaatggggtttttccatgttggtcaggctggtctcgaactcctgaccttaggtgatctgcccgccttggcctcccaaagtgctgggattacaggtatgagccaccacacccggctttttttttttctttgagatggagtctcactctttcgccaggttggaatgcagtggtgcgatcttggttcactgcaacctccaactcctcggttcaagggattctcctgcctcagcctcccgagtagctgggactacaggcgcacgccaccacacctggccaatttttgtattttcagtagagacggccaggatggtctcaatctcctgacctcaggtgatctgttggctttggcctcccaaagtgctgggattacaggcgtgagccaccacgcctggccaataaatctatctaatgtcttaaacactaaaacatgtttttattttttactattgaggaagtatctgagacgacatcaaaaatcccccgtaaggtggactattttctcatatgaaggccaccttttcagcatttatgaaaacaggattgaagggagtgatgtgacagagtggcccaggaagtcttggcactgtagaattacttgattccataccttccttatacagttggcatatttgattttcttatttctccctataaattctttttttttggtttgtttttgagatggagtctcactctgttgcccgggctggagtgcagtggcgcaatctcggcttactgcaacctctgccttccaggtttaagcgattctcctgcctcagactcctgagtagctgggattacaggtgcccgccaccacacctggctaatttttgcatttttagtagagacggggtttctccatgttgtcccgttggtctcgaacttctgacctcaggtgatccacacacctcggcctcccaaagtgtggggactgcaggcgtgagccactgtgccaagcctatagtactttttattcagggcattgctgcaggattgtgttaataaatgagaacttttcttagcaagtagtgtttaagaaatgaaaatttgcttgttaaaattttcacgtgtgtttcagttgaggtaattagggagtgcgacacctctaaatcagtttgtatcgtgtacagcaaacattgcacacttctctccccttcctttccaggaactttaatggaattgggtatctccccaattgtaacatctggtttgattatgcagttgttagctggagccaaaatcattgaagttggagatacaccgaaagatagagctttattcaatggagcccagaaacgtgagcattaatgcaattaaagagcattctccaaatttgagagtgctcgtggtaaagatgttttctctagtcttttcttgtctttggtggtaagcgtgctctcctttccccccaactttcatcagtgtttggtatgatcattaccattgggcaagccattgtgtatgtcatgacggggatgtatggggaccctgcagaaatgggtgccggaatctgtctcctgatcatcattcaggtaagaaatcctatattttcctatgcagataacaaaacagtttgattcctttttccttttctaacagttctttaggtgattggcttattcattttcttacttttgaattatttaattctagtattttgatcactgaagtgatacgtgtaaaatttttttaaaaccttctgtcaccgtgacgtgttcaagttgtgttgacgtgaaaaattcaaatttattctaatagcttcataactgcacaatacaaagaattatggatcaattgtattttattgattcttaagatacacatttgtcacattttgatgtctctagaatcaggatgtttttgtacagtaaacagtgccttccacttgcggtctgccaggaggcagtcatggtggtgtcactgcctgtgcgtgtgtcagcctgttcaggtcatgctgaccttagttggctgagtgtgatcttcacagaatgggtgtttgagttcaatcgctgtctaaaggtgttcagaaaatctgttgtgatttgttattgaaatgaaagtttatgtatagaagggcaagctagatgataaatatctaccactaggtctaaaatacgtttttgtaagtagaaaattaaaattctttgcaataaggtattgtgccataagttaattggcagtattcttttcttagtagtacacaaaataatgatgttttacatggtaatgtcttagagtcagtgaaacactgtttatacacacataaatatattccatgggttttttaaatggatgcttaggaatggaatttttaaaggtcaacataattattagtgtcctaagtatcttttttttttttttttgagacggagtctcactctgttgcccgggctggagtgcagtggcacaatctcagctcactgcagcctctgtctcccgtgttcaagcaattctcctgcctcagcctcctgagtagctgggcttacaggtgcctgccaccacgcccagctaattttttgtatttttaatagagacgggggtttcaccatgttggccaggctggtgttgaactcctgacctcgtgattcgcccgcctcggcctcccaaagtgctgggattacaggcgtgagccactgcgcccggccctaagtatcttaaaatatgttaagtttggaagctatttctctattgtacaatccttaaaaaccatttagataaattacccaagaacagatcatacttaagttatctttcttgtgttttgaaaagaagtttgctgaagttaataaacaatgggtatctggagtcctgattttcttggaaatgcctcttcttcttcactttatgaaattgggattagtttaggaaattttttctttttcttttcttttttttttttttgagacacagtcttgctgtgtcgccaggctgaagtgcagtggcacgatctcggctcactgcaacctccccttcctggtttcaagcgattttcctgcctcagcttcctgagtagctgggactacaggcgcgcgccaccatgcctacctaatttttgtatttttagtagagacagggtttcaccatgttggccaggatggtcttgatctcttgacctcgtgatccgcctgcctcggcctcccaaagtgctgggattacaggcgtgagccactgtgcccggccaggtatttttttctgtctgttcaaaagatcaagatcaagctgagaaaaatattttttaataatctcaaataccagtttattaatatatacatagaaggaaatctgactgtctcagactggcatggttgagcattctggtttttttgtttttgttttttatttttgagacggagtttcactcttgttgcccaggctagagtacaatggtgcaatctcagctcggcacaatcttggctcaacacaacctctgcctcctgggttcaagcgattctcctgcctcagcctcccaaagtgctgggattacagagcattctgttttttaaattagaaatgttatgtaggaagcaaaacatgattatttaatgagtgtgacttatatccaggaaagttatgctgttcaagtatttatttagcattgttaacaataaacatgacttttctaatgagatggaactgttttgtcatttgaccagggcaggaattttttttttcgagacggagtcctgctctgtctcccagactaaagtgcagtggtgcaatcttggctcactgcaacctccgcctcccaggttcaagcaattctgcctcagcctccccggtagctggaattacagggtcctgccaccacgtccagctagttgtgtatttttagtagagatgggattttgccgtgttggccaggctggtcttgaacttctgaccttaggtgatccacccgcctcggccttccaaaatgctgggattacaggcgtgagccaccacgccccgcccagggcaggaatttttaatgaaaatcaggttatttggaagctttctgatccccagtgtgttcgcatttggtagaagatacgtttccttaaagaataactgtcagatgtggtggctcacacctgtaattccagcactttgagaggccgagatgggcagttcacttgaggtcaggagtttgagaccagtctgggcaacatggtgaaaccctgtctctactaaaaacacaaaaattggccgggtgcagtggctcacacctgtaatcccagcactttgggaggctgaggcgggcggatcacgaggtcaggagatcgagaccatcctggccaacatggtgaaacgctgtctctaccaaaaatacaaaaattagcagggcgtggtggcaggagcctgtagtcccagctatttgggaggctgaggccgaacccaggaggcggaggttgcagtgagctgagattgcaccactgcactccagcctggcgacagagcgggactccgtctcaaaaactaaaacaaaataaaacgacaaaaattagccaggcgtggcggtgtgtgcctgtaatcccagctactaaggaggctgaggcaggagaatcgcttgaactctggagtcggagtttgcagtgagccgaggtcacaccactgcactccagcctgggcgacagagtgagactctgtctcaaaaaaaaaaaaaaagattaactttgtctttgtctttatttgtccatttacaaatcacttgattggcaaatttacagcccttgggaattagggaaagaggcgcattggatggggagagatgatattctggagtctgattttagtatctttcagggcttagggtttctcttcgtatgctttaggcattgttgaggttatggacaggccaattgttgccttcagttttgtttctttacagcattttctttctgcaatccagagtttagaataatcttgatttttagaagacacttagaactggcatgtagctcgtagaacattatacatcaagaaaagctctctagtatcttacttaaggatctattcagattcctaaggaatctccactgagcgattctcagccagctagctacaggattgacttcttacagagtcagttatggattgaaattgatataaaatagagttaagctattttgctgttcattttcagtattcagaaatcagaaatacttacagtccaagaatgaaacaagtgaagtggatgtacactgattcatttacatgaattctgatacacaaatatgcgtgttatggctaattcttctaatgttaatatataaagaggggtgtcatgtttgattgtaggtgggcagtgacccattggtgtcttttcaaggcgttactaacattgaaaatatgtggatacactgaagagctatgattggatcagtgtgtttcacccagaaacataggttttgaaaactgtttgcatgccgttgtggaaggtatttctcaccttatttgtttatgtttcattcacgtggttagtgtttttcagctagtgagtttagaaatctacatagcaggtcttgactaaaaattttaaaaaactattagagaatatcagtgtgcatggcacataataaaggtaagtatgttttgacatactgaacaaaagatagtttgacaaaactaagttgtgtgtaggtgtcgtgcagggttaaaatgttaagtgccatgtttataccggctcatcatacatgtcgtccattccccgtgaacatgtagcagttagggttctggtcccatcactgtagacgctgctgtcacttcctgggttctcatcccttttcacaggcatgcatgatatttactggcttttattcccttaattatagaaaccgtttctcatttctgtataatttcttcctccctttggaaaaacccaagtttaattttcacaggacatatgtgaaccactctgtagtccgatggtcactgttctgaacagggggtgtggagaattagagttgtttcagagctgctgtgggactctggagaggtcatttctcaaggcccatcacgatgctttctgtggctgatgttcatggacggctgttgcctcctgcataggatgggtttctctatgatggggagtctctgttcactaattacatgattgtggttaaatagaatcggtagtaagtcctaacctctacattattttgtcaaaatgtcgaacttggttttcaagcagtaaaggattagcatgatctctcttagaagtttggagaatcgtaccctttctcctgcccattgaaactcagactaaaagcctgtaaatagacaagttaggctctgtccaactactgaaatggcagttaaggagaaaaacaacactgtgtaaggtaagcatgcctaaaatggtctcatgtggttactttggtcgctcttccagcaggtgatattggataaagtgagtacaaaatgagggtgggcggcttgagagctgggaggaatggaagtgacttcctcacttctgccggagggtgtctttaaagtggggacatgtgtgaggttgggggcatggaagcatattttcttcctgtcttgattaggttatttgagtgcagggaaggggtcatatgactgaggaggtcacttgaagggctagggactgtttttaattaatgcatacttttacaggaatgtcttctccaagaagcaagttcagaattttcaatatcccataaattaaagtcagtatgctttcatttttaaaaacaatatgagcttaaccttaaccgtcttcaaatttacattcaatctttgtcactatgtgtatagaatgcatttttacattgctgctcgagtacgtatttgagtacatatttgtgttctagttttttattctgtacacattttatagagtatacatatatataatatatataatgcttttttcaaaggatcaacacagcccttagacttatcctttgatggcagtgtacatttccatcttgctattataccagaattcatctgactttttacttccttggaggtatttgggatgttttcagtttcttgctgtcataaattctagaatactgtgatcattttttgtttcagtgtgcttttcaaacaggctttatttaaacattgcaaaagaaactattcagataagtgtaaatagactttaaaagttgaaatgtctgctttataatacaacagtatttccagtcctcttactgttctagattggcctgagtaaatgaaagcaggccaaaagatgcagttggtcatcacagtgagattgcaacgatcaggccttaatattcaaaacgcccctagcttggaaatagccaatggtgttcctctccccctttcttgagtttgttcttgcttccgcttacttgcatttctttccccacagttgtttgttgctggtttgattgtgctgctgttagatgagctgctacagaagggttacggcttggggtctgggatttccctctttattgccaccaacatctgtgagaccattgtctggaaggcctttagtcccactaccattaacactggcagaggtacatcgcacagcgactgcaactgcacgcgttttgctggatgtgtgctgggaacaaacccatcgtgtcgcagtacatgcctagagccgttctggtttgctctcctaggggataaggaatgcgaattcttcaaaacttaatgagcagagatttgtggagtaagcaatactacctcagagagaatagtatcaaaattttagcctctgcttatttaaaatttcagtggttgcaaacagattttcaaaatttcttttgttaaccttgcttaaggcattgctgcagaagtcatttatttgactgatttcagcatccgtagggggataaaaaggtagtggattttagatttttcaaatgaaaagactgttgttcattgaatccacctggagcactcctactctgctgctcttctaattggctttgtaatagcaccaaagttttgaaatatttcattctctctttccccttcctcatctccacttctaacagatactgtcctaagtggttaatacctaaactctgatcccagccttaagaaaactgtaatgatgattaatgttcttggtgcggtaaacttcgaggcaggctcgatagagtgacatctgtctcttattctgacatctctgctctgcttcgctgctgtttatttttcctaaaaacactctctcccttccctgaagtagaggagaggcaaatctctatgaatgaaattttgctttggtaaattttacgttgtatgttttcttcaagaatagtctcttgagaaaacttcggatttatgctataaaaacatagatttgcctcaatgatctaaatatttgtagaacctgctcacatggctatatcataaagcaaacattggcgaattcttttgacccatattttctgctgtatactggactttcacggttagttgtttgagctttgggacagctttggacgatgagtccacaggtcgtgtctgtcttgattttacaggtactgagtttgagggtgcagtcatagctctgttccatttgttggccaccaggacggacaaagtccgagctttacgggaggctttttatcggcagaacttacccaatctcatgaacctcattgctacagtttttgtgtttgctgttgttatatatttccaagtaagtataaccttttcaccaaagtaagtgggatgtagatttttattttgctcttaaagagaatgccatctgacatgctgttgtttaacaagtcagggtttaagatcaagggaaataaaattttgcaattagagtctccagactctgattttaaggtgtgaaatattggagtctctgtactttttttgttttttgttttgacccatcagcaggaagcagactctcgacagtttaaaaggcagaacgtctttgttagcattgtcttttcttttctttttttttcctgagacggagttttgctcttgttgcccaggctggagtgcagtggcgcgatcttagctcactctaacctcctcttcccgagttcaagtgattctcctgcctcagcttcctgagtagctgagatgacaggcacgtgccaccacgcccggctaatttttttttttttttttttgagatggagtcttgctctgtcgccaggctggagtgcaatggcgcaatcccggctaactgcaacctccgcctcctgggttcaagcgattctcctgtctcagcctcctgagtagctgggactacaggtgcatatcaccacacccagctaattttttgtattttagtagagatgagatttcaccacgttggccaggatggtctcgatctcctgacctcgtgatctgcccgcctcggcctcccaaagtgttgggattacaggcctgagcccctgtgcccggccggcattgtcttttcatcccccgcactgttctttgttttccctctctggtctctgttcttttcttaatgtgtctggctcccccacttactctccgtttccttttttagggatttcgcgttgatctgcccattaagtcggcccgttaccgaggacagtacagcagctaccccatcaaactcttctacacctccaacatccccatcatcctccagtcggccctggtgtccaacctgtatgttatttcccagatgctgtctgttcgatttagtggcaactttttagtaaatttactaggacagtgggccgtgagtattatgtttatttacattatttatagtttattataatttgcatttcatggttgtatttttaatggaatgaggtcgacattggagcatttgctgtattttcagattcacttacctatatagcagagtttagtacttatctggaagaactggtaagtgttgcagaagtaagattgcccaagcgctttttattattttgctctctaggaagcactttcacatctcatttgaatgaccttttaagctaaaattgtggttgatttcataaaagtaatttcctattttgtcatcttattccagtattgtctacaataatgctttctaaaagatgctatttgctggctgggtgcggtggctcactcctgtaatcccaggactttgggaggctgaggtgggtggatcacctgaggtcaggagttcgagaccagcctggccacatggtgaaaccccgtctccactaaaaatacaaaaattagccaggtgtggtggcaggtgcttgtagtcccaaccattcaggaggtcaagtcaggagaattgctggaacccaggagatggaggttgctgtgagctgagatcacgccactgcactccagcctgggcgacagaacgagactccgtctccaaaaaataaaaacaaaaaatgctatttgctgctgctaacatgtgagatactggactcatcctaacctttcctatctcccaccctgcctccaggcctcctccatttttcatggtctgaatggcaataagccagcttgtgatgagctgggctagagataggcatgctattaactagacggtagagacagcggtgctgctagtaatataatcctatacattctcatatacatcccccatcataatttttttttcttttttttttttttgagacggagtctcgctgtgtcgcccaggctggagtgcagtggtacgatctcggctcactgcaagctccgcctcccgggttcatgccattctcctgcctcagcctcccaagtagctgggactacaggcgcccgccaccacgcccagctaattttttgtatttttagtagagacggggtttaactgtgttagccaggatggtctcgatctcctgaccttgtgatctgcccgactcagcctcccaaattgctgggattacaggcgtgagccaccacactcggcccataattttttctaaagccatctagccacgctgttattgaagcgtgagttactgtgggactgaattttcattggtttaaattctgtcacctaacaaaggggtattttccctcttaaaattatagattttagccaggcgtgttggctctcatctgtaatcccagcactttgggagaacaaggagagaggatagcttgaaggccaggagttggagacctgtctgggcaacatagcgagaccccatctctacaaaaaaacttaaaaactagccgggcacagtgttacgtgcctgtagtcctagctacttgggaggctgagttgggaggattgcttgagcccaggagtttgaaggtacagtgagctgtgatcataccactgcatgccagcctggttgacagagtgagaccgtgtctcaaaaataatagaattttaaaagactaatgtcctttattctttgccacagtaggtaattctagaatttgcaccccaccaaagaatagtatttttctgtacagttattcttgaaatatggtgtttattctgtgcatttgtcttaatatgctttttttttgcattataagttacaaagactcatacctttctgcttttactgaatgtcatttaaaaaaaaggtttttttaagataataagacagtaactcatatattagttgaagggaataggattccctttattcataatacttctttcccattcatttaagagaaatgtgatgatctctgttgtattctggctaatattatatcgaggacaggaaagtcaagagacaggaataagaagaatgctgtttctgccctccttagaatagtccagcagcagctattactctgatcagaatgtcatagtgatagtgctttgagtagttggtcctgtacaatttgtgttatgattttgagtaagattcttctgaatgagagaatgattgggagatagtgcttttgatctgggattaatgattctaggggcacagtaaagaaatcattgggcagtcataaattcaagaaccagatactgtaatcatcgcaactaaaaattggtttctcaccccctatctgtataccccaaaactttatttaatatgagcaaataatgctgttcctatttctgtaagatttaagtatatagataaaaatccaattattatatttattaaaagattgctccttataacatagaaaccacataaagtctaggcagcaagttaaagtcttatgtcagtattttagttgattgcattaatattttcatatggaaggatcattcatagggatcttaatgtactgactggatactctcatagctcagaaaatttcagattttaagtataatcagaggttgattgtaaatgtaatcatattcctattttcagtaatggaagattttgtaatatattacaatttttaaaaatgactcaatattttcacagtgtcttgcatgtaataggtgttcatcgtataactttgaaggagtgaaggtagtagacacaaaagtacattctgaaactacatagaatgactagctgtagatgccttgaacttaaaacactgtcatttctgagaagtttgaagtgacatgcaaatgtattcctgactaattaggttgaccacttgttctttgtactcctgttctgtaggatgtcagtgggggaggacccgcacgttcttacccagttggaggcctttgttactatctttctcctcctgagtccatgggcgccatctttgaggatcctgtccatgtcgttgtttatatcatcttcatgttggggtcatgtgcattcttctctaagacatggattgaagtgtctggttcctcagccaaagatgtaagtgtttggtttattttaaaataaaactcttggcaatgcatggtggcgcacatctgtaatcgtagcactttggcaggctgaggccgctggatcgcttcacctcaggagttttgagaccagcctgggcaacatagcgagaccccgtcatgactaaaaaaatacaaataaaaatcggccgggcacggtggtgcaagcccgtggtcccagctacttgggaagttgagacggagcagtaacgcttgagtccgggaggtggaggttgcagtgagccaagattgcaccactgcactccagcctgggtgacagagcgagatcctgtctcaaaaaaataaaaaaggccaggcgcagtggttcacgcctgtaatcccagcacttcgggaggccgaggtgggcagatcccatgggtaggagatcgagaccatcctggtcagcatggtaaaaccctttctctactaaaaatacaaaaattagctgggcgtggcagcgcatgcctgtaatcccagccactcaggaggctgaggcaggagaatcgcttgaacctgggagtcggaggttgcagtgagctgagatcgtgccactgaactccagcctggcgacagagctagactccgtctccaaaataaataaataaatagataaataaaaaatttttaaaaaagtaaaataaaactttgtttttggaaaattcatatttaattgtcaaaacagtagtggatacactcctttataacttaagctttaatttatacatttttaatgagtcagtgtcaccccaacaggctaaaaattggttcccaaaaggtaaaaaattcttagatattacagtggtttgcaaccctcctgcaaaacaaaatcttgtttggtaattgaagaagggttgagaagcaccggtttcatatgggtaacatggagcggaggagcactgaagctttggtttcctcaggcttaatgcgaatgatatgacaatgcaactttcaggttattgtatgttacgtgttagtgtgtggcgagcacttcgcatagaacgtggtagatgtaagcagtgaaatgttccagttggattttgaaagtcgtttttctctcggcaggtagctaaacagctgaaagaacagcagatggtaatgaggggccaccgagatacctctatggttcatgagcttaataggtaaggctgctagactgacacctttataggcctgtgtttgtgtttcagtctttcagtgttggctaaatgtttttctttgttcaagttcatatttaaaacccttctattcacacagatgaatcaaaatttcacacaaaacttgttttccatgtcaaaaccaacacctgaatttttcattgaaattgtgagcactgctctgctcatcccagtgataaaatcttgcagatcagtgctgttctcagcattggctggctgcacatacaatcaccagagagcttttaaaaaggatttcccaggaactgtggcttatttggtctggggtgagttccaggcatcagggttttattttttggtaacagctttattgagataaaattcagataccatgtaattcactcacttgaagtatattgttcagtgttttttagtatattcagacttgtacagtcataagtttaaacacattttcaccacccagaaagaaaccctgtacctactagcccaccttcccaaccaccagccccagacagccacttttaactttgtctctacagatttgcctattctgtacatttcatataaatggaatcatataatgtatgttattttgtaagtggcttctttcacttggcatcatgttttcacagttcatatccttaattcttttcatgaataatattcaattgtagggctttaccacactttatcagttgatagaaatctgggttgtttccactttttatgaataatgctgttgtgaacatatttgtacaaattttgtgctgctcagctgtcttccaggttggctgctgtagtccacattcccaccagcagtgtatgaggttccactgctgcctgtcctcgccagcactagctctggctttttaatttcagccatcctgatggatgcgaagtggggcacaatcacagctcaccgcagcctcttgggctcaagcgatcctccccgcctcaacctccagagtagcttgggaccacaggtgtgtgccaccacggccagctagcttttttttttttttttttttttttttatctgagatggggcctcactttgtcacccaggctggagtgcagtggcaccgtcttggctcactgcaacctcgacctcctgggatcaagcgattctcctgtctcagcctccctagtagcagggattacaggcacgcaccaccatgcccggctaatttttgtatttttagtagagatgggtttccccatgttggccaggctcgtcttgaacttctgatctaatcatccacccgccttggcctcccaaagtgttgggattacaggcatgagccaccatgcctggtgggatccagattccttcttttgcttgggggcatcctgttgtcccagcatcatttgttgaaaaggcactagtatttttccttaaactttttatttatttagaacacagactgcagagtagtatgatggatctccagctccagttgtcaccatcttgctgttcttgtttcacctatcactgcctctaatcttttttgagtattttaaatcccatttttcagttttccaggtgattctaatgtgcagccaaaggttgaattactgaaatggatcctcaaaatcttatgacataaatttgttcatacctactcttcattccacaagagggaacgaaaggttactcatttaaaaatcttaaacattttaatatttaaatctgtccaggaatctcatgtcctgtaagattacatattgtctttcttggctgttgactggttcctggaaattagggtcagagtctttgcctggatcagagctcctgttcccatgccgtgccctgcacacccctccacactgcagcctgttccctctggagttcagggaggctttagacccagctatggctgctgcgcctcgacctgtcttcgtctctagctgccgtgctgttcctggtctctgctgccgcctaacttggggttctgtctcctaggtacatccccaccgcagctgcgtttggcggtttgtgcattggcgccctgtcagtgctggctgacttcctgggggccattggatctggcactggaattctgctagcagtcactattatttaccagtattttgaaatatttgttaaagaacaggccgaagttggtgggatgggtgctttgtttttctaaatgttcaaatatttcattttgtgcgtgtgaaagggaaaacactttgacggatcgtttttgtcagatgacactggtggctccccttttctcccctcacagtttcttgtttcgagtgctgactgacccgtttctgaaatgggcaccgagctaagtctgtgtgcagcattagtacccgctgccttaaaactcaagtttacattattcattaaaaaaagtacatctagtgttgcctgtaatgctggaaaccagtgtatctaccttgctgtgttaaatcatgacagtgagacggtgagatggattcgttttgcacacaacattcaaaacacttcatattgcccccacttgttgaaaaataaatgtagttcaaattgccactttccagtatttttgagcttatttaatgagttctggaacatttatatctaatctatattttagataattactttttatacttttttaactcatggtatccccactccccacccccacctcatttttatttgtcccttctcaaagcagccacttagcccacatgggcgaaatcaagtctccagttatttctgccacaactgcttctaaggcctcctccttctcctcctcctcttcctcttcctccttttccttctcctcctcctctcttcccagtgacagcatcatcgtgctgtttgcctgtattggctatgccttctaactccaaccagtcacttgagaatattctttcaagattctgggccccgattcttttctgtttaaatccctaaagcaaagatctaattctcaagcaatgtctgtagttcagtgggggtgaacaatgaatatattcatgctaggaatttgtgtctgttgttgtactcacagcagcaacatgagtgtaaacagtagacaataaacttttatttaagaaaactgattcagttgtgttggaaaaaataaagaaatctgatatt

SEQ ID NO: 750 - DNA, 35764 bp, Homo sapiens; identical to SEQ ID NO: 749

SEQ ID NO: 751 - DNA, 40318 bp, Homo sapiens
aagggcggagtctgcgcggggttgggcggagcctgcgcggggccggtaggatcgcgtcgggagccggtaccgaggcccgagccgcgggagtcgagcgaaggcagcgccgaggccgcggtttccccctgggcctccccagcagcagccatgggcagtgagtagcggcggctggagcggggactctggctgggaacgcaggccccgcctgggctgcgggcggtggggctggcgctcgctcggagtcgtgggggccagggatgcgcgggccgctccgggcctcagcggagggcacgggccgggggcctccgccgaggctcccctagccgtgcgaggccttgcccggcgggtaccgggacccggaggcccggggtttgcgtttgatagagggcgaggatggcgctgggaggccattggttttgggggcggggagttagggcaccgggtgaacctggaccactttttaatttttcaggagttaaagaaatcccgtgtttttattccctcgtcatctttccttggcatgttgcattgaagaaagctcccctaactcgtttaattttaaaaaaagtgatgcatggcgtgtgttttagggaggaaaggagtgtgcattggtaacagcgttttccttaaactgttcattctgtagcgtttactgaaaactgtaaggttttataagccttagggacaaggccttatgttataggaatgtttttcagggccctccccgtaacactcaaccccacatatgtgcacgtagctacttgcatagctgtgaagatgttcgttggatgatgggtcgtgcatacccaagcagggcacccattggccaactagtggacatttgggggaaattagaaaggagtaggagagacccgtggtaaaattttgcatcacaaggatagacagggggcagccaaaagctttgcttgaacatgaataccccttacagatgatcataaagtgtcaagaaatctgagagtggcttggattgaggtggagaggaaaagggatggagaggttctaggaagcctcctgatgtgattgatacttgtttcgcgttagcaatgaatgctttcataattcagatttactttccagaaaatccaaaatattaggttgctgcaaaagtaattgcggttttcaattacttctcaaaaaccgcagttacttttgcaccaacctaatagtacttgggtaacaaacatctgcccatgacaattagttaatccttctgtcaaacatcagtgactggtggggcgcagaggctcacgcctgtaatcccagcactttgggaggccgaggagggcggatcacccgaggtcaggtgttcgagaccagcctggccaacatgatgaaaccccatctctactaaaaatataaaaatcagcctggtgtggtggtgggcgccagtcatcccagctccccaggaggctgaggcaggagaatcccttgaacccgggaggtggaggttgcagtgaatggagatcatgccactgcacttcagcctgggcgatagagcgaaactccgtctcgaaataaacaaacatatatcggtgactgcccatcatttgtagaggcttttttaaaaaagataatatagtcaactttaggcaactacagaaacgtaatcactcacgtcagctttaagacaattttgggatgttggtatatagaatccagtgtctgtaggggaagaaaagccgcagagcctaactaatacctagctgcggcttgtctttctccacattgcagaccctttggcaaaggacagaagcttgagagattgtcattttcaccctccagttctctggcaggacttgacttaagccgtgccagaagacagtgtctatccttaaagaaccttgatttatcttacctttatatgttataagagtagtctgggaaaacaatactttctgatgaaatgtaattgttaattctctgggttgattattttacacaagcaagtacttttctattacctgggagagtaactaggcaatgaaatgtggtctgatgaaatcaaacagagattacataccttttttttttttttttttttttttttttgagacggtctctctctgctgcccaggctggagtgcaatggctccatccgggcttactgcaagctccccctcctggggtcacgccattctcctgcctcagcctcctggggaggggggactacaggggcccgccaccacgccctgctaatttttttttttgtatttttagtagagacgggggttcaccatgttggccaggctggccttgagctcctgacctcaagtgatccgcctttctcggcctcccaaagtgctgggattacaggcgtgagccaacaagcccggcctacatactttaaaaaggtaactacaggggctgggtactgctcacgcctgtaatcccagcactttgggaggccgagacgggcggatcacgaggtcaggagttcgagactagcctgaccaacatggtgaaaccccggctctacgaaaaatataaaaattagccaggcatggtaccgtgcgcctgtaatcccagctatatacgaggctgaggcaggagaatcacttgaacccggggggcggaggttgcagtgagccgagatggcggcactgcactccagcctggaccacagagggagaatccgtctcaaaaaacaaaaacaaaccagttaactataggggccaggtgccatggttcatgcctgtaatcccagcactttggaaggctgagatgggaggatcgcttgacgttaggagtttgagacaagcttggccaccatggtgaaatcccatctctagtaaaaataaaaaaattagctgggcttggtggcactcgcctgtaatcctagctactcgggaggctgaggcaggagaatcacttgaacctgggaggtggaggttgcactgagccgagatcgtgccgctgaactgcagcctgggcaacacagcgagactctgtctcaaaaaaaaaaaaaaaaagttaactataggaggtgattccatgatttttttgtcacctatgcatttcggcatctttcagttgtttaaggcagttctctacagaagagcccatttgccgttgtgcttcctgagtgcagaaggcaccctcctgtcttcctcctctgatacctgctttcttctgtcatgcattgtctcacgggtaccacggtagagtacatttgctcccttttgacgtcgtgatgccctttgaacagccccctttttgtatatgtaaaatgattggatacaagtgtgaggaagaaagtatgatgccctttgaacagccccctttttgtatatgtaaaatgattggatacaagtgtgaggaagaaagttctggaaaaaggttgcttggattgcttcacttctactgaccagccatcaaaccatttggacttctttgtccctggaatgatatctcttcctttacatatcatttgaaatggagaacagtatgatgatttaatttggggcttaagggtggggtgaattgctggtgaaagagaatctttgtatttgattttctagaaagacagatctttttttaacttcataataataggaacatttattatttttctttttacagtcaaatttttagaagttatcaaaccattctgtgcagttctaccagaaattcagaaaccggaaaggaaagtaagtataatattttagtaatatagagggtagctcaagggcttgttctatgaaaccagcaaaattcatttccttacctcagtccttctctgttggtaattggaaaactattggtgttcatcctccttgcaagaggcacaaagtgaataaaaataatataaatctgtttaaatctagataggttaactcatgctttcaaaaatgactgttctttaagttgtgacatttccaaattaagtgtttcttcggcctatgtgttagttaagacaggttattctcctgtctgtagtgatcctttataaatcctgtagtattgggtgtgtattgtgtttgctaatgatgtcacctactggactagaaataacccagtctgctcgataggttttgatgagtacagctgttttatgtaaatgaattgcatttgcacaaatatatacctcccatttcttgattcattcgttggaaagaaaaatgacaggaatgcattcagaagatattgtgactgggtcaaatcgttcttccatcattgcaaactttcagagttcaggtatttaaattctggaaatattgttaatcctagattggccaatttctagaaattcttcatcaaactacaaatttctcatcaaactaacaggaatagggacatagagataggtaaaagaattttaaacttactatttgatttagaagtatttatttatttatttatttttgagacggagtctcgctctgtcccccaggctggagtgcagtggcgccatcaaggctcactgcaagctccgcctcccgggttcacgccattctcctgcctcagcctcccgagtagctgggactacaggcgcccaccaccatgcccggctaatttttttgtatttttagtagagacggggtttcaccgtgttagccaggatggtctcgatctcctgaccttgtgatctgcccgcctcagcctcccaaagtgctgggattacaggcgtgagccaccgcgcccggctagaagtattttattgctttgagattgtaaaaatagttgttccattaacatttaaggcatcctgagaaaccctggctttgcagtctataaaatattcatatggcactgtcaccagcaggcccaccttcgcacagtgcagtgttcaccgaatcgcgtgcacattggatccctgttttgctttggctccttttcagtttcatttaacaccgtacaatgcagatgagaactgcctgtatttaagttaccttttttatgaaaagtaaagaaacttatatttaggaagttcagctgtttgttgtagctgctactgaggtgaaagggacattagaaaacaatctaggcccggcacagtgactcacacctgtaatcccagcactttgggaggctgaggcaggtgctcaagagatggggaccatccttgccaacatggtgaagccccgactctactaaaaatacaaaaaaattagctgggcgtggtggcgtgcgcctgtagtcccagcttctcgggaggctgaggcaggagaatcgcttgaacctggggtggtagaggttgcagtgagccgagactgcgccactgcgctgcagcctgggcaacagggtgagactctgtctcaaaaaaaaaaaaaagaaaaaaagtctacctaggatagtacttcaaaaaggggcatttaagagtgaataataggatgtcacgatggggaactttagttacgtttttgtgtggatttgtgctttaaatttgctgtttcgaaaaccaaacaccacatgttctcactcgtaaatgggagctgaatagtgagaacacgtggatacagggagggggaacatcacacaggggcctgtgggggtagggggaaaggggagggagagcattaggacaaatactaatgcatgcggggcttaaaacctagacgacaagttgataggtgcagcaaaccaccatggcatatgtctgcctatgtaacaaaccggcacgttcagcacatgtatcctagaacttaaagtaaaatttaaaacaataataataaaataaaaatatttaaggtaaaaattttgaagtaaaagagaaactgaaaaatctagatttgaaaattctttcctcagtaaaagtagatttaaaaaaatataagcttaattttttagaacatatttctctttttaaatttgtataaatataagtagcacaaatgcagttttgttacatgaatgtattatgtagtggtgaagtctgggctttgagtgtatccatcacccagataacgttcattgtacccattaagtaatttctcatcatccatcttttcctgccacccctgtacccttcggagactccacttctgtcattccatattctatgtccatgtgtacacattgtttagctcctacttttaagtgagagcccacagtgtttgactttccacttctgagttgtttcacttaagataacctcctccagttcgttccatccaggttgctgcaagggacatggtttcattcttttcatggctcagaagtatttcattatttatatacagcatatcttctttatccagtcatcaagaagcatctgtgcatgtgtgtctgtatatatgtgtgcgtgtgtgtatatgtatgagagagaaaaaaatgtttgtaaaactttgtacctaataaacaaaaatgcttcctttataacacataacggacattcccaatttctgtgaattaggccccaaagaataacctcaaaactctgctgccccccaaaaatttgctgtttcttggttttgattgatgattctttacattttgttgtacagatccagtttagagagaaggttctgtggactgctataacgctcttcattttcttagtgtgttgtcaggtatgtaactatactattaaataaatgtctgcaccattgttctaaggttttgattggttagaatttgagaattttttttgttaaaataaagaatacattgagctcaatatattgagcattattatcctttttattttttattattaatttttttttgagatggagtctcactctgttgcccaagctggatgcaggggcatgatctcggctcaccgcaacctctgcctcctgggttcaagtgattcttcttccttggcctcccaagtagctgggactacaggttcctactaccatgcccagctaaagtctcgctctgttgcccaagctggatgcaggggcatgatctcagctcactgcaacctctgcctcctgggttcaagtgactcttcttccttgggctcccaagtagctgtgggactacgggtgcctaccaccatgcccagctaatttttgtatttttgttttattttattttttgagatggagtttcacattgttgcccaggctggagtgcagtggtatgatctcgactcactgcaacctctgcctccccagttcaagtgattctcctgcctcagcctcccgagtagctgggattacaggtgcatgccaccaagctcagctaatttttgtatttttagtagagatggggtttcactatattgaccaggctagtctcgaactcctgacctcaagctatccaccttcttcagcctcccaaagtgttggtattataggcgtgagccaccacgcccagctgaatttttgtatttttagtagagatggggttttgctgtgttgttcaggcttatctcgaactcctgacctcaggtgatctacctgcctcagcctcccaaattgctgggattacaggcgtgagccaccacacccttttttatctggcaattttttgtttttaaatagagacggggtctatgttgcccaggctggtctccagctcctaggctcaggtgatgctcctgcctcagcctccctagtaggtaggactgcaggtgtgccccaccatgtctggctaatttttcaattcttttgcagggaaagggtcaagctaaaaccaaatttttgcaatcttgggttgtactgtgtttaaaaattactaaaatttgatgatagtgtttttttggtttttgttttttggtttttttttgagacagggtctcactctgtcacccaggctgcagtgatcacttcagccttgacttccccaagcccgggtgatcttcccacctcagccttctgactagctgggactacaggcacgagccactacacccagttaatttcttttggtattgtagagatgaggttttgccatgttgcccaggctggtctcgaattcctgggctcaagccatccatctacctgtatctcccacagggctgggattacatgcctgagccaccacacccagcccaatgatactttcaaataaaatgttgcagacatattaagttcacagtgtgagtataaaatgtggcctgcctatgttttagggttattgtaaagattaaataagataatttaggtcaaggtggctgggcatggtggctcatgcctgtaatcccagcactttggcaggccaaagtgggaggattacttgacgtcaggagttgagaccagtctggtcaacatggtgaaactccgtctctactaaaaatacaaaaattagccaggcatggtggcgtgcacatgtaatcccagctactcgggaggctgaggcaggagaaccacttgaacccaggtggtggaggttgcagtgagctgagatcacgccattgcactcaaacctgggcaacagagcgagatgctgtctcaaaataaataaatacatagatacatacatacatacataccagataatttaggtcaaggttttttggggagttcgaaaatctattgaaatacttgtaagaacttttaaaaaattatattaggaagcagtagaacagattaggtacataatctggagaaaacctaactatattttctttctgaaggatgaaatgatctgataattaaagtacttttactactgtacttgttttaaatttgttttaaatggtcagggagagaagtttaaagaaacaaagaaaaatacaaagaaaaaaaagaatagtcatccatatttctaccattgactttcagcatcttagaaactcctctccccaccattaaaaaaaaagtcaaccttgtggaggtataatatatatacagtaaagtacacctgtttttaggcatacattttgaagagttttgacaaatttgtacacccacatgactacaacctctgtggatatagaacacttctgtcatccccgaagttcactgtaacctttctcagtgaatctccacaggcccaggctaccactcatctgcatcctgtgactgtactttgatttgttttttctagagcttcatgtaaatggaatcatacagtagtatattctttagtgtctaacttcataatctttttgagattaattcatatggtcgttacgtcagtaactcattcctttttatttctgaatactgttctgatgttgaagttatcacagtttattcattcattcgcttgttagacatttgggttgtatccagattttggctacaacacatcaatttgctatgaacattcatgtataagtctttctgtggatatttttcatgggtgagtccttagaagtacagctgttgggttttatagtaaatgtatgctcaacttataagaaattgtcagctcttttccaagtggttgccccattttgtttgtttgtttgtttgtttgtttgagacgtagtctcgctctgttgcccaggctggagtgcagtggcacgatttcggctcaccgcaagctccgcctcccgggttcaagcgattctcctatctcagcctcctgagtagctgggatttcaggcacgtgctaccatgcccagccaatttttgtatttttcgtagagctggggttttaccatgttggacaggctgttcttgaactcctgacctcaggtgatctgcctgcctcagcctcccaaagtgctgggattacaggcgtgagccaccacgcccggccctcggttgccccattttgtatttccaccagccgtgttctggagttccagttgatctgcatcctggtctacttttagtatttttgattattttaatagtagtcatcttgccaggcgcagtggctcacgcctgtaatcccagcactttgggaggctgaggcgggtgaatcacctgaggttgggagtttgagaccagcctgaccaacatggagaaaccccgtctctactaaaagtacaaaattgagctgggcgcggtagctcacacctataatcccagcactttgggaggccaacgcaggcggatcacgaggtcaggagatcgagaccatcctggctaacacagtgaaaccccatctctactaaaaatagaaaaaattaggcgggcgtggtggcgggcgcctgtagtcccagctgctcgggaggctgaggcaggagaatggcatgaacccaggatgcagagcttgcagtgagctgagatcgagccactgcactccagtctgggcgacagagcgagactccgtctcaaaaaataataaataaaaataaataaaaatacaaaattggctgggcgtggtggcaaatacctgtagtcccagctacttgggaggctgaggcaggagaatggcgtgaacccgggaggcggagcttgcagtgagccgagatcccgccactgcactccagcctgggcgacagagcgagactccatctcaaaaaaaaaaaaaaaaaagaattcatgaacctgacagcactcaacatgggtagaggggccgagagctgctccaggggtgtgggcagtgagcttttgtagcagaagtaaagaattgcagaagtaaagaaattacttgattggctacagctaggcgtttgcctcatttgattatgttccagtgagaggtttctgtgtagccaataggctggttgactgtctgtaattggctgaaactcattcagaattaaatatcctctaaggtcattttcagttttcttttgtgagacttcagggtacagaaacaaccacaggctaatggccacctgcttagagtgccttaacaagttgaaactgattattatattaaatatagtgcaaagtttggaactctgcaactgtgacagattcatagaaaataagctcctattgttgcccacctgttgttgtacatgatcctctagctatggaatttactaagtgaaataaaattagaaaccaattttaataatcctactggttgcaggaaaggagggtataccattaattatgggaggttggcttgctgtttcccacagagcgcctaaccatggcggattaaggaaggtcgttgggcggagtggccgctctccacttgtggaatattttgagatggagtctcactctgtcacccaggctggagtgcagtggcatgatctcagctcactgcaacctccgcctcccggattcaagcgattctcctccctcagcccccggagtagctgggactacaggcacgtgccaccacgcccagctaatttttttgtgtgtatttttagtagagatggggtttcactgtgttaatcaggatgatctcgatttcctgacctcatgatccacccatctcgacctcccaaagtgctgggattacaggtgtgagccaccactcccagctgtttttgttttgttttttgagatggagtcttgttttgtcgcccaggctggagttcagtggcacgatgtctgctcactgcaacctctgcctcccaggttcaagcgattctcctacctccgcctcctgagtagctgggattacaggcacgagccgccactccctgctaatttttgtatttttagtagagatggggtttcaccatgtcggccaggctggtcttgaactcctagcctcaagtgatgtgcccacgttggactcccaagatactggtgttacaggcctgagccatcgtgcctggccctcacctctcactttaaatgaagagtgtctacagctgccaggtgcacataaaatatccatgtttcatgctttaccagttttattacccagctgataaattcagactttcagggaggtttaggttgaccaggtgagttgtttaaaattgctgccagcatcttttgtaactttcttaaaaatcagtttcatatagagaaggtttttgaaatgtctttgtctaatccccacatggttaaggaggggttaaggccaagtgctgtatcctaaatatgggttatataataggaagcaatctgaacttaagttgttttttgttgttgttttaatgaaaagttaatgtcctcattatggaaaatttgatacatatgaaaagaatacagaagaaaaagtcaaccataatcccaccatctacagataattgctgtttaggatttaaaaagatatctcctcctagtttgattttctgtgcatctatttacagtgtcatagtttatatatacactttcgtacttcgtttttatactagggcttcttaacagtcgcactcctgaatttgaggtaggatgattccttgccccaggggtctgtcctgtgtatttcaggatgttcagcagcactctggcctctactagccatcaccccctgttctgtgaaagggccatatatgcaaaatgacccgcaaacactgaaggagctgcgaaaccaatgaatgagggagacaaatccagtttgtcagtagagggtgattttacagacagaagcatagtttggggcagcagtaagacagggaaaggcctgcattcttactcccagacccagggctaatctatcatagggaaggggtgtatgtgctttgtgcaggacagttgaaggcagctttccagaacatgcaagaatgctgtgtgtcacagcctgttatttgtgtaatagcatcaacgttgcttggatctcagggcaggatttatggcgagtacatgttcttacactaaggactgtaaataaagcaggaatcaggaggtatccctgagaccagggttgagcagaagtcaacatggtagattagcatccaagatggagtcactttggtctccaccttggcccctagttgtggcaaccaaaaatgtctctagatattgccaaatgtcttgggtgggggctaaaatcacccctagtttagaactgctattttatatttagttttatgacataagtacttcttccatgttattacagattgagtaagcataatttttagtggccatgtaatattccattgtggatatcatcttcagtcttacattgagaagagtgaccttggctgtctttagtatatagagctttgcaaaatcattctacgaccaggcaggtataatattccataatctactggtgggagtgttttttaaattgtggtaaaagtatagaaaatatgccatcttcatcatttttagatgtgcagtttagtaacattaggaatgttcacattgttgtaccaccacactccataagcgatgtatttactagtgaatgcaccaagtgatgatttgttgtttttatttttattttcactttctggttcttttaattattttttttattaacccttatctatgtgatggaatgtttttctttttattttctttttaataaacagctttaccttgaagatatgcttgtttttgttgaagaacataagaatagtttttaaaaaagtattgcaagcagtaagtgaataccttgtaaattaagtgcacactttatactttttttttttgagacagagtctcctgtcacccaggctggagtgcagtggcgtgatctcagctcactgcagcctttgcctcctgggttcaagcgattcttatgcctcagccttatataatacagtttcataaactattttgtgtactattttagatcccactgtttggaatcatgtcatcagattctgcagatcctttctactggatgagagttattctggcttccaatagaggtatgcgtgtcttttctgtctccacactcctactcacagcaaacagatggaaacatgtggattagcaatgagttttcaatgtctacagggagggggaggatatcattgcctagaaaagcctagtatgtagataatgacaacaccgtgtgattaatgtaatcatagagaaatctgttcttgggttttcatggactggaaaaccctgatcttcagtgtcaaagaaggtgatgtccagataacattggaattggagtccaggtggggcgccgtggctcacccctgtaatcccagcactttgggaggccaaggtgggcagatcacctgaggtcaggagtttgagaccagcctggccaacatggtgaaaccccgtctctactaaaaatagaaaaattagccaggtgtgggtatgcacctgtaatcccagctactcaggaggctgaggtaagagaatcgcttgaacctgggagatggaggttgcagtgaactaagatcgcaccactgcaatccagcctgggtaacagagtaagactctgcctccaaaaaaaaagggagtccagtgtgtgagccaatcggggagctcagctggagctgagcctgaagcctcaagcagcattgttcatctgggaaattgtggctgaggatgctggacagtgagagtagcaaggggtacaaccagtcgtgaggtttcttacatttaggaacagtggttgcctcttttttggaaacacttttttcaggcgatcctcccacttcagcctcctgagtagctgggactactggtgcgtgccacaatgcctggctaatttttgtagttttgtagaggtgaggttttgccatgttgcctaggctggtcttgaactcctgggttcatgccatcctccctcaaagtgctgggattacaggtgtgagccactgcacccagcctggacatactttaaatcgatggcagatttttttttgatgtttttaggttataaaggtaatattgatttattattttaaaaatgcactagcaatttatatacagatttatatgaagctgaaaagaaaagtgtcacttctgaggggagctctggaggatttggtagattggtgactatcaattgaggccttttctttgcacatacattcacttacatatatctatatacttcttataactgaaaagtaagatgtcctgtatatactattctgctactttgtttacttaatatcttacatgagctattaatggccatgttattattccattataaggatacgctgtgatttatttgatcattcattcaacaaatacttactgagttcatattgtgtgtcagcctttgtgcaaggtgccgagattagagcagtgaacaagacaatgtcccagttgtcatggagttgatatttgctgtttggggaggtacctggggtggggaaggtgctctaggaaggtgatctttgaagacagctgcaggaagtgagagaggaggccacatgaagacctgagggaggcatattctagggaagagccagtgcaaaggccctgaggtgagcctgtgcttggtgtgttcaaagatcattgaggaggggccaggcgcaggggctcatgcctgtgatcccaacactttgggaggctgaagcgggaagatcacttgaggtcaggagtccagaccagcctaggcaacaaagtgagaccccatctctactaaaatcacaaaaattagccaggtgtggtcgtgtgtactgtggtcccagctacttgggaggctgaggtgggaggatggcttgagcctgggaggaagagattgcagtgagccgagatcacgccactgcactctagccggggcgacacaaccagaccctgtctcaaaaaaaaaaggaacattgaggaggtgagtgtggggtggaagaaatgaaagaagagggaggagtgatgggacctgatgttgcagatgtatctaagtcagatcatgaagggcttggagaccgttggatggagcacattttaaggaagatgggaaacttctgcaggccactaggttcctttcttgtcatatattacgtttttttccccccgattttatatcattataaagaatgctacaatgaaggctatcacaccgttctgtaactttttgatagaatgaatttctagaagttcaactgttgggtcacaagataggcatactgaaatttttgatagagaaagctaaattatcttccaaaacagttgtttgattttacactctcagcgacagtatatgagaatgaccatttctctttcaacagtggatattattagtattttagtctttgttagtcagagaggtaaaagctggcatcagttatttaattttgatttctttatagattggtgagtttgaacattgttttctgtttttatggaacatttgtatttcttctataagtggagttttattagtgtgttagattccttttgttgtaagtaataggaaactagatgctttcgtagtccgtagatgtgatgattggatcttcacgctcgtgtgtgagatgtgcctctctccagccttgttaggatgttggaacattacccatctgacatgaaaagaaaaaagaaaaaacattgttttaaataaaggagaaaaattaaggaataggaaatcactgactagcttaaacagaaacatgatacttgctggaaggatactggttattttttggaatctacagtggagatgaacagctaagccccaggaagaaggggagcaaggccagcccttaggcctcagcagcagggattggtgaacattttccattctctgtgcgattcagctccacactcccagatttattttattttattttatttttttaaaccaaatttcgctcttgttgcccaggctggagtgcaatggtgcgatcttggctcactgcaacctccacttctcaggttcaagcgattttcctgcctcagcctcctgaatagctgggattacaggcacaagccaccatgcgccactaatttttttatttttagtagagatggggtttcaccatattggccaggctggtgaattcctgacctcaggtgatccacccaccttggcctcccaaagtgctgggattacaggtttgagtcactgtgcctggccccagattatttgtttaaaattccagatgcccagggttctcaccaggcaggatcagcttcagttagagttccagggttgcacagtacaggtttggatgctgggggcctactcctgtgctgcattttcctgagaaagcttcagcaggagcagacacatcatgtatctgctgtttcctttttaaattgtttttttccttttttttttgttttattttttttgagacggagtctcgctctgtcacccaggctggagtgcagtggcgcgatgtcagctcactgcaagctccgcctcccgggttcacaccattctcctgcctcagcctcctgagtagctgggactacaggtgcccgccaccacgccctgctaattttttgtattttttagtacaggtggggtttcaccatgttagccaggatggtcttgatctcctgaccttgtgatccgcccgcctcagcctcccaaagtgctgggattacaggtgtgagccaccgcgcccagccagtttgttcactttttaattgatttgtaagagctctttgcacatgagagataagaactttttgtcatttgtgtttaatttttttttattcttttgggacaggctcttgctctgttgcccaggctggagtgcagtggtgcaaacagctcactgcagccttgacctcttgggccaagtgatactcctgccttagcctcccatgtagctgggaccacaaccgggcaccaccatgtctgactagtattttaattttttgtagagacagcatctcactttgttgcctaggctgctctcaaactcctggcctcaagtgatctgcctgcctcagcttcctaaagtgttgggatgacaggcgtgagccaccatgtctgccttaatagttttattttaaccattatgctgccttttgccacgtggaagttttgtagttgtatctaatcatatcttccatcttttcctttgtggcttctagattttttgccatgcttagaaagactttcttgcccaagatgataagctactcacccatatttccttctagtatttttgtcatttatcctttatgtttaaattttctatacatggaggctgggcacagtggctcatgcctgtaatccctgcactttgggaggccgaggagggcagattacttgaggtcaggaatttgagacctgactggccaatgtagtgaaaccccatctctaccaaaaatacagaaattagctgggcatggtggcttacgccagtaatctcaggtactcgggaggctgaggcaggagaatcgcttgaatccaggaggtggaggttgcagtgagccaagatcgtgccattgtactccagcctgggtgacagtgagactctgtctaaaaaaaaaaaaaaaaaaatttctatacatgtagcatttgttttgatgtgaggcatgaggcatgaggtaaggaatctaggtttaatttcctaaaaatggccaatttttttgccaaggtccatttttttctctactgatttgaaatgccatatttcttatatcaaatattcattaaagcttgattaagtctatttctggactagagctatttgcaataataaattttggtgatctaacttaagaaatctatctaatatctttttttttttttttgagacagagtctcgctctgtcacccaggctgaagtaagtgcagtggcacgatctcggctcactgcaacctctgcctcccaggttcaagtgagtcttctgcctcagcttcccgagtagctgggactacaggcgcccaccaccatgcccagctaatttttgtatttttagtagagacggggtttcaccatattggccaggctggtctcaaactcctgacctcatgatcctcccacctcgtcctcccaaagtgctgggattacaggcgtgagccaccatgcccggccatttttttttttttttttttttttaagacagaatttcgctcttgttgcccaggctggagtgcaatggcgggatcttggctcaccgcaacctccacctcccgggttcaagcaattcacctgcctcagcctcccaagtagctgggattacaggcatgcaccatcatgcccggatacttttgtatttttattagaaatggggtttttccatgttggtcaggctggtctcgaactcctgaccttaggtgatctgcccgccttggcctcccaaagtgctgggattacaggtatgagccaccacacccggctttttttttttctttgagatggagtctcactctttcgccaggttggaatgcagtggtgcgatcttggttcactgcaacctccaactcctcggttcaagggattctcctgcctcagcctcccgagtagctgggactacaggcgcacgccaccacacctggccaatttttgtattttcagtagagacggccaggatggtctcaatctcctgacctcaggtgatctgttggctttggcctcccaaagtgctgggattacaggcgtgagccaccacgcctggccaataaatctatctaatgtcttaaacactaaaacatgtttttattttttactattgaggaagtatctgagacgacatcaaaaatcccccgtaaggtggactattttctcatatgaaggccaccttttcagcatttatgaaaacaggattgaagggagtgatgtgacagagtggcccaggaagtcttggcactgtagaattacttgattccataccttccttatacagttggcatatttgattttcttatttctccctataaattctttttttttggtttgtttttgagatggagtctcactctgttgcccgggctggagtgcagtggcgcaatctcggcttactgcaacctctgccttccaggtttaagcgattctcctgcctcagactcctgagtagctgggattacaggtgcccgccaccacacctggctaatttttgcatttttagtagagacggggtttctccatgttgtcccgttggtctcgaacttctgacctcaggtgatccacacacctcggcctcccaaagtgtggggactgcaggcgtgagccactgtgccaagcctatagtactttttattcagggcattgctgcaggattgtgttaataaatgagaacttttcttagcaagtagtgtttaagaaatgaaaatttgcttgttaaaattttcacgtgtgtttcagttgaggtaattagggagtgcgacacctctaaatcagtttgtatcgtgtacagcaaacattgcacacttctctccccttcctttccaggaactttaatggaattgggtatctccccaattgtaacatctggtttgattatgcagttgttagctggagccaaaatcattgaagttggagatacaccgaaagatagagctttattcaatggagcccagaaacgtgagcattaatgcaattaaagagcattctccaaatttgagagtgctcgtggtaaagatgttttctctagtcttttcttgtctttggtggtaagcgtgctctcctttccccccaactttcatcagtgtttggtatgatcattaccattgggcaagccattgtgtatgtcatgacggggatgtatggggaccctgcagaaatgggtgccggaatctgtctcctgatcatcattcaggtaagaaatcctatattttcctatgcagataacaaaacagtttgattcctttttccttttctaacagttctttaggtgattggcttattcattttcttacttttgaattatttaattctagtattttgatcactgaagtgatacgtgtaaaatttttttaaaaccttctgtcaccgtgacgtgttcaagttgtgttgacgtgaaaaattcaaatttattctaatagcttcataactgcacaatacaaagaattatggatcaattgtattttattgattcttaagatacacatttgtcacattttgatgtctctagaatcaggatgtttttgtacagtaaacagtgccttccacttgcggtctgccaggaggcagtcatggtggtgtcactgcctgtgcgtgtgtcagcctgttcaggtcatgctgaccttagttggctgagtgtgatcttcacagaatgggtgtttgagttcaatcgctgtctaaaggtgttcagaaaatctgttgtgatttgttattgaaatgaaagtttatgtatagaagggcaagctagatgataaatatctaccactaggtctaaaatacgtttttgtaagtagaaaattaaaattctttgcaataaggtattgtgccataagttaattggcagtattcttttcttagtagtacacaaaataatgatgttttacatggtaatgtcttagagtcagtgaaacactgtttatacacacataaatatattccatgggttttttaaatggatgcttaggaatggaatttttaaaggtcaacataattattagtgtcctaagtatcttttttttttttttttgagacggagtctcactctgttgcccgggctggagtgcagtggcacaatctcagctcactgcagcctctgtctcccgtgttcaagcaattctcctgcctcagcctcctgagtagctgggcttacaggtgcctgccaccacgcccagctaattttttgtatttttaatagagacgggggtttcaccatgttggccaggctggtgttgaactcctgacctcgtgattcgcccgcctcggcctcccaaagtgctgggattacaggcgtgagccactgcgcccggccctaagtatcttaaaatatgttaagtttggaagctatttctctattgtacaatccttaaaaaccatttagataaattacccaagaacagatcatacttaagttatctttcttgtgttttgaaaagaagtttgctgaagttaataaacaatgggtatctggagtcctgattttcttggaaatgcctcttcttcttcactttatgaaattgggattagtttaggaaattttttctttttcttttcttttttttttttttgagacacagtcttgctgtgtcgccaggctgaagtgcagtggcacgatctcggctcactgcaacctccccttcctggtttcaagcgattttcctgcctcagcttcctgagtagctgggactacaggcgcgcgccaccatgcctacctaatttttgtatttttagtagagacagggtttcaccatgttggccaggatggtcttgatctcttgacctcgtgatccgcctgcctcggcctcccaaagtgctgggattacaggcgtgagccactgtgcccggccaggtatttttttctgtctgttcaaaagatcaagatcaagctgagaaaaatattttttaataatctcaaataccagtttattaatatatacatagaaggaaatctgactgtctcagactggcatggttgagcattctggtttttttgtttttgttttttatttttgagacggagtttcactcttgttgcccaggctagagtacaatggtgcaatctcagctcggcacaatcttggctcaacacaacctctgcctcctgggttcaagcgattctcctgcctcagcctcccaaagtgctgggattacagagcattctgttttttaaattagaaatgttatgtaggaagcaaaacatgattatttaatgagtgtgacttatatccaggaaagttatgctgttcaagtatttatttagcattgttaacaataaacatgacttttctaatgagatggaactgttttgtcatttgaccagggcaggaattttttttttcgagacggagtcctgctctgtctcccagactaaagtgcagtggtgcaatcttggctcactgcaacctccgcctcccaggttcaagcaattctgcctcagcctccccggtagctggaattacagggtcctgccaccacgtccagctagttgtgtatttttagtagagatgggattttgccgtgttggccaggctggtcttgaacttctgaccttaggtgatccacccgcctcggccttccaaaatgctgggattacaggcgtgagccaccacgccccgcccagggcaggaatttttaatgaaaatcaggttatttggaagctttctgatccccagtgtgttcgcatttggtagaagatacgtttccttaaagaataactgtcagatgtggtggctcacacctgtaattccagcactttgagaggccgagatgggcagttcacttgaggtcaggagtttgagaccagtctgggcaacatggtgaaaccctgtctctactaaaaacacaaaaattggccgggtgcagtggctcacacctgtaatcccagcactttgggaggctgaggcgggcggatcacgaggtcaggagatcgagaccatcctggccaacatggtgaaacgctgtctctaccaaaaatacaaaaattagcagggcgtggtggcaggagcctgtagtcccagctatttgggaggctgaggccgaacccaggaggcggaggttgcagtgagctgagattgcaccactgcactccagcctggcgacagagcgggactccgtctcaaaaactaaaacaaaataaaacgacaaaaattagccaggcgtggcggtgtgtgcctgtaatcccagctactaaggaggctgaggcaggagaatcgcttgaactctggagtcggagtttgcagtgagccgaggtcacaccactgcactccagcctgggcgacagagtgagactctgtctcaaaaaaaaaaaaaaagattaactttgtctttgtctttatttgtccatttacaaatcacttgattggcaaatttacagcccttgggaattagggaaagaggcgcattggatggggagagatgatattctggagtctgattttagtatctttcagggcttagggtttctcttcgtatgctttaggcattgttgaggttatggacaggccaattgttgccttcagttttgtttctttacagcattttctttctgcaatccagagtttagaataatcttgatttttagaagacacttagaactggcatgtagctcgtagaacattatacatcaagaaaagctctctagtatcttacttaaggatctattcagattcctaaggaatctccactgagcgattctcagccagctagctacaggattgacttcttacagagtcagttatggattgaaattgatataaaatagagttaagctattttgctgttcattttcagtattcagaaatcagaaatacttacagtccaagaatgaaacaagtgaagtggatgtacactgattcatttacatgaattctgatacacaaatatgcgtgttatggctaattcttctaatgttaatatataaagaggggtgtcatgtttgattgtaggtgggcagtgacccattggtgtcttttcaaggcgttactaacattgaaaatatgtggatacactgaagagctatgattggatcagtgtgtttcacccagaaacataggttttgaaaactgtttgcatgccgttgtggaaggtatttctcaccttatttgtttatgtttcattcacgtggttagtgtttttcagctagtgagtttagaaatctacatagcaggtcttgactaaaaattttaaaaaactattagagaatatcagtgtgcatggcacataataaaggtaagtatgttttgacatactgaacaaaagatagtttgacaaaactaagttgtgtgtaggtgtcgtgcagggttaaaatgttaagtgccatgtttataccggctcatcatacatgtcgtccattccccgtgaacatgtagcagttagggttctggtcccatcactgtagacgctgctgtcacttcctgggttctcatcccttttcacaggcatgcatgatatttactggcttttattcccttaattatagaaaccgtttctcatttctgtataatttcttcctccctttggaaaaacccaagtttaattttcacaggacatatgtgaaccactctgtagtccgatggtcactgttctgaacagggggtgtggagaattagagttgtttcagagctgctgtgggactctggagaggtcatttctcaaggcccatcacgatgctttctgtggctgatgttcatggacggctgttgcctcctgcataggatgggtttctctatgatggggagtctctgttcactaattacatgattgtggttaaatagaatcggtagtaagtcctaacctctacattattttgtcaaaatgtcgaacttggttttcaagcagtaaaggattagcatgatctctcttagaagtttggagaatcgtaccctttctcctgcccattgaaactcagactaaaagcctgtaaatagacaagttaggctctgtccaactactgaaatggcagttaaggagaaaaacaacactgtgtaaggtaagcatgcctaaaatggtctcatgtggttactttggtcgctcttccagcaggtgatattggataaagtgagtacaaaatgagggtgggcggcttgagagctgggaggaatggaagtgacttcctcacttctgccggagggtgtctttaaagtggggacatgtgtgaggttgggggcatggaagcatattttcttcctgtcttgattaggttatttgagtgcagggaaggggtcatatgactgaggaggtcacttgaagggctagggactgtttttaattaatgcatacttttacaggaatgtcttctccaagaagcaagttcagaattttcaatatcccataaattaaagtcagtatgctttcatttttaaaaacaatatgagcttaaccttaaccgtcttcaaatttacattcaatctttgtcactatgtgtatagaatgcatttttacattgctgctcgagtacgtatttgagtacatatttgtgttctagttttttattctgtacacattttatagagtatacatatatataatatatataatgcttttttcaaaggatcaacacagcccttagacttatcctttgatggcagtgtacatttccatcttgctattataccagaattcatctgactttttacttccttggaggtatttgggatgttttcagtttcttgctgtcataaattctagaatactgtgatcattttttgtttcagtgtgcttttcaaacaggctttatttaaacattgcaaaagaaactattcagataagtgtaaatagactttaaaagttgaaatgtctgctttataatacaacagtatttccagtcctcttactgttctagattggcctgagtaaatgaaagcaggccaaaagatgcagttggtcatcacagtgagattgcaacgatcaggccttaatattcaaaacgcccctagcttggaaatagccaatggtgttcctctccccctttcttgagtttgttcttgcttccgcttacttgcatttctttccccacagttgtttgttgctggtttgattgtgctgctgttagatgagctgctacagaagggttacggcttggggtctgggatttccctctttattgccaccaacatctgtgagaccattgtctggaaggcctttagtcccactaccattaacactggcagaggtacatcgcacagcgactgcaactgcacgcgttttgctggatgtgtgctgggaacaaacccatcgtgtcgcagtacatgcctagagccgttctggtttgctctcctaggggataaggaatgcgaattcttcaaaacttaatgagcagagatttgtggagtaagcaatactacctcagagagaatagtatcaaaattttagcctctgcttatttaaaatttcagtggttgcaaacagattttcaaaatttcttttgttaaccttgcttaaggcattgctgcagaagtcatttatttgactgatttcagcatccgtagggggataaaaaggtagtggattttagatttttcaaatgaaaagactgttgttcattgaatccacctggagcactcctactctgctgctcttctaattggctttgtaatagcaccaaagttttgaaatatttcattctctctttccccttcctcatctccacttctaacagatactgtcctaagtggttaatacctaaactctgatcccagccttaagaaaactgtaatgatgattaatgttcttggtgcggtaaacttcgaggcaggctcgatagagtgacatctgtctcttattctgacatctctgctctgcttcgctgctgtttatttttcctaaaaacactctctcccttccctgaagtagaggagaggcaaatctctatgaatgaaattttgctttggtaaattttacgttgtatgttttcttcaagaatagtctcttgagaaaacttcggatttatgctataaaaacatagatttgcctcaatgatctaaatatttgtagaacctgctcacatggctatatcataaagcaaacattggcgaattcttttgacccatattttctgctgtatactggactttcacggttagttgtttgagctttgggacagctttggacgatgagtccacaggtcgtgtctgtcttgattttacaggtactgagtttgagggtgcagtcatagctctgttccatttgttggccaccaggacggacaaagtccgagctttacgggaggctttttatcggcagaacttacccaatctcatgaacctcattgctacagtttttgtgtttgctgttgttatatatttccaagtaagtataaccttttcaccaaagtaagtgggatgtagatttttattttgctcttaaagagaatgccatctgacatgctgttgtttaacaagtcagggtttaagatcaagggaaataaaattttgcaattagagtctccagactctgattttaaggtgtgaaatattggagtctctgtactttttttgttttttgttttgacccatcagcaggaagcagactctcgacagtttaaaaggcagaacgtctttgttagcattgtcttttcttttctttttttttcctgagacggagttttgctcttgttgcccaggctggagtgcagtggcgcgatcttagctcactctaacctcctcttcccgagttcaagtgattctcctgcctcagcttcctgagtagctgagatgacaggcacgtgccaccacgcccggctaatttttttttttttttttttgagatggagtcttgctctgtcgccaggctggagtgcaatggcgcaatcccggctaactgcaacctccgcctcctgggttcaagcgattctcctgtctcagcctcctgagtagctgggactacaggtgcatatcaccacacccagctaattttttgtattttagtagagatgagatttcaccacgttggccaggatggtctcgatctcctgacctcgtgatctgcccgcctcggcctcccaaagtgttgggattacaggcctgagcccctgtgcccggccggcattgtcttttcatcccccgcactgttctttgttttccctctctggtctctgttcttttcttaatgtgtctggctcccccacttactctccgtttccttttttagggatttcgcgttgatctgcccattaagtcggcccgttaccgaggacagtacagcagctaccccatcaaactcttctacacctccaacatccccatcatcctccagtcggccctggtgtccaacctgtatgttatttcccagatgctgtctgttcgatttagtggcaactttttagtaaatttactaggacagtgggccgtgagtattatgtttatttacattatttatagtttattataatttgcatttcatggttgtatttttaatggaatgaggtcgacattggagcatttgctgtattttcagattcacttacctatatagcagagtttagtacttatctggaagaactggtaagtgttgcagaagtaagattgcccaagcgctttttattattttgctctctaggaagcactttcacatctcatttgaatgaccttttaagctaaaattgtggttgatttcataaaagtaatttcctattttgtcatcttattccagtattgtctacaataatgctttctaaaagatgctatttgctggctgggtgcggtggctcactcctgtaatcccaggactttgggaggctgaggtgggtggatcacctgaggtcaggagttcgagaccagcctggccacatggtgaaaccccgtctccactaaaaatacaaaaattagccaggtgtggtggcaggtgcttgtagtcccaaccattcaggaggtcaagtcaggagaattgctggaacccaggagatggaggttgctgtgagctgagatcacgccactgcactccagcctgggcgacagaacgagactccgtctccaaaaaataaaaacaaaaaatgctatttgctgctgctaacatgtgagatactggactcatcctaacctttcctatctcccaccctgcctccaggcctcctccatttttcatggtctgaatggcaataagccagcttgtgatgagctgggctagagataggcatgctattaactagacggtagagacagcggtgctgctagtaatataatcctatacattctcatatacatcccccatcataatttttttttcttttttttttttttgagacggagtctcgctgtgtcgcccaggctggagtgcagtggtacgatctcggctcactgcaagctccgcctcccgggttcatgccattctcctgcctcagcctcccaagtagctgggactacaggcgcccgccaccacgcccagctaattttttgtatttttagtagagacggggtttaactgtgttagccaggatggtctcgatctcctgaccttgtgatctgcccgactcagcctcccaaattgctgggattacaggcgtgagccaccacactcggcccataattttttctaaagccatctagccacgctgttattgaagcgtgagttactgtgggactgaattttcattggtttaaattctgtcacctaacaaaggggtattttccctcttaaaattatagattttagccaggcgtgttggctctcatctgtaatcccagcactttgggagaacaaggagagaggatagcttgaaggccaggagttggagacctgtctgggcaacatagcgagaccccatctctacaaaaaaacttaaaaactagccgggcacagtgttacgtgcctgtagtcctagctacttgggaggctgagttgggaggattgcttgagcccaggagtttgaaggtacagtgagctgtgatcataccactgcatgccagcctggttgacagagtgagaccgtgtctcaaaaataatagaattttaaaagactaatgtcctttattctttgccacagtaggtaattctagaatttgcaccccaccaaagaatagtatttttctgtacagttattcttgaaatatggtgtttattctgtgcatttgtcttaatatgctttttttttgcattataagttacaaagactcatacctttctgcttttactgaatgtcatttaaaaaaaaggtttttttaagataataagacagtaactcatatattagttgaagggaataggattccctttattcataatacttctttcccattcatttaagagaaatgtgatgatctctgttgtattctggctaatattatatcgaggacaggaaagtcaagagacaggaataagaagaatgctgtttctgccctccttagaatagtccagcagcagctattactctgatcagaatgtcatagtgatagtgctttgagtagttggtcctgtacaatttgtgttatgattttgagtaagattcttctgaatgagagaatgattgggagatagtgcttttgatctgggattaatgattctaggggcacagtaaagaaatcattgggcagtcataaattcaagaaccagatactgtaatcatcgcaactaaaaattggtttctcaccccctatctgtataccccaaaactttatttaatatgagcaaataatgctgttcctatttctgtaagatttaagtatatagataaaaatccaattattatatttattaaaagattgctccttataacatagaaaccacataaagtctaggcagcaagttaaagtcttatgtcagtattttagttgattgcattaatattttcatatggaaggatcattcatagggatcttaatgtactgactggatactctcatagctcagaaaatttcagattttaagtataatcagaggttgattgtaaatgtaatcatattcctattttcagtaatggaagattttgtaatatattacaatttttaaaaatgactcaatattttcacagtgtcttgcatgtaataggtgttcatcgtataactttgaaggagtgaaggtagtagacacaaaagtacattctgaaactacatagaatgactagctgtagatgccttgaacttaaaacactgtcatttctgagaagtttgaagtgacatgcaaatgtattcctgactaattaggttgaccacttgttctttgtactcctgttctgtaggatgtcagtgggggaggacccgcacgttcttacccagttggaggcctttgttactatctttctcctcctgagtccatgggcgccatctttgaggatcctgtccatgtcgttgtttatatcatcttcatgttggggtcatgtgcattcttctctaagacatggattgaagtgtctggttcctcagccaaagatgtaagtgtttggtttattttaaaataaaactcttggcaatgcatggtggcgcacatctgtaatcgtagcactttggcaggctgaggccgctggatcgcttcacctcaggagttttgagaccagcctgggcaacatagcgagaccccgtcatgactaaaaaaatacaaataaaaatcggccgggcacggtggtgcaagcccgtggtcccagctacttgggaagttgagacggagcagtaacgcttgagtccgggaggtggaggttgcagtgagccaagattgcaccactgcactccagcctgggtgacagagcgagatcctgtctcaaaaaaataaaaaaggccaggcgcagtggttcacgcctgtaatcccagcacttcgggaggccgaggtgggcagatcccatgggtaggagatcgagaccatcctggtcagcatggtaaaaccctttctctactaaaaatacaaaaattagctgggcgtggcagcgcatgcctgtaatcccagccactcaggaggctgaggcaggagaatcgcttgaacctgggagtcggaggttgcagtgagctgagatcgtgccactgaactccagcctggcgacagagctagactccgtctccaaaataaataaataaatagataaataaaaaatttttaaaaaagtaaaataaaactttgtttttggaaaattcatatttaattgtcaaaacagtagtggatacactcctttataacttaagctttaatttatacatttttaatgagtcagtgtcaccccaacaggctaaaaattggttcccaaaaggtaaaaaattcttagatattacagtggtttgcaaccctcctgcaaaacaaaatcttgtttggtaattgaagaagggttgagaagcaccggtttcatatgggtaacatggagcggaggagcactgaagctttggtttcctcaggcttaatgcgaatgatatgacaatgcaactttcaggttattgtatgttacgtgttagtgtgtggcgagcacttcgcatagaacgtggtagatgtaagcagtgaaatgttccagttggattttgaaagtcgtttttctctcggcaggtagctaaacagctgaaagaacagcagatggtaatgaggggccaccgagatacctctatggttcatgagcttaataggtaaggctgctagactgacacctttataggcctgtgtttgtgtttcagtctttcagtgttggctaaatgtttttctttgttcaagttcatatttaaaacccttctattcacacagatgaatcaaaatttcacacaaaacttgttttccatgtcaaaaccaacacctgaatttttcattgaaattgtgagcactgctctgctcatcccagtgataaaatcttgcagatcagtgctgttctcagcattggctggctgcacatacaatcaccagagagcttttaaaaaggatttcccaggaactgtggcttatttggtctggggtgagttccaggcatcagggttttattttttggtaacagctttattgagataaaattcagataccatgtaattcactcacttgaagtatattgttcagtgttttttagtatattcagacttgtacagtcataagtttaaacacattttcaccacccagaaagaaaccctgtacctactagcccaccttcccaaccaccagccccagacagccacttttaactttgtctctacagatttgcctattctgtacatttcatataaatggaatcatataatgtatgttattttgtaagtggcttctttcacttggcatcatgttttcacagttcatatccttaattcttttcatgaataatattcaattgtagggctttaccacactttatcagttgatagaaatctgggttgtttccactttttatgaataatgctgttgtgaacatatttgtacaaattttgtgctgctcagctgtcttccaggttggctgctgtagtccacattcccaccagcagtgtatgaggttccactgctgcctgtcctcgccagcactagctctggctttttaatttcagccatcctgatggatgcgaagtggggcacaatcacagctcaccgcagcctcttgggctcaagcgatcctccccgcctcaacctccagagtagcttgggaccacaggtgtgtgccaccacggccagctagcttttttttttttttttttttttttttatctgagatggggcctcactttgtcacccaggctggagtgcagtggcaccgtcttggctcactgcaacctcgacctcctgggatcaagcgattctcctgtctcagcctccctagtagcagggattacaggcacgcaccaccatgcccggctaatttttgtatttttagtagagatgggtttccccatgttggccaggctcgtcttgaacttctgatctaatcatccacccgccttggcctcccaaagtgttgggattacaggcatgagccaccatgcctggtgggatccagattccttcttttgcttgggggcatcctgttgtcccagcatcatttgttgaaaaggcactagtatttttccttaaactttttatttatttagaacacagactgcagagtagtatgatggatctccagctccagttgtcaccatcttgctgttcttgtttcacctatcactgcctctaatcttttttgagtattttaaatcccatttttcagttttccaggtgattctaatgtgcagccaaaggttgaattactgaaatggatcctcaaaatcttatgacataaatttgttcatacctactcttcattccacaagagggaacgaaaggttactcatttaaaaatcttaaacattttaatatttaaatctgtccaggaatctcatgtcctgtaagattacatattgtctttcttggctgttgactggttcctggaaattagggtcagagtctttgcctggatcagagctcctgttcccatgccgtgccctgcacacccctccacactgcagcctgttccctctggagttcagggaggctttagacccagctatggctgctgcgcctcgacctgtcttcgtctctagctgccgtgctgttcctggtctctgctgccgcctaacttggggttctgtctcctaggtacatccccaccgcagctgcgtttggcggtttgtgcattggcgccctgtcagtgctggctgacttcctgggggccattggatctggcactggaattctgctagcagtcactattatttaccagtattttgaaatatttgttaaagaacaggccgaagttggtgggatgggtgctttgtttttctaaatgttcaaatatttcattttgtgcgtgtgaaagggaaaacactttgacggatcgtttttgtcagatgacactggtggctccccttttctcccctcacagtttcttgtttcgagtgctgactgacccgtttctgaaatgggcaccgagctaagtctgtgtgcagcattagtacccgctgccttaaaactcaagtttacattattcattaaaaaaagtacatctagtgttgcctgtaatgctggaaaccagtgtatctaccttgctgtgttaaatcatgacagtgagacggtgagatggattcgttttgcacacaacattcaaaacacttcatattgcccccacttgttgaaaaataaatgtagttcaaattgccactttccagtatttttgagcttatttaatgagttctggaacatttatatctaatctatattttagataattactttttatacttttttaactcatggtatccccactccccacccccacctcatttttatttgtcccttctcaaagcagccacttagcccacatgggcgaaatcaagtctccagttatttctgccacaactgcttctaaggcctcctccttctcctcctcctcttcctcttcctccttttccttctcctcctcctctcttcccagtgacagcatcatcgtgctgtttgcctgtattggctatgccttctaactccaaccagtcacttgagaatattctttcaagattctgggccccgattcttttctgtttaaatccctaaagcaaagatctaattctcaagcaatgtctgtagttcagtgggggtgaacaatgaatatattcatgctaggaatttgtgtctgttgttgtactcacagcagcaacatgagtgtaaacagtagacaataaacttttatttaagaaaactgattcagttgtgttggaaaaaataaagaaatctgatattaaacgttttctaagatcatttgtataggttcagtgtattcataagaagtccaccctgagatgcctgtaaaagtcaaatgtaattacacttcaaactttaatcctaaattattgacagatagatagatagtgaccaacttaagggtaatcatatatgtgactaacatttgggaggaaacaggaaaacagtggtctcaaaacaacaatatcccagtctccatttgaaagagcatagatcttggtaaatcattttgaaaactatgtgctttatttcccaaaagatcaaacttaatttttaaaagacacccttttcagaagtatgggttttcattgctgtttagtttcttaggtgtggtatgtcttacgtagcttatgcttacaaagccaaataatcgcagggcaaggcagataaaggcaggcaggatagtgacagtggctcggtgagcatccgccaagggcctcagaccactgttaccataaaaacatccacccagtgttatgacgtccgatttttttttcccttaagaaggtggaaatatggcttttaatacataggaaaccttcagtttttaaatgcagggcaaataaacatttttaaacagtgccagccagactgccagttctcaaacagactgaatttccaaagcacaaccttttcatgtttataaaaaatagaaatggcatttagggatacattctaggatttggctctgacttctaagttgcactcttaggaagaaggagaggataagcttaggtcagctgcagaggtcattcccatggggagtggctggggaggaactgggctatgtggaaagactgggctgcgcccgtctacggatgccttctctcttgatttcaatgattgatagcatgtggctttcagacctaaggaagagttagagctttggagaatcacaatgcctgtgattgaaatcaggatttaaaaaagggttagaggcataggggaaggctaccattacaggaagtagttggatcttaattttcacatgtatagggctagacagcttcatctgtaaagttctgtatttccataattgttttatctttaggaagtccagtgtaaagatcttacagtttcactcataaaaatatcctgggctcagacagtgagcctgtggacaaacggaggctactgcagcattctggcattagcactctgattttatctggagagccctttcatatggttctcagggcctggcttacccgctggagccaggctagaaacatgacttagggctggatgagaatcatcctgagaattccgtgggggccagactggaaagtcctggaaaatcatggagctgctggaggccctaaaagtcaacacaaaaagagctaaactcactcaagaagctaagaaaatggcccaggaacactggtagaactgctagatgacagggtttcaggcatgggaaccagatcaatctgtacttcttgctgtgaactactctgtattgggtttcaggtactggctgatcttgctggttctgttcatggtttaacatcaagatattactgccccaaacatgtcagtcttacagatttgttttcagaaacttcaagtactctttgaggtaagaataggaaaagagatcctcaagcacgtgcagatgcttgcgggatggacctgaattttcattagtctcctagccttggtgtagtgaatggagtcaaccgttttccttacttaaaagctggttcagcctcagtaaatagatgaactgaaaactagtagaggattctatcgaaccctaccctagttggattcaactaccctagataaattttgcatagtaaaaattcaattagaagaggccaaaaagccttttttttctttttaacgctgttttaaacactaacggagtacatggttatttgcatacccagcttagaattttatattgggggttgagagtggaaatgacctaattgagaactcaggtctatttctctatacaaatacccctgtctaccagactggactagaaaagtaactgagctgtagttaactgctgttgagctttaaaaaaattggagtaaacatacttgcatttatattctttgttaattttagctggagttataacaaatttaaaggaaggtcacaacctacctgtaattacaattccataccaccaccacatctgttctgtgcttttattttacgaaaaagctaatggcaaatctacattaaactaagttgaatacaaagtcttagtgaagaaggcctggtggtctcgtttacaaaaatggccagtgtcatatttgggcttaaaatttcaagaagggcacttcaaatggctttgcatttgcatgtttcagtgctagagcgtaggaatagaccctggcgtccactgtgagatgttcttcagctaccagagctgtggaaagcaaagaaaacaacttagatcatgccgttaaggaaggacaaaacatcttattcaatcagtgtttgcgcagcaggtactactatatgtcacttcctatgctagatgctggtgataacgttttttttggtctataaggatcttaaagaataaagactataaaggcaagattacattcctagcatgagacaagaacatcagggataatgattttttttttttttggtgagacagtctcgctctgttgcccaagctagagggcaatggcgtgatctcggctcactgcaacctctgcctcctgggtttaagcgattctcctgcctcagcctccccagtagctgggactataggcgcacgccaccacgcccagctaatttttgtatttttagtagagacggggtttttgccatgttggccaggatggtttcgatctcctgacctcgtgatccacccgcctcagcctcccaaagtgctgggattacaggcgtgagctaccgcacccagccagggatgattttatgtgtgaaaacagcaaagttggaagtgtatagagccaatcgctatacctcatttatagctggggtagggctttgcttttctgaaaccagatggtgatgattatgtaggatcttagggattccatcttttctgctgctaggggatacatatgttcccccggcaagttaaactgtgtgcatgttaggactggagatctactaccaagaatgcggtctcaggaccttattaccacaggctttcattaaaatttgtttcactcagatggaggttgccagatgtaaaatcagcctcttgttttcctagccgcttgtttgggaacaagcctggggacatttgcaggcaggaagcatgtcctactcacctgggcacagcaggtgcttggtaactggcagatgctactctttgtagcaaactgatctttttttaattttttttttatgtttttgagatggagtctcactttgtcgccaggctgcagtgcagtgccacgatcttggctcactgcaacctgcgcctcccgggttcaagcgattctcctgccccagcctcctgagtagctgggactaccggcatgtaccaccatgcctggctaatttttgtatttttagtagagatggggttttactatgttggccaggctggtctggagctcctgacctcaagtgatcagcctacctcggcctcccaaagtgctgggattacaggcgtgagccaccgcacccggccagcaaactgatcttaaaatgtaatactttccttccgacttctcaaatgttgctggttgaataaacggtttgattactgtattttgattctgctaaagctaggcaacttggttcttttacccctcctcctttatagccatagtagccctctctccacctcccctcacttattctatttttttctcccttttctaagaccaaaagtgaagttaagaaggtggaagggagaaggaagacattttacaaaaaggatactcttctactaaaagataaccccgcacggcatttcacacttgcctacgtcaccctgctttccacgcacctcctcagagggaggggctgttattgttcctgttttatgaaaaaagccgagagaggctacagaacctgtttgatgtgatagctaattatggtccgcggagcctcaaaccgagtcgggcctgtgactccgagctgcgctgcctcgtattgattgtcatgcctttctccaaatacgcaccagataaactattgtatctattcagtatgattgttctaactctggctttgagctgtcgaggtggcttctaccttaggtctagtttttggaaaggtgaagcaggagtggaagctctctaagggatacgaaatctgattttatccaaagaaatcacagcagcctttgaaagacacattcagattttcaaacaaacaacagacaattcaaaaccaggcgctctgcttattcactgaaaccgtaagctgctgaaactcagggaaaagcttaagaaactggtcttaaagcttcaggccaaacaatgcttcaaatcacatttgaagtaatcacttaaaaacagtagaaaaatcagttatcaattacctaaaacacttatacccaataaaatattcccatgatga

SEQ ID NO: 752 - DNA, 40318 bp, Homo sapiens; identical to SEQ ID NO: 751

SEQ ID NO: 753 - DNA, 40318 bp, Homo sapiens; identical to SEQ ID NO: 751

SEQ ID NO: 754 - DNA, 76149 bp, Homo sapiens
taaggtccagctgtattatttatttacagcacagttcaaagtcattaaatccggtacaaaagaaatggctctcacttcctggattggcaccagacatcctaccagctgcaattacatcattttttatctatcttctgcttttactttgtgtagggtagggatggggacttacaaatgggccaaagacacttcaacctcaaaaccaaagagaaatctctgcttgcagagatacaaagaaagtaactctccctcttatgaaaagcaaccaggaactctactccagttatgagggccactgatggtgtgggagagctatcaagaagattcttcctagacgtggtgcaaagacagtgagaacccaggaaatcacattcatgggacacttgctcttaccgtcatcaccctctattctatctcaactttggccccatcaaatctaatgataaacaaaagaaggtaattacatgtagaaaatcaaagtgaatgggaatgtggtggtgtgaacataaaagaagaaattgaaaacaatcaaaagtttctcagtgctgctttcccgcactgtcatagaaatctctgatccaattcttcatatgtctaacttccaaggagcgggctaacagcacagacataggatccaaggcattcttggtgcggagatctaagtggtgggccccctctgagatggtgactgcaaccagagtgtctgtgatatccttagttactccacctcctgaccaggggtctagttcaccattgctgcaagtgaaaaaaagaagaaaaaataaagttgttagtttttcatgttaacactcagataagctagaagaaacctattacatgtttaacacctaaaattataaacttgtaacctgggggatttgatctgaggatctaatttatcatatggatagatacttcatactggagttttgcaatattcatgcaaccaggtgcaaaaaaagaaccagagataattgaaggaggcgttcccacaaatcaacctagactgtactgggatatgaaatttagaaacctgaatttcaatcctgatttcattattcaaaagttatataatgcaagttacctgactcagtttcctcatctgtaaaatggagataacatgccaggcgcagtggctcatgcctgtaatctttgctctttgggaggccaagatggtgaatcgcttaagcccaggagttcaaaacaagcctgggcaacatggtgaaactccgtcttctcgagggagggaagaagggggaaagggaggaaagaagaaagggagggagggagggaggaaaggagaaggctgcattttttatctaatatagtacagtactttgggaaacaggatggtagatctaaaaaatgtcaccaggatctggaatccgaaaatttgggcattacacgaaaatcttcattttacattagctttaaagttaaggaaatgctactaggtttttagtctcagctggttcacacaacacaattcagaataatgtaaagagaatcagtcactgaaactgagtatctactttcactgagtaaaaaatccaatacaaccacagacagcatccctaataatatttctgaacagttttgttgagatataattcatctaccacagaatttgtccatctaaaacacataattcgatggtttttagtatactcagagttgtgcaaccagcaccacaatccattttagaacactttcgtcaccccaaatagaaacccatactcattagcagtcactccccatcttcctgccttgctctcagcctcaggaaaccatgaatctattttctgaatctatagatttgcctattctggacatttcatacaaatggaattaaatagtaggcggtcttttgtaactggtctctttcactcagcgtaatgttttcaagtttcacccatgttgtggcatgaatcagtacatgttcctttttattgccaaataatatttcatttatggatacatcatgttttatttatctcttcatcatttgatgcacgtttgtattgtttccactttttggctaatgagtactgctcctttgaacattcacatacaagtttttgtgtggatgcatgatttcacttctcttaggcatatacttaggaatttctaggatatatagtaacaacctattaattagctaccagactactttccaaagggactacaccattttatattcccagtagcaacatttgagggttccactttctctacatcttcaacacttattattatctgtctattttagacatcctaagctagtaagtattaaatggtatttcactgtggttttaatttgcatttcccaagagactgatggtatttaaacatcttatgtgctgattggccatttttatatcttctttgggaaaatgcctagtcatatctttgttcattttttaactagggttatatatctttctatttttgagtgagagctcacactctcttaacttgtgtgttgtagagtaacaaaagcatgagctttgggatcagacacactttggttccaatttcaggtctgcctctcatctgcctaatctcatggaaacagattccttaggcaaaaaactggcactgaaatacctggatctaagtactcagcccattgcaagcattagatcattttccccttgcatggcactcttggcatatctttacccacataccactggaaattacttatagaacatttttatgggtgtcctaatatttgtttaatgcaaactccgttttgctggtattgtttacaaagccttatctattctagatacaagtcccttatcaaatatatgacttgcaaatattttctcccatcctgtagactatcttctaactttcttgatagtatcatttgcagcacaagtttttcattttcatgaagtcgatttatctattttttctcattgtttatgtttatggtatggtatccaagaaactggtgtctaacccacggtcatgaagatttgttcctatgttttcctctatgagatttatcattttagctcttatatttaagcctttgacctattctgagttgatttttttgttatagtatgaaatagggagccaacctcattcttctgcatgcggatctccagttttcccagcatcatttgttgaaaaaactattcttttctcaatgaattgtcttgccacttttgttaaaaatcaatatgccatacatataaggtttgacttctggacactcgattctcttccacttgtctatatgtctatccttatgccagtatcacactgtattgactgtagctttgtaataagtttgaaatcaggaagtgtgagttcttcaagttcgttcttccttttcaagattgttttggctattctgggtcccatatattcctatatgaatttcaggatcagtttgtcaatttctatttttttaaaaaaaagtccagctggaaatttgacagagatcacgttgaatctgtggatcaacttgaggagtatagtcatcttaatagtattaattcttctaatacataaatatgagatgtctttccatttaaaggaagcaatttttaatgtctttgtttccaatgtatatatcttgcacttcttttgttaaatttattccaaagcattttattcttgatgctatttaaatcaaatttttccctagtataacatattatgcatagattgcattcgtgtttacaaagcctttcacatttgttcattgtaacaaccctatgaagtaggtttaattacaattcttttataaaagagaaaactaatgcccaaagaggttaaaaggcttgccaaaatcatttgatttggcaaatctgagattcaaacacagttctaaaaaccctagtccaatgcttaattttacactatgttgcatttcagcggaaccatgactgctgttggaagtcgacagcttacactctcttgtgtgctgcaaagtaagaaaagcataagctttgggatcagacacactttggttccagtcccaggtctgcctctcatctacctaatctcattgaaacagattccttaggaaaaaaactgtcactgaaatacctggatctgagtattccacccatggcatgtattagatcactttccccttgaatggtacctctcggcatatctatacccaccacttgaaatcacttctagaacattttatgtgtgtcctgatatttgtttaatgcaaactccattttgctggtattggttacaaagcctgaaataaaaagtcttcaagcccacattatcaaatacatgaaaataattcccataatttgcaaaatcatcaaaaaatttctcagctataagtacaacctatatacagatgactaccaaataatgtatctagccaggattgttcccctaaacttcagaaccaaagttcaatggtgtacttgacatttttacatggaagtcaaattagacacttggcagttcctgatgctccccaaatgccaaccagctcctcctgccatcttctccaatctctgtcagtgggaagtctatcctttccattgttcaggccaaaaagtttgatgtcactctttaatctttttggtctcactctttaattttctcattgtttaacacacaatctgtcaacaaatcctgtcatctatatcttcaaatatatccataatctgaccattttgtattacctccactgcacaaccctgatccaagtcaccattatctctagcctgagttactataatagccttttaactgatcttcctgcctctactcttgtctccctacaatttaatatcaatagagcaggcaacttgatcctgttaaaacctgaaccagataatgtcattccttttctcaaaatgctccaagttttcccatctcattcacagtaaaaacctaagtccttactagaaccaacaagtttctacatgattcaggccctctgctccctccctgatttcaccttctattactctctcacttactaactccactccagccacactgaccttactccacgtgaagaagaacatgctggggctctttcaaggcctttgcctttggttaatcctcttaccccaccaacctcatggctagctcctttacttcctctatatcattttttaaaagtcaccccttgatgaagtcttccctggtcactctaataaaaaatttcaactgttttccctccctatgacattttatagtccccttccccggtttacttttttctccttgtcactcacatccttctaacatatttataagttctatcttgtttcatttcctatctctcaaattagaactccatgagagccgagatttttgtccatattgtttatttctacatctccaagttcctagaagcagacctggcttagaaaaggaggcccaaaaaatttactgaatgaacttaaaaagtgtctagttgtctgtggcctcatactggatgcccatcatagacatctataaatacacgtatgcaagttcataaacatgttgtaaatcactttggtactttttacgtgggaaagaaaagttgatataaatgattaatagaaatataaagagattaaccttcagctgtgtgttaatagtggaaagaacaatgaattaattcagtagatctacgttgtacatttttactagctgaatgactttgggtaagttactgacccctgtgaacctcaattctcactggattatagaaaaaaatgttttttaagaaagatagtacccttctctcagagaactactgtgagacccaagtcaaataatatatgtgaaaataaataaactataaatactatacaaatgtgcgatgtcattatagttattaccatactctgtaagcataataagtattaccaccaccaagaggtaaatgaatcatgaaaatgtaaatgtacaaattatatgagaaaaaaacatttaggtacattaagtatatgtgtgtttgtaatacaatctaaaattgcctgcgctggccaggcacggtggctcacacctataatcccagcactttgggaggccgaggtggatgggtcacttgaggtaaggagttcgagaccagcctgcccaatatggtgaaaccctgcctctactaaaaatacaacaattagccgggcgtggtggggcatgcatgtagtcccagctacttgggaggctaaggcaggagaatggcttgaacccgggaggcagaggttgcagtgagcccagatcatgccactgcaatccagcctgggtgacagagcaagactccatctcaaaaaaaaaaaaaaaaaaaaaaaaaaaactacactccagaagtgtacttttttggttttgttaaaaacaaaaaggaacactcatgtaaaatagaagccttagttttcaactaccaggtaaacttttaaagtaaactacataaggagttggattctcttaaattaacaaatcgcctttatcattattccaaattgacaagcccaacccagataggaaactctccattatttgcaaaacaaagaagctatcccaacagccacataataagcaaactgcatttgatttaaaaggtcatctgaaatagcctagtggcttagcaacagtgtttggagttgctgagagacctaagatgcacatggacttgaatttcttggtcctagacatgtgaaagctaaaccagtcattggaaaatctacaaaaaaaaaaaaaaaaaaaaaaaaaaatcctggctttcatgagaggatctagatgcctgggtaaaattcccccaacagggagcttcacttagtcactggcaacaattaatttgcctgagaaattatgttaaactaaccagctcctcagggactcccttttggatttatactaaaataactgaaaatgactattggtaaaataatgcctacaagttgggaaagacaataaaactccccccaaaaagcaactgtggaataaaaaaagaattgctgtaatgagactattaacaggtaaacaaatgtttactgattgcctattatatatcaggcactgattgggcacgggactccacagtcaacaaaacagacaaaatctctgttgcttacttccacaataatttgttccttgaaataaccctgttaggtactcattattattcctaactaatatgaattggcaatttgcccaaggccacgcagctaattcagggaagaagaaaaatggcatcaaggtctacctgacttcaaagccttaacagaaaaatctccaatccaacagttaaagattaaacttcccaaccggaaaagcaatcacacttggattcatgtgaggcagcctaaggagaggcctggaaacaaagattaagatactttccacagggctccttggacactttctttttttttttaattatactttaagttctgagatacatgtgcagaatgtgcaagtttgttacataggtatacacatgtcatggtggtttgctgcaggcatcaacctgtcatctacattaggtatttctcctaatgctatccctccccaaccctcaccccccgacaggccccagtgtgttatgttcccctccctgagtccatgtgttctcattgttcaactcacacttatgagtgagaacatatggtgtctgattttctgttcctgtgttagtttgctgagaatgatggtttccagcttcatccatggccatgcaaaggacatgaactcatcctttttatggctacatagtattccatggtgtatatgtgtcacattttctttatctagtcaatcattgatgggtatttgggttagttccaagtctctgctattgtgaatagtgctgcaataaacatacatgtgcatgtgtctttttagaatgatttttaatcctttgaatatatacctaggaatgggattgctgggtcaaatggctctagatcctggaggaattgccacagtcttccacaatagttgaactaatttacactcccaccaacagtataaaaatcttcctatttccccacaccctctccagtatctgttgtttcctgactttttaataatcgccattctaactggcgtgaaatggtgtctcattgtggttttgagttgcatttctctaatgatcagtgatgatgagctttttttcataagtttgttggccgcataaatatcttcttttgagaagtgtctgttcatatcctttgcccactttctgatggggttatttgtttttctcttgtacatttgtttaagttccttgtagattctagatattagccctttgttagatggacagattgcaaaaattttctcctattctgtaggttgcctgttcactctgatgataatttattttgctgtgcagaagtctttagtttaattagatcccatttgtcaattttggcttttgttgccattgcttttggtgttttagtcatgaagtctttgcccatgtctatgcttggacaccttcttactcagcaaccagaaatgtttcacagctagtggtcatgaagtacacagaacagacacacctatggctgttcttttactttgggagtgctgtttcttcagaaaagtaggagaattttgaattttttaattacttaatttttgcattgtatttctcatacctaccaaactatagaaaaagatttctttgtagaagtagacttgccactgctaaaagataaaccagcatctttacacagtcttgcctttaaattttcacatgcttctgaagccttcctgagctgtgtatttcattcatcatccttatcaacaaccggcacatttactgagcattcattatgcgccagtcactgtagcagatgctaaagatacagagatgattaagatgaagtccctgccagtgataaattcacaatctcatggggcagatagaaacgcaaacaggtaactaccacatggagtgataagcggtatttacaggtgctagtagaagtaagggggaagtggaaacctatcctcccttatggaatatttcttggagaaggtatgaatcttaaggaaaatggaaaaagaggatgagaaaggacattcagggaccatttcatgccagttagaatggcgattattaaaaagtcaggaaacaacagatactggagagggtgtgaggaaataggaacatttttacactgttggtgggagtgtaaattagttcaatcattgtggaagatagtgtggcaattcctccaggatctagagccatttgacccagcaatcccattcctgggtatatactccctttatgttctgtggctagaacataaagggcaaggtgaagagtgtactttcatttattcattcaacaaatattttttgagcatagatatttgccagatctgggccaagtactttgatgggctaactcttttaatgcatcacaacaactttatggggtgagtggtattattattctcacttcacaaaggataagactgagaatcaaaaaagcttaagtaattttactcaagacagctcattctacctttgtatagctcttcttgaaagtcctttcttacactgagctaaaagtttcttacatggagctctaattcctacccacttacttttctcacaaaatatgcccccttctccaatgatgatgataatagtaatgatgatgatgatcatcatcatcgctttgacaatctgagaaagataacataaaaaagcaaatggataactaatatacttgtaaaaggactggaggaaacgagcttcttgcccttccacctccagccatgtaagggtgctgccttaaggtgccatcttgaaagcagagactgggccgtcaccagacaccaaacctgccagcatcctcatcttgggcttcccagcctccgtaactgtgagcgatacatttgtgctgtttatatattacccagtctcaggtgttttgctatagcagtgctagtggactaagacaaacccaaaggcttatatttaggtctttttcaaccctctcagttctttcaagttttcctatttcaaataccataaatttggcacaatttccttaaacatcctaagcagacgtatttgcttaactgtcactttataagactgagctgaagagtatagttttgaagaatcctgttgagaacaaggaatacaacgtaaggaaattaaacaaaaagcagttttacgttttccattaaagtgtctggccttttatttggggacaggtatcctgctggatggaatactatgcagccataaaaaggaatgagatcatgtcctttgtagggacatggatggagctggaagccattatcctcagcaaactaatgcaggaacagaaaaccaaacactgcatgttctcatttataagtgggagctgaacaatgagaacacatggatacagggaggggaacaacacacactggggcctgtcagtgggtggagtagggggaaagagagcattaagaaaaacagctaaggccaggcacagtggctcatgcctgtaatcccagcactttgggaggccgaggcaggcggatcacctgaggtcaggagtttgggaccagcctggccagcgtggtgaaaccccatctctactaaaaatgcaaaaattagccaggtgagctgtagtcccagctacttgggaagctgaggcaagagaatggcttgaatccaggagacagaggttgcagtgagccaagatcatgccattgcacttcagcctgggcgacaagagcaaaactctatctcaaaagaaaaagaaaaacagctaatgcgtgctggatttaacatctaggtgatgggttgataggtgcagcaaaccaccatggtgcacgtttacctatgtaacaaacctgcacatcctacacatgtaccccagaatttaaaaattaaaattaaaaattaaaaaagaaaatagaatgagtctaataagtctaataagagtctaataagaggcctttttttgcaaagtgggcagtgccactagcctaaactcagagtcaacttccaggcaaacagctctcctcatccctaaaagcttttggctatgtaccaaaggccaaatttgacttatttaaaataatctgtagagcacagtggtcagagaggtacttgcaggagcagcaatgctgccaggggcctggggctgggctgtccgagttcccatgtgctaagcccacttgagccacagccacgtccggggatgagacagtttttggtcctactatgagcaagaagaaaaagaagaatccctttatgttagatgaggaaggggatacacaaacagagaaaaaccagccgaagaagtggaaccagaaccagctgaggacaacgatgtagaagctgatgaagacgacggtaggaaaaaagacatttctgatgttctagatgacttgaacttctttaatcagaagaaaaaggagaaaaaaaagacatttgatgctgataaagctgaagaagttgtaaaggatcttaagattgaaagtgatgttcaagaaccagatgaaccagaggaggaccttgacattatgcttggcaataaaaagaagaatgtcaagatcccagatgaggatggaatactaaagacacagctctagccgggcgtggtggctcatgcctgtagtcccagcaatttgggaggccgagtcaggtggatcacaaggtcaggaaatcaagaccatcctggctaacatggttgaaaccccatctctgctaaaaatacaaaaaattagctgggcgtggtggtgggagcctgtagtcccagctacttgggaggctgaggcaggagaatggtgtgaacccaggaggcggaggttgcagtgagcagagattgtgccactgcactccagcctgggtgacagagtgagactccatctcgaggaaaaaaaaaaaaaaaaaaaagacacagctctagaagatgaagacagcaaaaaagacgatgctgtctcattcagcaatcagataggccctgataggtaggtcagaaagagactgcacatataaggagctactggatcatatgttcaacattataaggggaaagaatccagacacagttgcttgaaagaaaaggaaattcaccatgaaacctctacaggtcgtccaagtaggaaccaagaaaactcctttcatcaactttatggatatctgtaaactattacatcaacagcccaaatgtctccttgcatttctttcatttttttttgttttgtttttatggtttttggggagtttttgtttgtttgttttttgagacaagatctggctctattgcccaggctagagtgtagtggtgcaatctcagctcactataacctccacctcctgggctcaagccgtcctgccacctcagcctcctgagtagctgagactgcaggtacatgccaccatgccaactaatttttatatattttgtagagatggggtttcaccatgtttcccagaatggtctcaaactcctgggctcaagcaagccatttgccctggcctcccaaagtgctgggattacaggagtgagccactgcatccagcctccttgcatttttgttggctgaattgggtacaagtggttctacagacggtaataaccaacttgtaatcaaaggaagattcccatagaaacagaaaatgtcttgaggagatatatcaaggaatatgtcatttaagttatggggctccacccttatgaacagagtagtgcctcataaaagggctggaggaaactagcccttgatacatcaaggaattgtcaaggtgatgtcacacatgccaatcaccagacacaatcctgcagaagggcatccgactctatttcttacagtgtgaaagttgtccttctcaatgttctgttgccagtatcaacaccaggctgtcacgggcaaataagcacagctccatgccaaagctaaccaatttgctaatcactaattttgcaaattgtgttgtggagatttggctggataagtttgccatcagagtggatctaccattgtattaaaaacgagattaaaaagctgccaagttctttggtgagtagttggttggtctgaaatccttgcaagatggcaatgctcaagctggtgatatatccattgcctactttaacaactgtcagagaaatgcgacatggggtaaggagatgccttttaaaaatcattcatagacttctgtaaaatgcaagataaagttttaacagattttttcaaaaaataaaaactaaaacaaataaaagaacttctaaaagaatgacatttacaattttaaaaatagctctggttaacaggtatgtagtggcatctcctatttctatatagacttggggaaattcttgattaacttgttgctattttaatagctgacaacctaatgttcaactcaaaacatggaaattttgaagtcccagtcagatacacatggagtctgctcaattaactctaatgtgaaccagtggcaactgtgtgacttcttaaggaacagtgtaatgtagaaaaacaaacatgggatttgtagtcaggccatgatagaaagctggctttatcacttagtaactaaaacaaagctggatgagctttggcaagtgattgaacacagtgaccttcagtttccttcacagtaaaaaaggggctataaaaactacttcacagggttgttgtgaggatttaaccaggtaatttatttaaagtgcctcatttagtacttggaacagaatgaagtgggcacttcaaaagtgatgaatactgaaaattttttattaccatcaacaacaacataacaataataagacaaattaagaacaacagatgatgctttattttgtgctggagagtttttttaatatttaaaaaattttgttgctgttgatttttaagactttcataaagcacattggtaatagagcaaaaaatcctatctcttctcagcatcctatctttcaaggcataggaaaacatgacaggtagcactgttgtattctatgttgttatattgtccagcatttccctggttctgttttttcagatattctacaaatgttccaccaactgaagtttatctttggacagcaaaaactcacctgaaaacaatgtttgtgtgtgaactaatgtttttgcctccatacatagtagtgatccaggagggccttggtctcacaccccactgttgaaaacagtcatcagaaagttcctttaagttccatgagtgaggttcaaacatgtcatcgacaccattagtacaaaagggcatgactacttctgtgcaggcctaagaagcaaaccaagagagaatccaattagaaaaatgaggcaaaaagaggttaaataaattacacaaagtcataatgctggtaagtagtgaaggcagggtttgaactcaggcaaggcagcttcaacgccctgttctttacttctgcgccatataatctctcattattcttaaaaagacttggccaagaagtcacggaagtcaggattatgtcccttcatagcaaactgcttgatttcacatttattatcacatttaaccctcaaaacaactctgcaaggaaagtttattattattagtctcattgtgcagatgaaggacaaattagactccctttcttttatatgtctataaaatgcttcctttgtaggacttatcaagatctattgaaatactacttacttacttttttactacactagatttgatcatgtaccatttatctttgtatctttgaaacctagaggagtgcctgacacatgtaagaactcaatatctatttggtgattattaaatgaacaaatgaatgaacaagaaaacttgtccatagtatcacagcataaggtaacagagcccaaaactggatccaggttaggtgacaaaatcttgtgtaccctgatttttttttacagcacaactgtgtcagtgaaaagtaagttccacttggggaaattatacatatttacctgatagctccaacccagtgttcccagactgctagttgctgtctctgaaatattcaggcatttcacctggcccgaataattgtaatatacattcagagcttggaaaatattctgcagcagcagtgaatcagatacattgggatttttcaaatactggcacactacctgtcattttagaaagataaatggggaaagagtcagaatatgaatataaaatgacagtttaataacacaaagaagaaatatgattttgatctgatcataaaatattcttaagctactaactgcagtgtttaatttctctcttgggtttaatcccctccataaatgaataaacctcttcaattactccttaggctatagaaataaaccgaagtcatttgcatggtatgcaaagtcctctccatctaccatcttagcttcctctttgctgcctttgctccagcctaggaaaaccattccccaccacaccaggctccttcccctttgccctttctcaccctgaaacactgttttccaactcctctcccactccactaatgcctttgaacaccaactcatcttttacaacactcaactcaaatattacctcctcttcaaggccatccttgcctatgtttccaagttgggaagaattaaacctctcccttcttggtgcctccattataccctgtacctatttttatcacagcccctgtaatgctctacttcactcacttgatttcagaatgtctccctcagtacttagcaaggtatctggtaagtaaatgtttgctgaatgaattactatacttttataaaaatgcaaaatttataaaatctcgtatggaaaaactataccaagttccagcatctgtcgtgtgataaaaagcatatgctgcaactccccagctcccaaatattcctatcactatcctataaaaaatgcctggaatcctagctataaaaatcagacaatattcagggttaggagtaaaggtgaggactgactaaacagagccagtgcaaactttcttgggtacagaaatattctatatcttaatagggttacatgaaaaatgatataatttgtgtatttcatggtatctagatttcacccctccaccaccagaagaagaaccatacacaaatattgaactcttgttaatgataataaagctgaagtatttaagaggaagatgtctgcaatttactttaaaattcattttaaaataggataaattaaaagatagatgaagtgatggataggtgaatatatatgtgacaaatcaaatataataaaatattatttattgaatttagatgttaggttcatgagtgttcattgtccaattattttaacttttccatatgtttcaaacttttcataataaaatgttggagaaaaataacaggcaatggaatcatagctgaataatactaacaacaacaacagctagtaattattaagccttgggtttccaaccaatacaccatgtaatcttcaaagaaccctatcagatagatgattgtccattattttacatgaaaaaaaaaacctgattcttaggttaagtcatcttcaaggtcactcagttggtaaataatagggcctagatttgttcccagctgtctctggttatgaaatatacatcttatccattatgacacacagcttaggaagtgtccacctgtaaaactacaaatagtcccagtggcaaggcaaacccagtaagcttgaatctctattgactctgacatgaattcagtaatctggtccttttccatttcatacggaaaagattatatatataatagactagtcctgacaaaaaaaagactagtccagagaagaagccaggaaaggagcccagtcaccccacctcagggagagagattctgggcagcaggaataacagggcctgggctggggacatgctcccagtcaggaaaggagggtactgagaaaggatgcaaccaaacccagcccctcatcacagttctgcctggcaccagctgccagcgggggaaaaaaaaaaaaaggaaaactgtaaaagagaaaatgaattttcaggaaaattcaatgcctctccccaaatatattctgcaccacaatatttccatggaatgtttattggtactttgtggaaaaatgtttcctagccagatagttttgagaaactgtatattagcaaatgtgaacagttttcctgactggttgttattattatataatctcagatgatttctcagaacctttaacatgctcaaatgtaatatgactttccaaaggaagatggagtgtgcatcattgccaaaagttttcagaactgctgaatgtgagaaaagtcagaaattaagatgttcaaataattggatatatctttcaaaagtaactgtgaggtcataagaataaggaataccagggtttaggatgtacatgaagagagaattgagctaaactgagagctaattaaaagtcaaaatagtgtttattttggcaactctcgatttttcatggtaagtcaaaaaaatacctaacatttgcatggcacttttctcagaaaacattcctaggaaatatgtcaataagaaataactcaagacaatatggaaatcaagaaacaatcataagatatattaaaccatctattgccaacagttgatcagcattctttcctgaacctggacatagattcagctctttcaaaatgcagcacataactacaaagtagacacatggaatgcagagaagcgccttatgttcaaggacagcatggtagatggggaagggcgacaatgcaagctgggcagggggagaggaggtagtgatgtgcagcaacaagtggcccaaaactctggaaaagaacagtagcaagtgagtgtgactcacatgctggcatcagagcccctcttagagcttagaacactgggcctctgtcaggcaaagaaaaggagtccctatgaatagccatctccacaaatagcagttactgtcacttcttaaaagacacaagcatggctggagaccggcactggctgacaatacttgggtttcagcagccccagttacacagagagaacatcatggtcagagacttggcctctgtatgatggaattccaagtccagattaagggcactccccaggcactgtgctctgtgaggtcagatcacccttggagtactggatccagctttgtacacaacttacgaagggcaccgaccaacattagaaaatctagaagagagcaatcgggatggggagctgaaaaacagctgaagcaaccctaaaattgggtcattccccacctttcatcattacaaataaggctacaataaatacccttggggctaaatctttcttatattcttaattgttttcttgggataaattcttaaattactggctcaaaagagatcaacatgtttaaggcccttggtacatcctgtcaaactgccttatagaaaggaagtgctgatttttaattctactactatgctagatagaaagcctgaaaaaatgtcacttaaaatttttttgcaaaatatttgcaaatttaatatggaaattttattttaggtaagtctaaatttcctttctaactcaaagattttgtgagtccaagcatcatcctctaccattaaaaaacagaatctctaatatctctttgcacttccttaacaattttggtagcagagtgaatgaagtttcaaaaaaatactgaagtcatattagccagacctcagcactattcctatgcttatttaaagactagagtaactcaatgccaggcacagtggttcatgcctgtaatcccagcactttgggaggcccaggcagtaggaccacttgaggccaggagtgcaagaccagcctgggcaatatatcaagtcctcatctttacaaaacattaaaacttaaccaggtgtgatggcacgtgcctatagtctcagctactcaggaagctgaggtgggaggattgcttcagtcaggagttccaggctccagtgctatgatcacaccactgcactctagcttgggtgacagagtgagactccatctcttaaaaaaaaaaaaaaagacgagtagtttaaaaggagatattcacatacttttatcaaataactgtaggatgcataaaatacataaatattaaattgaaccatatgaaattctcacatttataagtcaaaaacagtcaaatatcaacaattttgtcttaacctcatataatactttagcttaaccctgataatgtgcagatattactgacgtgacaaaagcaagcacttggcctgttgattgtttacatagaggctgtgatataatcagacaaccatctctgtccaaaatactcaacacccaggtatccctgaacttactttctatttattttgtgagccctagcaaacggcttcttctaaacaatttctacataaggcgtgtcattcctacacatactgtaaatgcgctgaaatgtgaatagctgggactgaggttgctagtacaactactgaatattctttgatggcagggcaggttctttcctcacaataaccaagagagcaccatataatgatcattcccatttcacagaagagaaaacaagctcagaggtctggctacagatacacaatttaaaaaccatgaatgcaagaagcgtatgattgggttttcatgctcacgtgtgaaatggaccaccctcaaacctggttatgctatcagcacattacctgtctgatgtgggaaaaaaaaaaaaaaaaagcactatgaatataggtctcaacccagacgtcaaccacaaagtcctggtataatcatctggtttcccaatattacataataataatagctattattatttataactagcatcaatttagtgcttttactttataccagatgctatgaaatactcataacaaccctaataagcattacaattgttattatacacattttgcaaatgaggaaactacagcacagagaggttaagaaacttgcccaaaaccacacagcaaggaagtggcagaactgggattcaaatacagactctagtaatcccagttactcaggaggcttaagcaggaggatcccttgagcccaggagttcaaggctgcagtgagctaaaatcatgccattgcactccagcctgggtaacagaatgagaccttctctcttaaaaaaataaataaaagaaagaaagaaagaggccgggcgcggtggctcacgcctgtaatcccagcactttgggaggctgaggcgggtggatcacctgagatcaggagttcgaaaccagcctggccaacatggtgaaaccccgtctctactaaaaatacaaaaatcaggcacagtggtgggtgcctgtgatcccagctacttgggaggctaaggcaggagaatcgcttgaacccgggaggcagaggttgcagtgagccgagatcatgccattgcactccagcctgggagacagagcgaggctccgtctcaaaaaaaaaaaaaaaaaagaaagaaagaaagaaagaaaagaaaagaaaaaaacacaaatgcagactctctggagcttccaaccactgtaactatattgcatgtattcaactaaaagctaaaagaaaaataacaacacaaacaatgcttaaatacacctgctgtctcatgcttaattttttaaaacaattttcctaattcttagatcatctttatatttttctaggtttatttgttttggcaaaaacttagaatgaattttgtggcaatatgaaatcataaaacattaaaagtatgtaatagtaaaaaaaaaaaaaacaactgtaaaatagtagagtgatacggcatttcctagaataaagatgaacattcaggaaacagaaagagcattagaaagtccattttactcattccagttttaaagtgtatagaaatagttgagaaaatagaacattcatgcaaccttactaccaaactaatcagatctgcaaccaagtatttcagttctgccctttaatcccacatgcaccagacaaagtaaagataatgatttgtttaaaagttttaagtgttcctacctatgagagtacacatttaaataagagaaggaaaagggggtcaaagaaaattttttaacagaggaaggaaagaagatatgttgggggaaaaaaaaaagaccaatctcctctcagagcatggtccatccacattagagaaaggattaagcagatacattcagcttttctaacagattttctttctctaaggcttcaatacccctctcacactcactcagataatcacattagttttgtcattaaaagctcccttttcatagaatgcacctaaaccgcttaaaccacccagagaggtcgcatacattaccaaacaccaagacaaacggaagagatttttccatcttatgtcattatttcactatatctatctacatgcacagcagcctatgctgaaatatttgagaagttatcagctgaaatgtgattccaaaattaacaaattacagcatcctttaaagttgctctttaagctgggaagaaacctagtagttttcatgctgacagaacagtcaaatgacagaggggttttctgtttcccttttctcttcttccttgtgttctaccagccaagtccatgattatttctgcatgaatgttgcagcttctgttaacagtaaacaaaagcaaatggagtctgagtgtgcaaagcccaaagacaaattaaaaggaacgatacttgaattgacacggaaaatggcatttagtcgctgcccatggatccttcagaactgtacaaggtcccagacagaattggaaatcacctgctttttttcataacctaactgttacatattatctcaccatcctaagcctgagttacagactcagaaaaggacgcctgtttgtcagccctttaaaaaggaggaagtgtatcagagggaggaggagttctggttaaatggaactatccaagtgaaagagcagtccccaactgggtagtgttccagggattagtgggttgggagaacacagaggggggtcaaaaaaaggagaaatagaatgaacagtgaaagaaagtgatctgaagctacaagtttgggagggagacgtagtggaaaaattctgaaaatcagatgggtaactaactataggatgaaattggaaacagaggcaatggaatttctcaagcagggggcaagagataagattacttctggtggggtgcaggctggaaacagaatcataaataccagcaatcaagaattccttgatctgtcaaaagaaaggataatgtcagtaagaaataactgaagagaatgacaagaattaatcctggataaaagaagtaaagggtgactgtgagggaaagacctaaagatatcttaccttaaaaataaacttttataatgcatatatataaagcataaaaggattgcagtaaatcaaaactagatgacaaaatatttgaggtatactctgctggttttgagtaattatttagaagaacaaaggataaaatatttattcacatgtaagactgaacagcaaaatatcccaaaatgaacattaaagaggtagggagaaaaccagttagactgctcactattccaaattgtggtacaccaactaacattcaacagctatatttctccagcctttttctagataagtggttagcaaagtacaaaccccaggccaaatccagcccactgcctatttttacaaataagttattattggagacagccatcctcaattgtttatgtattacctatggctactttcatgctacaactgcagagttgagtaattgtgacagaaactatatggctcgcaaagcctaaaaatatagccctttgaatgcagaaagtttctcaacctctgttctaaataatgagagaattccccatatgtttttatcatctgacaactcattcattcttcaagtgagaataaagatacaaatgtaattctcaccttgtacacagatagatatagagttaaatctgatagatgtcaccctgtgagcaatggtcccctcaatcctcagtcaagtttcctcctaacccagtgcaatgcagtagatgatcagaggctctgaacagtgaagacccaagttcaaatcctacttctaccacctcttagttgagctttaatttcttctccataaatcttggattatacctctttttctacacagtacttttaaaagaatttagtgagacagcatacatgaaagcgctttgtaaatagtaaagtaatatggacagataaagcattattagcacatagatgtttatggagatgaactagtttagatttagtttttccctatcattttgatccaggttttcttttctttacttttctttttttgacgcaggatctagctctgttgcccaggctggagtacagtggcatgatcacagcttactgcagccccaagcaatcatcccgccttagcctcccaagcagctggaactacaggcaggcacccctatgccctgctaatttttttgatttttagtagagatgaggtctcactatgttgcccaggtgggtctcaaacttctagcctcaagcaatcctcccacctcggcctcccaaagtgcagggattacagggatgagcgaccatgccaggcctattgatttaggttttctaacataaaacatgatctgctcttttcaacaactttgtattgttgaaattcattctaattcaatatatacttacctctggcctgctatatgcaatacactcactggtcattctactttttaaatgaagaaaaataatagcaaatgaacttgtttaagttacaaatttttaagcaaggtatacatgtaataattcaaaggggtggttaaattaaaagtgcatttgaaacccggctctatatcgccaattctattttcacttccaacactcattctagctgaagagttggttatattctctaaatttaaccatcaagttggccagcctttgtttttaaaactaaaaggaaagctctttacaaagaaatgcttaaaatgaacatacacaataaataattttgacatgaaaagaaccttaaaatttatactgtaatgtgtccttatactttccaaagtgtttcacatccaacattttattagatcctcagcacaaccctatttggtatgtaagtactgttattcccttctacagaggaagacgggatggggaaagaaaagcaccttgcctaagatcacacagttggtaagtgaagcagcagttctggaccaaaacctcactttcagaatctaatttgatgttctttccactctactgtgctgcatggggtcactcttcacactgagggtagcacctacaatgctttcgcagctgactagatcatggtgctatgataatgactgccatttattaagcatcaaccatgtattacatagatggaagttacacatatatcacaaagattaaatacattatacatgcaaagtacacagcccaggatttggcacatagtaattattccattaacagcaactttaggtattatttctaattcgtacaactctataatcaatgaattctatctccatttttcaaatgaggaaactgaggctcagaaaagctaggtaacatgtccaagcccacataatcagaaagtagcagaacccaggattccagctcaagtttgacaaactctggagcccctttgtcactgggactttctctgaggcagaaagtcagagtatgcacattaaaaaaaaagtgtgttattaaaaaatgatgacaggacattttcctattaccttgataggccaagcaggcaaaggctgtaaaaagttagaggcataaggatagtccaccattgccagattcacccaggtttcagagatccagtctttcaaatgttggatgtcctgagaagttaatgggctgcataagtgaagggctccagtaagccactgcaaaccactgcctgggaatagaatcacactgttggaatctaaaaagtactggtcaacagatgtctttacagatcatttattcttcacatagtattttagaaaactcaatcttttataccccttctcccaggatattttcagagcaactggagaatcccatgacagacaagttgcctatcctcatagagtttaccataattagtattcagaattattctccctttttaatatactattaaaatgaataaataggaacactatagaacaacaagaatacataaactacaacttagtaaaacaaatggatgtatctatcaaacagtgctaagcaaaagacagtagacacaaaaaagacatgctatgtaattccaattactaaaacatttaagaacaagtaaaaattaatctatggttctagaagtgaggatgtttttgctgggtaggtatagaggtagtgactgaaaaggcacgaggagatttctgagatgctgacaacgccctttactgatttaaatgctaattatactgtgtccttgctttgtgaaaattcatcaagctacgcattttgatttgattttgatttgtataattttctgtatgtacattatactttaacaaaatgtttacttaaaaagcgacaactactgaatttaacaaatgaaaggttaaaaaaacacacaattccattctcttaattaaagcttaccagtatttgagagtcgattaatggcatcccaggacctgtggatgctctctgaacaatgtggaccgcttttcctaaaatctgtagttacgatcttcataaatacaccacaaggtactaaatcctcaaactgccagataggggcagaagctgcaagagctctaaatggcaagaaaatcaaagaaagaaaaaagaaaagaaaaaatatatatatatattatatatatgtcatctaaatcaagttttaaagttgaaacataataaaaatattgagaaaaataacacagctgttaatgagacagaagccagaaacctcagggtaatggcatggaacatgttttacccaaaatgaatctctaagtttcccttgataatcattaagaaacgttcatgtccagtacaaatgcacttacccaactaccatatgaggatatttcatcctaaaccaggcggcaagcatgccaccataggagcctcctatggcaatgacaggttgattttcagctcctgggattgttcttttcaagtgtttgattaactctgcaaaatcagccagagcttgttctgatgtcaggaaattcaagtgtctggaatcctaaagaaatataacaaagaacacgggtataaatgtgcacataacagcagcttaggaatagcatggatccagaagagagccagtgtcagataagcttttctctaaatagaatttctaggcaattgagctaaaatgcctagtcaaagcaataactgtgtggattcaaactcatgaaaatgattttaagtttgtggaagaacataatgtattttgtatgcaagtagattgtagaaacaacagaaacaaattgtaggtaaaatttaatagcaaatgtgatcgaatataaactaagcttaatagataactgttataacttttgttttaaatcttggcacatttaaaatgtctgccacacaggcaaatataaactaaatctagtggacaattgaggtaagaatcaccagtaaaaataaaactcacccttcttcatcggaaagattatatatgacctcggccatatcaacaactgaaacaaagtagcctgcctattttaaacaattataaaattggaaagaaaaaaaaactattttcaggtattggaaaacaggcaacatgagacattgatctttgagaaaaggaaaactcataatgttaagtttcataaacatcctgctctctacatgaagacaatttccctactgcagaaggtgaagcccagtgtcctgctgagctgagaaggctaagaaggtcttttaaaatatgtctgcaaattcttgacactcattcctttaaaaggtgaagcttaattccactccctttgaacttggatgggatttaatgacttggttctaatgaatagaatggggcagaaataatgatatgtgactaccaaggttaggtcattaaaaaaacactgcagcttccaccttgctctcccgcactgccaactttgagggaaattagctgccttgtaatgaactcaagtagacccttaactgcagcctcttgtcaacatccagcaccagttttatctcgtatgtgagtaatcctccatatgagaggctctccagccccagtcaagacttcagatgcctgcagcaccagctgacatcctaacctcatgagaccccctgaaacagaaccacctagctaaaccactcctaattcttcacccatggaaactataaagtaatagatgtttattgctgttttaagccataaggtttgaagtacatctttactagacaacgaatacagctacatacctctattaggctaccctgtttgactttcatgctttggtctcaccatcctgatttcttccatcatctggcatattactgaatcacatagatcccatctttcctatctcctatatatgccacctactcctttagctttcccccctcttccaagatgtatgccttcttacctcctctctccctgtctgtcactatcctttacttccagtttttatggcactctgtacagttgagtgcattttttttctaatccttgcataatatctataatatccttcatgctactgacatattctgtgagcacacaaagggaaagaagtatatcaaaaagagcccctggctccattttgctaacacagtatcatttatagaaacctaggagaggaagttatgttctatctacaacaagctaactgcttcccagtggtttcaggacttgtcaagtcccttaatcagatatttacgcaaaataccaagctaaagaatagaatttcccatacagctcaacaaatatcagcaaatcatcccactttatatttataacacaacatttttacttatttttactattgtatttatttataatatgagatagtaaaatatcctttttaaaaataaaaactcctttcaaaataggcagcctagtaaaggactggccccaagtccttctagctgagagttcccaaaagcatatgtatacactgatggtattaggaagcacacaaacatttttaatggaacatttattgcttcattttagtgtaatttgtaaagaataaccagtacacagagcccttggttaagataatgctaagtttaaaaagtgagctgattaaagaaaaatattaggtaaataatagtacacgtggcaaattaatatagccaaagtcacaagtgtagtagtacatgaatgactcagttgaagaaaaagtgtcctggtttattaggtagagtctgtgacaaaggccaaagctcctgtgagaacaggaaaggctgaaagggaatccaaggggccagttggccttaatgcatcatacagcttatttgtccttattttattgattttattttattaaaaacatcttatcagataaatttgttatgctcattatattttttccagtggcaggctcaataatttaagtgtacgatttataaagcggaattgtttactgatatttttgaaataataaaaagctccctgtgctgtctctgcagccacagagtaaaatttaactttctgaggcacacagagttaaaaactgattaacattaagaattataataaaatggcttaaaaaaaaccctcagtctgttcaaattgtatctaaaaagaaactattaaatataaactattgagcttttaggcatttcaaatttaagttatctcacagtggggcatataatttagaaactattctaaattgaaaagaaaaagcttgtaacttttaagtaaaaagtatctttaccttgaatgagttgtcaccaaaggggagagactctccatagtatcgatgttcagcaaacaccaacatagctttcagttcctcagccacatcccacatgaacccctaagaagagtttacaaaatcacaggataaaatcagaatgtgaaaaaaagtcactgaaccttttggcaaaccatatggaatagatgttaagccagaacaaaaagagcactctacaaagttgcacaatttgtgtttgttccacaaataaatgacataattgatgtcttattgttgcatatcaatctcacactttatgagtgaaacaattaaaaataatcccaggttgctcatccactagtcatccacgtctttttatcctgacactctagccctagcatcaacattatgtctaaaatggtcttcatgtacaaagagccagtacaaatcctactgaaattatttttaaataaggacgagggcctcttccctaactcattctatgaagctagcatcattatgatacaacacctggcagggacacaatgaaacaagaaaacttcgggccaatatccctgacgaaaatagatgcaaaaacccttaacaaagctagcaaaccaaaatccagcagcatcaagaagttaatttaccagaatcatataggctttattcctggatgcaaggatggttcaacatacacaaatcaataaacagaattcaccacataaacagaactaaaaaataaaaccacatgatcatctcaatagatgcagaaaatgtattcgacaaaattcaacatcccttcatggtaaaaattctcaaaaaagtaggtattgaaggaacataccgcaacataataaaagccatctatgacaaacccatagccaacatcgtactgaatgggcaaaagctgtaagcattccccttgagaactaagacaaggcaagcatgctctgtctcagcactcttatccaacacggcactggaagttatagccagtgcaatcaggcaagagaaagaaataaaaggcatccaaacaggaagagaggatgtcaaactgtctcttttcacaaatgatatgatgctatacctagaaaccccacagactccaccaaaagacttctagaagtgacaaaacaacttcagtaaagtttcattatcaaatttaatgtataaaaatcagtagcatgtctatataccaataacaatcaagctaacagccaaatcaaaaacacaatcccatttacaatagccacaaaaagaatgaaatatccaggaatacagctaaccaaggaagtgaatcatctctacaatgagaattacaaaccactgctgaaaggcatcagaaacaacacaaagaaatggaaagacattccatgttcatacataggaagaatcaatattgttaaaatggccatactccccaaagcaatttacagattcaatactattgctatcaaattaccaacatcatttttcacagagttaggaaaaaaaaactattttgaaatccatataaaacaacaacaaacaaacaaacaaaaaacttgaatcaccaaagcaatcctaagcaagaaaaacaaagccagaggcatcacactacctgacttcaaactatactgcaaggctacaataaccaaaacatcaggtactggtacaaaaataggcatgcagaccaatgtaacaggatagagaatccaaaaatcaagccacatgcttgcaacaacctgatcttaaataaagtcaacaataacaagcaatgggaaaaggactccgtattcaataaatggtgctgggataactggctagccatatgcagaagattgaaactggaccccttcctttcaccatatacaaaaatcaactcaaaatggataaaagacttaaatgtaaaactgaaaactataaaaagcccaaaaaccccagaagaaaactgaggaaataccattctggacatcagccttggcaaagaatttatgactaagtcccaaaaagcaattgcaacaaaaacaaaagctgacaagtgggacctaattaaactaaagagcttctgcacagcaaaagaaactatcaacagagtaaacagaccacctacagaatgagagaaaatatttgcaaactatgcatctgacaaaggtctaatatctagaatctataaggaacttaaatttacaagaaaagggccgggcatggtggctcacgcctgtaatcccagcactttgggaggctgaggtgggcggatcacaaggtcaggagatcgagaccatcctggctaacacggtgaaaccccgtctctactaaaaatgcaaaaaacttagccgggcgtggtggcgggcacctgtagtcccagctactcgggagactgaggcagtagaatggcgtgaacccgggaggcggagcttgcagcgagcccagatcacgccactgcactcgagcctgggcaacagagcgagactctgttcaaaaaataataacaataaaataaataagtaaataaatttacaagaaaaaacaaccccattaaaaagtgggcaaaagacatgaacagatacttttcaaaagaagacatacacaaggccaacaaacatgaacaaaggctcaacatcattatcatcagagaaatgcaaatgaaaaccacaatgagataccatctcataccagttaggatggctattattaaaaaacagtaaaaaaataacagatgttggtgaggttgtggagaaaggggaatgcttataaactgttagtacgatataaattagttcagccactacggaaagcagtttggagatttcccaaagaacttgaaatagaactaccattcaacccaccaatcctcactactgggtatatacctaaagaaaaataggccaggtgtggcggctcatgcctgtaatcccagcactttgggcggccaagacaggttgattacttgagtccaggagtttgagaccagcctgggcaacatagtgaaacccttttctctacaaaaaataaaattaaaaactaaataaaaatttaaaataaaaataaaccattctaccaaaaagacacatgcacttgtatgttcatcttagcactgtttgcaatatcaaagacacagaatcaacctagatacccttcaagagtggactggataaagacaatgtggtctatatacaccatagaatactacgtagccattaaaaagaacaaaataatatcctttgcagtaacatggatgtagctggaggccattatcctaagtgacctaatagagcaacaggaaaccaaacactgcatgttctcacttataagcaggagctaaacactgaatacacatggacacaaagaggggaacaatagacactgcatgactactagaggggctaatagtgcagggagtgtgggtgtggggcatgagttcaacaactacgtatcaggtactatgcttactacctaggtgatgggatcattcatacaccaaatctgagcaacacacaatttacccaagttaacaaacctgcacatgtaccccctgaacctaaaataaaagtcaagaaaaaaaaacacgatggagagaaaacaaattaaataaaaataaaaggtaatttcaactttaaaaaaaaatgggccaggcgcagtcgctcacgcctgtaatcccaacactttgggaggccgaggcgggcggatcacgaggtcaggagatcgagatcacggtgaaaccctgtctctactaaaaatacaaaaaattagccgggcgtggtggcaggcgcctgtagtcccagctactcgggaggctgaggcaggaaaatggcgtgaacctgggaggcgaagcttgcagtagccgagatagcgccactgcactccagcctgggcgacagagcgagcctctgtctcaaaaaaaaaaaaaaaaaagtctacaaattgcactgtttgccaaatcttctaggaaagagctaaagatatctaaagaagctgtctactcataggcattgacaacataaaagagaaagcaaaacaaacaagcatactaaactccctagggggtttcaattaatcttctttattggaaaataaatagtagcacacaatggctaataataactgagtgtttataatgtgtcaggcactgttctaagcatttcatatgaattaattcacttaattatcacagcaatctatgaaataggcactttgattacccccattttatagacaagaacattgaggcacaagagtttaaataactttcaacattcacacagctagtaagcggcattgccaagattcaaacaggtgtctggctccagagcaccatcatcaagagctgttagatctccttgctagaaccatctatatctggtcattagccaatcacttcattttttcgcttactcagttgtggcctcagaatctgttctcaacgaagcattctaggtagtcaacatcaatcgattagatttagatttagcacagattaaaactacttgtcattcctagtgcacattgttgctttttagtgagttcctgctccctaacaaagactaagaacctcaagtgtttttgttttgatcgataaatgaacaattagaagagttatatgcatgtaaggatagagaatttaaccagatatttgtgatggtttcaataacccccactttctctcttaaggatctactcattccctgccatttatctacagatcttgcaaacacccagctcaagcatgcccacctctgcctgccccaccttggcagtgctgatcactcccccttctcaacaccactgtgctaggtataggtccctggtactgtgccgcaaaatttgcttacatgtatgtcacacaccagaccgtgagtatcttaagagtaaagatcatccattacaatgtccagacctctgtgcagttgatttcaggctttgagaggaggcaatttcattgaactagttcacaaagtaataagtgatgtatttcaggagtattcttatttttcaaaagaggtcaatgtaatatatcaacatcttttaacattatgtgcttgcaagtcccctaatcttctttaattctttacacaactctatgaaccattattactgtatccatttaacagatgagaaaactgaggcacagaacaagaaacttacctaaagtcacacagcaaagtggcaaaatcagcattcaaaccttgtctatctgactgaagccttcactctcgaccactgtgtgatgctgcctctcaacaaattaatgtccagcagtgaatgtgcactggaacattttggtatgtaaaggaaggtctctggggctgcggatgggccaggatctgctcttctatgatctgcctctagtcagttcttcagaactgttcctacactgaatatctcttcctttccaccactttcgagaacagagataccccagcaaaccttaagttctgccacagtgcctgtcagagtagtgcctagtggaggcaggaacagctacctgcctataatacaagagaatggaaactggaaaaatcactggacagggtaagttaccctgtggccttcacataaaatgaaagtcacaccaaaaggagaaaagagacaaggcagcctctgtggtttcacagaataacagaacgggaatctgatggaaaggagatttctcttgtctcctttccagaaatcagagaaagaatctgatttctcttgtcactgacctaaaagaaataggcatcctaggatctcatttctctgggaagtattttatttcaactaaattacttagattcttaacattcctaaggaaataatcagaaatgagaaatgcaataacaatgtaattgggttcatatctttactttaaattcatataccagttaaacaaacatttactgagacctcctgactaccaggcattgtgccagacactggcattagggataatacataattcattccccactttaaggtagttcacaactagctttttggtagaaagttgacatttcctagtcacagcactgacacattgaaaaggagcatttcttcctttcacatatctttccaaattaagttttgttaatggatttcggcattataaaaggtgatagaaaatatagtcagggaagcaagctaacaggctatatactacttttaaccctcacaaataaaagaaaatggtagaacaggaaagctaaactaaaatgtaactacaactttaccttttcccattcctatttgtatatttttttctcatttgcactggctttgtttaggttttattcattcattcatttaacagacatatatcaccttctatatgtcctggacactgacaatataacactaaacatacaaaaattcccacccttgtttttaccttctagagaccataatcaaaataaactatacacagtaacattcttatccgtttcccttatatgcttgttcactctagaaacaagctgagattttataaacaaaacaaagcaaaacaaaaacaaaaaacttgcaaaattcaattctctgggatgttcaggcagtccatgaaaaatacaataaaataaaataattcaattctccaaaaattgtacattattcttttcatttgtaattctttaaagctgaatatgcagacttattggatatctgtatttaattcttttatgaacttcctattcatgtgcttttgctatttttctattattagtgtgttaatttttttgttattttttacagaactttacaattaagaacagcaatgtttggtcatacatattgcaaaacatttcttccaagttatcataataaaagtcaaattgagcactggaatttcatgaatctgcacataccgtgttattacaaaaccagataatgtccccttcattaccagtgtagaaaagtattgatccaccatttttcttccagtatttatcagctactaggtaccgctgattaaaagttttcacagtattaaatccaaaatgatcaacctgtgataaaaacaaaacaaaacatatttcaaaggaaagtaataaaatgagatcaacataaaggtaattaattcttccattaaaatcaatctctactacaaaaataatcacaagaaattttaaacttcactgttttattattaatagtaatatcgatattattattttgaaatcatttccttatattataaaataaagtaatatttgctattggtgatcaagattttcaatgtaaaagaaaaaatacaattataaaatcaaatagctacttaaaaacataatgttaaaattgaattgtaaatacaatgtgaacccttttttaatttttaatgcatttttaattggcaaataaaattttacgtatggtgtatataacatgatgttctgaaatacgtatatgctgtagaatggctaaattgagctaattaacataagcattacctcatatatttatcattttttgtgataagaccacttaaaatctactcccttagcaatttttaagtatataatacatcccattatttttcaaaatacagttttccattactatctgaattttcattgtacaaactttcaatattaaaaattcatgaactaaatagactactgaaaaggtccataaaccttgtcaccccagcacaccatagatattctaagttacaagaatttcatgtctatatcattcccaccaaaagaaattagggcttattagtgaagtggctgattgacatttgggacaaggaagctgcaagataagcttatgcattttgctgtgcaaggaagcaagaaagtgctcacaattaatggagagttatatttaaagaagataggaaccaaccacaaggaactatcactggcaatcattttaataaattgaacgtaaaacaaaaacaaattaaacataaaaagaataatgactgtagttaattgaaacattcaattcatgaaactccattagtccacaaaaatatttctaaaaaggaaagaaaggaaaaggttcatttgccaccatttgtttattaaatcaactcttactctgaaattgggaattaaaaagtaaaaaattcaacatttaacctgcctgtccaacagaactgtgtttgatggctacgaatagtcccagttaataaagaagagctgtgtttagtcaaatgtcagctaatgtggaaggaatgacagaattagaatatgacagttctgtaaagttactgattcaggcaagaattatcaattggtgttaaaagcattaggaaaatgaataatatgaaaatgaacattcatatagtatcaaagtaatacaatagagaatactcgcttgtcacaaggggaaaacataactacaatggaaggatcaggctgctatcactttaatctagtaattaattttgttagtatcatcaatggtagagcacgcagggattatgtatctcctcatgtggcacaacatgaagcacatatcacctatgacgtattcctgccgaaaatgtttcatttcatcttaatccagcctttagatctaatttccaggttccaggaaatataaaggtaaaagagcaagttgaagatatttcaaagggacaacagatactgaaggtagaacattttacaagacaattgacaaggcaatatcatgagaaaggactattttagattaaatgaattttaaggaacataataaccagacataatacatgaccctggattggatcctagtttgaacaaacaagatatacacaatgatgtagggacaaatgtgtaattttaatatggactagttattaaatgatacaggttgagcatccctaatccaaaaatccaaaatccaaatgctccaaatctgaaacttttgagcaccaacatgatactcaagggaaaggctcattagagtatttcaaattttggattttcagattaggtatattcagtcagtaaccataatatgactattacaaaatcaaaaaaaaaaatccaaaaaaaaatccaaaatctgaaatgcttctggtcctaagcatttcagaaaaggaatactcaatttgacctaaagacttgttcattttgtcaaaagtgttcatattgttttggctacataagaaaatgatttcttaaacggaattttaaatatatttttgagatttctttttaccctttgagattttttaacttactatttaaaatgtaattatcaaatactataacatggtaagattcatgtacaacaatctgaatttacagatttaccctgcagcacagagtctcactgagcctttagcatcatgggggctaaattcctcagtgctttggaaagacagaaatgagaatgcagcacccagtctgggtcagacataggctgttccagcgctgctccagtctcccaggaacagtgcttagttttgacctaaaccagaccctgtaagacttgcctaggtcattctaaaacagatgggacttcctgcacccagctctatctacacacacagttcccattcataccactggtcccaaaacacaagtgtctcaaaactttacctaactgcaaacttcctggtatctatgatcatcaccatatgtagtcctaaaatatgatattctaatctaaagactgtctacttttcaggaaaataagcagtttttatggacgaggtatgtaataatgatgtccatgtgctataaacccttccattatacatgttaatttactcaatcattcactcaacaagaatctattgaattcctattttgggccaagtactaagctaagcaatgggataaagagttggctgagctgcaatccctgaatttaacttaagctaattcaactatatccactcagcctaaaaatgaaagggcaagaaaggcagacagacagtgaaaggaagacggataagtgattccacctgcttccattcaattagtacagtggttctccaggtgaggtccccagaccagcagtatcagcttcacctgagaacttgctgaaaatgcaatccccttggctgaatcccagacctacagaatcagaaaccatgagggtaaaacccagtaaactgtgctttaacaagccgtacaggtgattctgtaaagttttgaaaaccactgagttagaataagcaccaaaatagacattaatttgttattccttctcttgttctaggtttcagagtacctgaaatactgtaagtatctcatcatgctgaatgagactctggtgtctaaagatttgaattaccactgaacatacccccaaatataagctaactgtatcatttgaaactcaacatgagaaaccaccacaggaacacctttcgaaactcagcaggtttcaacaagggaggaaagactgactgtgttggacttaaagaaaggaagctcatggctctctaacaagatgccttcccatgagattcttgaagataattttgccctaatgattttcacctcacccactgactacagaactgagtcttcatgtaaactgagatattgccgtagcctttaaaagcatcccacaaagaaaaacattaataatccagtctaaaattttcagatttgaaaacatgggtatgtgtttgtatatgtcatgctaaatataactgatataaagttcttgccagagaaacacttccatctagaatcacaagggccacaagaacttcagaaccagagaaagccaaattcccttgtgtggccatgcccaaggtactcctgctcccagcaatcagccttgattgttaagattggggaaaagagagaggaaccctggcaagaaagcagacttcggagttaaaagacctgaacttgaatctcttctaactgtgaagcctcgggcaaattacttaacctctctgaaccttagtatcttcctgtataaaataaggataaccacatacaattcaaaggatttctgtgaggatagggaaaatgcacctaatgtaccaggcatagttccagatatatacgtgcttaaaagatgttagttctcctctctatcccatttgcacaccaatcctaagcacggagtacttagatgggagacagattaagttcttcacagaattacaggaccttagaatgtcaaaatctcctattttctgagtgcttcacctaggtgctaaacaactggaaatacgtagtgaaatgttctttgcacaacatgaatttacagaatttccttggctccttcctatcatcaaggatatcaacttctggctagataactagatagttttcaacacctaatggccaggcacactaggggcagcatgccctctgctgttgagaagtgggacccacgtgccactccctgttctgggctcctgaataaagattttatgaattacaacacggaaaggtcacaagggccttagaaaccattccgtctgtgttgctcaactgaagaaattaggctcgaagaggtcacatgacttagccatggtcacaaggcagaggcagagctagaactttatttttgcagtttggtttattgaaccaattaaaataaataatagcatggtaaagacaacaccgtatgaccttggaaaggaaacaaacctctctagtcatgcacagcagttctttctagcacgtggtcctagaaatttcattttttcttttttataattttttttatggcccaagaaatttcaaaacatgcttccccactttaccatgtggaggagaaatagatctgtgagaatgggtaggcaagaagaaaagagaccatcctttaaatgatgtttattgtataaaagtaattatttggactttaaaaccactcaagaataaagttcgcatccagaaaaatcagtagcaacattacatctgttagttttgatggcaacttggggacagcgggggtgggagaggtggggatgggagggaataacacagagcacctaccacgtgtctgccacagtgctgttgctctacacagatcccttcaccatctcggcagttaccctctggggccactttcatcacccagttttaaaataagaaggctgatgctcagagaggtcagagagcttgcccaaggtaatgtaactaataattaggaatcaaatgtaattcttttcatgtgcttttaacccctacccaatcccgcctccaagaaaacccagatctttatactccttgcattataacacgctcatgcagataaagctgactataaacttcaaccctcggtaggcgacacttaagagtgagtatctttctcctaaatttgcaaaatgaaggacaaatctcccagccatttactaacagttacattgcagaatatgtggaatgttggtcttttcactgacctgacaataattgttactacactactattgctaactccattaggccactgataaaaccaaaatcacattggctccttcttggcagccttcggttttagaaaattcagtatgcagttggatttattcaggcacccagacatctaataacagttaactaaaattttactaaagatacaaaaagtatacccagagatatacatgaccaaaaaaattaacttacgcctccaataaatcaaagcaccttaaaggagtttttcatgtgctctggtttccaactctaatgcagagatctaaaataaaataagaccctctttctcccatttgatgtgtgtgtcttatattaatttggggattgtggggttacattccattagagttcttaaatggagactgacagctttctgggcaagcttgatatgccctgaaaggatggacacttttatgttagaagaacacgggttcccaaagaaggactaaaacatggaaggaaggtggagtttagacaagccctagatctacagttggagaaggatggatgtctaggagtggattcctactaagttgtccctcacacatgggcaccctagaggtaggacaagatcagagagcaagccacatcttatgagtcagatctctggctcttggatgactcctggtttatttcttctttattatgtcaaggcctttcaaaaaccctgcttaaatgttctacctttactcatccatacaatgaagataccagaaagtattggagattaaatttgacttaaagaattaaagaggaaacggtatcccccagtgagtgtagtggtagcaaaggaaatgtttacaagtccctccaagaggaaggtgagtccaagaagatactgtcctcccttcccacgaagatgctctcgtcattgccaaccttagagggtcgagcttccatcttaacaaaaagggtggaagtcctctcagagatatgcttcaaaggcaatcatcttcgtatgtaataagacactgctcctctttacacatacttctataagtgttaaccaggagacagaactgcattccctgactcctatgctttttttttcctaacatgcccctaatcttaaaaatgagactcttagaaataaatttatttaaagagaaaatggtaaatgagaaagggaagcaaataagtgataatgggagagtccatcatggggaaaatttagtgccccagcctcctatactcagatggtttgaaaggcaagaacacaatagctaccacagtgcccttgtacatggcagatactttatagataattgtttttaatttttttttttttgagccggagtcttgctctgtcacccaggctggagtgcaggggcgtgatctcggctcactgcaacctccacctcccgagttcaagcaattctcctgcctcagcctcccaagtggctgggattacaggtgcccaccaccacacccggataatttttgtatttttagtagagacagggtttcaccatgttggccaggctggtctcaaactcctgacctcaagtgatccacctgcctcagcctcccaaagtgctgggattacaggcatgagccaccgcgcccggccatagataattgctcaactgatgcagtttaaatcttctaagtaagtggttcttgtgtttctgattatgaggttcccttcttaatgttaaaattatcacagatgtgttatatattagtagccagtgcttgagaaaatatgagaagctattataaattcaataatggtataaataaatatcacaacagcatctatctatgtggaaaaaaaaattgtgcttagtaaccaaatggggagagaaaacaccctctcgaaaaattctgcagtgcttaataacctttctttcctcaaaccaagaactcctgggcccagagggggaattgctaagttatcaaaatgctgtgaaaccaaaacactctttgctttactgctaaaacagaggtgaaaatatcctgccgttgagaatacctaaaatgctccagtaaatcaagaaataacatgttttgacaaataacagttaagtgtttcattagagggagattctatctgttggtcaaacagctctgtgaaagcaccacataatcaatgccttcccacggcttcaggaagctttgtactagaagaattaccgggccacagctcaagctcccaaattagagataaagtgctgctgtaatcaagcactgcatataaattttaggaaatgacacaccaccagagggcgcccttatataagtagtaaagtcggaaagaccattactttttttttgtttgttctctaagagacggggtctcccctctgtagcccaggcaaagtagagtggccagatcatagctcactgcagcctcgaactcctgggctcaggcgatcctccttcctaagctcgagagtagctgtaactaaaggcgcacaccaccacacccggtttgttaagttttaaattaagtttcagaaaatcttaggacagaaagggaacttagatctcaagtccaaactcttggataaaaaacagacacagaggccaattattttaaatctttcttttctaaataaatatattatatgttcacatgattgaaacaacaatcatcccccttctttttaaagtcaggattcaaaatctgtgctgtcagaaaccaggatattggttaccagtgcaggggaaaactgactgtaaaagagaatgaggggattctggagttaggataatgcattgttctgtatgtataataagataattcaaaagcagattgataaacatttaaaatctcattgaagatatatattattttacaagatacatgtttatatttctatttcactatacaggcatatgtaaattatattgcactaaatcacattaatattaaatttttctttcatttaaaaatacttattgagtgctcactaaaaggcaggtattaagaaaaaaactaagatacaattccatttctcaagttctggagaatctaacagaaatgattaatgtgctagtaaacaaccaagcagtggtgtggttaagttctgtatacaaagcactgtgggagctcagaagccaaagtcaccaccctgcctgaggaaattacagagggctgcaccaaggaggtaatatctgagctgaaacacagagaagaatttttttttttcaggtacaaaagagcatttcaagcaaaggaagaaaaacatgtgcaaggctatgatgagctatacagaatgagcataaattcaggaactgttgttttacggcaagaggtttatgaggggaagacatgggagatgagattagactcactgggctgccacaatggctcacacctttaatcccagcgctttgggaggctgaggcgggaggatcaaattgaggccaggagttcgagaccagcctgcccaacatggcaaaacctcttctctacaaaaatacaaaaaattagccaggcatggtgatacacgcctataatctcagctacttgggaggctgaggcccgagaatcacttgaacctgggaggcagaggttgcggtaagccaagatcacaccactgcattcccacctgggtgacagagcaagactctgtctcaaaaaataaataaataaataaggaaaaagaaaaacctaggccaggtgcactggctcacacctgtaattccaacacttcaggaggccaaggtggtaggatcacttgagcccaggagttcaagaccagcctgggcaacatagcaagaccctgtctctacaaaaaataaaaatattagccgggtgtggtggtacatgcctatagtcctagctactcaggacgctgagatcagaggatcccttgagcccagaagttcaaggttacagtgaactatgatcatgccactgcactccagcctgggcgacagagtgagactccatctcaaaaaaaaaaaaaaagaagaagaaaagaagaaaagaaagaaggaagaaaggaaggaaggaaagaaagaaagcggtatagagagacagaagaaagagaaggaagggaagggaaaggaggaaggaaagaaggaagagagggagaaagggaggaaagaaacctagctgaaatccaagattgtttctctaaaccaacagtgaatgaaaaacatccactggaaatagactcaaataggcagggacttttttctgttttgtccacttctgagtacacagtgactggaataaggcctggcatgtagtagaagaccaatgaatatatagagagtaaatgaatgcatgcatgcatcatggctctgcagttggtataaaaacaaaaatgagaatggaaagcaaagttcccaagaaggtcaagtttgtgcaggttcatttattgggtgggtctgttcccagctttggaagagttgcacaacactgtagttggatgtgccttttgcccagtgacaaatcacatgcctaatggagaacccaagccttaaatctaagagcaccacataacatttggactgctgaggaagcaggaaatgcatgccttctgctgggtgaagaaacagttctatataactacaaataatatggacagaaggccaacattgcagggagtgcaggagaaggactaatcagcattttaccaaagcatattacctaaaatataattgatcttggtgacaaggttataagtcaaagtttttaagactggaaaggactttaaagtcatggctgtcagccaggacacaataactttacctgagaaacagctttctgtaaaatgtacaacatagcagctcgttcagcagcatactagtgtttggtgaatccacatgtgctgcaaaatgttgatttgatcaatgtgtaaaatttgtgtttccaacaacagagttttaagaaggaagaaacagggaagaggtataataccctaggacaaaaagtaattggagggaatagttgagactctaggtaagtgagggatatgtgatgctgcgagatcctgggaaggaaggagggaatggggtcaatagcaccaacagaaggatctgacttgggaaccccttctccactgggaaacagatggatgcaagagttatctttctaattaccgagggaggaaactaaaaggattctagttaaaatgcctctcatataacaccttagtttttagtcaatgaagtaaagggacaaagtaatctattaaaagagatagtaaaagagagcctaggatggcaatgatttaaagacagaggtaaaagttcagcatggaagaaaaaactgatgcctaggcctccataaagctcctgaggttggagactgaattggtatgcacaataatctgccgcttagcagatatttacaacccaggagcaggagcagagaagtttaatggttggataaaactaggatgagaatgtcataaaggggttgtgagaggacagggggcaagagaattaaggtcattcctatcttcatgcagcctgaatatgcccagagctatgaggtcctgtccaccacagacaaatgctgccataatctgtttgctgatttgcaaggtaatctaaactatgctgtatttattctattttaaggagtaaataatcttgccagaactcatatatatgatatataagcatttcaataataatctcataaaaataatgtaaggctgcatatcatcaaggccttgaaagtttatattcttctgctttgttaaacataagatgatgtgttactgattttcttcctttatagtctattgttctaaatgtttctctttttttttttttttttttttgaaacagaatctgactctgtcgcccaggctggagtgcagtggcatgatcttggctcgtgcaaacttcgtctcctgggttcaagcaattctcctgcctcagcctctgagtagctgcgactatgggcgtgccccaccattccctgctactttttgtatttttagtagagacggggttttgccatgttgcccaggctggtctcgaactcctgaactcaagtgatccacccgccttgccctcccaaagtgctgggattataggcataagccattgcacctggactgttctgaatgtttcttctatacatgcaaaatattctcctgacaccactgttataactacatcacatcttctgagagatagaggctggtatctgctggtataatgtaaaaggacaaagacccctcaacctccaaaaaaggcaaaaaccacgtttctcacgaacaggagttcagacctgtgatctatgtaactcacaatccaatcttgcatactaccactcctcctgcaaagaactgtgatgacctcataaatcttctgttctccaactgagcaaccccagttcttactatttcccatataacactatattctaaagtcctcctaaccctgctcacactggattaattaacattccctcttacagatggtgtgcccagagctgagtacaatatgtaacgtggtctaataaagtgccttgctcatcactggccaggaataaataaccgatgagtgtgcttatagaccttatccatggttttgctttctgcagtttcagttacccatggtcaaccatggtcagaaaataggtgagtacagtacaacaagatattttgagagagagaaagagactacgcgttcacataatgtgtcatagttgtttattattcattattgttgttaatctcttattgtgcctaatttataaataaaactttatcacaggtatgtatgtataggaaaaaacatactatatatagggttcagtactaaccgacatctctggcatctactgggggtcttgaaacgtatcccccgcgaagaagggaggactactgtatagctccaataacacagcctactttaaattgaaagtcatgtaggtatactgggttgcatagcatccccccaaaatttatgtccttcctagaacctcagaatgtgactttatttagaaataggatcattgcagatgtcattagttaagatgagggcatgctggagaggggtgggcccttaatccaatatgactggtgttcttataagaaaagaagagacaaagaggcacagagagaagaatgccatgttaagacacagatgcacaaaagcaaaatggccatgtgacaatggaagcagagactggagtcaagcagcttccagcaaaagaacgccaaggactgccaacagccagcagaagcttagcgagggacacagaccagactcttccccggagcccggaccaggctctccccaggagtccccaagaagtaaccaatcctgctgacaccctgactttggacttctggcctcgggaagtgagaggataaacttctattgttttaagcctcctagtttgtgatactctgcagccctaagaaactaatacagaaggcctctctatggaggtggcaatggaaccgaagcctgaaggagccagacaaagaaagaactctagaaagaagaaacagaaaatacaaagagccagaggccagaaagagtttaatgtagaaagagagataagatcagtggtgaacaagagagagaatggtactggatgaggcttagcgctaagtgggctatgatagggagactgaacttaatttaaaggcaataggaagccttcaagagttttaaaacttattctgatctgtttttttttttttaaaaaaaaagaaagtaagaagaataagtagaaggctattgaaaggttcacatggcacatgattatgagaacaagccaggcttcaagccaaggtatgtctctcttaaattgctacatatttaacatatatgacaatgtttaatctccaaagtcataatacaccccagaaagatctcaatgaagaaggactcaatatatgacatcagcagtattcgtttaacaacaatcaacaaaaggaagtcttttgaacagctgtagtcaccactatagcccacttataacagattctgcagtggccctgactgtgggcattttaaacacgaaatgccccactaaattggcaaaagagttccaaggccatcaggctccccccagcatttaatagaagtcagtaaagcatattctattgctacccttttctccaaaacctattcaagaaattgatagaaggtaataaaactaattgttctcaaatgtttaggtcccgttccaccctggtgagataaaagacatcagcagccacaatcttcactggttacctctgatgaattaataaactacatgtttaaaaaagaaaaagtacatacaaacatagtattacaacataatgctaaaatacaactcttcttcttccatggagaatcttctgtgaatgataccatgagaaccactgaaacagaaaacctacaacctcttttcagagactgctttaaaataaatttttttatcacattgaaaaatacatgatgttaaagcactctggaaaattaaactttacaaaatccccacatgaatagcatccaccaaaggaagcagctgaggaaagtaatgtctaagttttttcctccctggaaactccaactcaaattcgcagtcctgatttcactataaaatgtcctccagggactttttatcattatcttaaagatacactctacagactattcattgttttgcacattcatccggtctaaatgataatggcgctgtaaaaaagataaaggaagggaaaaggatatcctcagcagaaaccaaaaagctcagaacaataacaacaagttcaaatgtaaccaagtggcttcctttgattactttcaggtggttttgccaccacgacaccagataatcaacaacttcccagagttagtgggatgtgtaagtatttcttgagtgcctaccatgggataagtactagagtataacaacagtgaacaagctagatatggtcactgcccgcacagggcttatagtctggtgacagacaacaggaaacaaaaaacaaacaagcaaatacacaaataagaacttagaaactaattgtacaagttttacctgggtgcggtggctcacacccgtgatcccaggactttgggaggccaaggctggcagatcacttgagccaaggagttcgagaccagcctgggcaacatggcaaaaccccgtctcttcaaaaaatacaaaaattagcatggcataatggcatgcacctgtagtaccagccactcaggaggatgaagtgggaggatcacctgagcccaggagttcaaggctgcaatgaactgtgatcacaccactggactccagcctgggcaacaaagtgagaccctgtctcaaaaaaaaaaaaaaaaaaagaaaaaaaagaaaactagttgtacaggttttattctgatagagaataaaagaggcagatcgacttctaacagggtggtcagaaaagaagtcctggagcaggcaatagttaagcctttaatccacacagccgtctaccctgtgaaatgtcctgggggttctattcaacgccactcccttcatgaagcattcctgccttctttgtgctttcatggtattttagctatattataatcttttcaaatgtatccttgcacagtagttatttatacatacatgtcttataaccaccatactgttataaactgtaaaactgtaaaaaaaaaaaacctgtataaaaaaagttagaatctgttgaacacaccatgtgtgttatttcttcctgcccctgtgaatagtgtaagggctgaactaggactacatgtaaataatctcaattgttcttcagaggaaccctatggagtagagaggctgtgttttccccaccatgccttactgcctctccctttctggctaatctctgtatccacaaagtgcaaaacacaatgtgcacaggccttactacatcaatgactcctgagttgaactggaagaactgagaagtatgatgtgacatctgaagaccaagtgacctcacccgaacttagactacaccagttaactctgctttaggcctgtggggctaccagcaagactgttttctttctatcagaggtgtgttagcctcaggaaatgtgaacagatcctacaattactcagttaaaatccaactcaaccttgaaaggtagaaaagctgtaaacacataggtgactataattaatactgagcctcctcagcaaagacaaggctctttcatcgttccaccatttcctgagtacttactctgtgtgccgggctatactggatacaaggataaaaagccttattttttgctctgaaagaggccacagtctaccagaggagacaagcaagcaaagaaattatttctatataaggaatgcacattatgaatgtgggtgagaacagggtgattgttatggcagcaaagaggaggcacaacccaactaaccagtggtacacaaggccgtagcgaaggcaaactcaagagaagctgataatgtctgtcctggcaccctgctcacctcttttccagcctcgtcttctaccacatggccctctcccacttcatattccagaaatgctctggacatacgctttctgaagtctccaggcttctctacatggatttcctcctgcctggaatgcattcctctctcgcatcattacaaaaaaaaattactacctcatcctcaaaatgttcattcaagtgctgtcccctctacaaagttttctaggacaaccccaggcccaaaggagaatgctccttctctgatcctatgacagcttccagaacagtcaccaccacactgtgctgtcactgttttgaaggttggctcagcacagtgaaaagagcccagctctgtagcctgaaagtcccacgttgaaatgctgattgtgccactttctagctaggtgtacctcagttacttcatctataaaagggaaaactaacttccttacaaggttgcaaggattcaaagtggtgtgtgtacaagtccctgaccacagcaaaggctcaaaaagtactcccagtgactgataaccatcaataactttatactgtggtattaaacaaaacacacacaaaagtacattacaaccatatgtgtatttttgcatttggcacgtgatatagttttgctgtgtccccacccaaatctcaacttgaattgtatctcccagaactcccacgtgttgtgggagagaccggggggaggttactgaatcatgggggccagtctttcttgtgcaagtctcgtgatagtgaataagtcttacaagatctgataggtttatcaggggtttccgcttttgcttcttcctcattttctcttgccgccaccatgtaagaagcgcctttcacctcctgccatgattctgaggcctccccagccctgtggaactgtaagtcaaattaaacctctttttcttcccagtcccgggtatgtctttgtcagctgcatgaaaacgaactaatacagtaaattggtaccagtagagtggggcattgctgaaaggatacccgaaaatgtggaagcaaatttggaactggataacaggcagaggttggaacagtttggagggctgagaataagataggaaaatgtgggaaagtttggaacctcctagagacttgttgaatggctttgacaaaaatgctgatagtgatatgaacaacaaggtccaggctgaggtggtctcagacggagatgaggaacttgttgggaactgaaacaaaggtgactcttgttatgttttagtaaagagactggtggcattttgccccaccctagagatttgtggagctttgaacttgaaagagatgatttagggtatctggcagaagaaatttctaagcagcaaagcattcaaaatgtgacttgggtgctgttaaaagcattccattttaaaagggaaacagcataaaagttcagaaaatttgtagcctgacgatgcagtagaaaagaaaaacctattttctgaggagaaattcaaaccagctgcagaaattgcataagtagcaaggagcccaatgttaatccccaagaccatggggaaaatgtctccaggccatgtcagagaccacacggcagcccctcctatcacaggcctggagccccaggaggaaaaagtggttacgtgggctgagcccagggtccccatgctgtgtgcagcctagggactgggtgccctgtgtcctagccactccatccatggcttaaaggggccaacatagagcttaggctgtgacttcagagggtgggagccctaagccttagcagcttccacatggtgttgagcctgcaggtgcacagaagtcaagaattgaggtttgggatcctctgcctagatttcagaagatgcatggaaatgcctggatgcccaggcaaaagtttgctgcaggggtggagccctcatggagaacctctgctaggacagggtagaagggaatgtggagtcagagcccccacacagagtctctactggggcaatgcctagtggagctatgagaagagggccaccatcctccagatcccagaatggtagacccactgacagcttgtaccgtgagcctggaaaagccacagacactcaatgccagccagtgaaagcaactgagagggaggctgtaccctgcaaagccacaggggtggagctgcccaagaccatgggaacccacctcttgcatcagtgtgacctggatgtgagacctggagtcaaaggagatcattctggagctttaaaatttgactgcccactggatttcggacttgcatggggcctgtaacccctttgttttggccaatctctcccatttggaatggctgtatttacccaatacctgtacccacattgtatctaggaagtaactaacttgcttttgattttctaggctcataagcagaagggacttgccttgtctcaggtgagactttggactgtggacttttgggttaatgctgaaatgagttaagactttgggggattgctaggaaggcatgattggttttgaaatgtgaggacatgaaatttggtggggccaggagtggtatgatatggtttggctgtgtccccacccaaatctcaacttgaattgtatctcccagaattcctacatgttgtgggagggacaaatggggaggtaattgaatcatgggggtcgttcccatgctattctcatgatagtgaataagtctcatgagatctgatgggtttatcagggtttccacttttgcttcttccccattgtcattatgatgttagctggttattttgctcattagttgatgcagtttcttcctagcactgagggtctttataattcagcatgtttttgcagtggctagtaccggttgttcctttccaagtttagtgcttccttcaggaacgcttgtagggcaggcctggtggtgacaaaatctctcagcatttgcttgtctataaaggattttatttctccttcacttatgaagtttagtttggctggatatgaaattctgggttgaaaattcttttctttaagaaggttgagtgttggcccccactcttgtagagtttctgccaagagatccactgttagtctgatgggcctccctttatgggttacccaacctttctctccggctacccttaatattttttccttcatttcaactttggtgaatctgacaattatgtgtcttggagttgctcttctcgaggagtatctttgtggtgttctctgtatttcctgaatttgaatgttggcctgccttgctaggtttgggaagttctcctggataatatcctgcagagtgttttccaacttggttccattctccccgtcactttcaggtacaccaatcagacatagatttggtcttttcacatagtcccatatttcttgaaggctttgtttgtttctttttactcttttttctctaaacttctcacttcatttcattcatttgatcttcaatcactgataccctttcttccacttgattgaatcagctgctgaagcttgtgcatgcatcacgtagttctcgtgccatggttttcagctccatcacgtcatttaaggtcttctctatgctgtttattctagttagccattcgtctaatcttttttccaggttgttagcttctttgcgatgggttcaaacatcctcctttagctcagagaagtttgttattgccaatcatctgaagccttcttctctcaactcatcaaaatcattctccatccaactttgttctgttgctggtgaggagctgcattcctttggaggagaagaggcactctgatttttagaattttcagcttttctgctctggtttctccccatctttgtggttttatctacctttggtctttgatgatggtgacgtacagatggggttttggtgtggatgtcctttctgtttgttagttttccttctaacagtcgggatcctcagctgcaggtctgctggagtttgctggaggtcccttccagaccctgtttgcctggtatcaccagcggaggctgcaaaacagcaaatattgcagaatggcaaatgttgctgcctgatccttcctctggaagctttgtctcagaggggcacccagttgtatgagatgtcagtcgacccttactgggaagtgtctcccagttaggctactcaggggtcagggacccacttaaggaggcagtctgtccattctcagatctcaaactccatgctgggagaaccactactctcttcaaagctgtcagacagggaacaattaagtctgcagaagtttctgctgccttttgttcagctatgccctgcccccagaggtggagtctacagaggcaggcaggcaggcctccttgagctgcagtgggctccacccagttcgagcttcccggccactttgtttacctactcaagcctcagcaatggcagatgcccctcccccagcctctttgccaccttgcagttggatctcagactgctgtgctagcagtgagcgaggctctgtgggtgtgggaccctctgagccaggcacaggatataatctcctggtgtgccatttgctaagaccattggaaaagcacagtattagggtgggagtgtcccaattttccaggtaccgtctgtcatggctttccttggctaggaaagggaattccctgaccccttgcacttcccaggtgaggcaatggcctgccctgctccatgggctgcaaccactgtctgacaagctccagtgagaagaacccagtacctcagttggaaatgcagaaatcacccatcttctgcatcattcatgctgggagctgtagactggagctgttcctattcggccatcttggaacctcctcactttgctcattttagtgtttagaaacacagtccaaatcagaaaagctcaacaagccctgctattatgcaagagcaaaaatattgagaaggaaaacaaaatggtgaataaataaaagcctaaagaaaactagagaggaggaaatgtgtgtttttcccatctgcccttatggaggaaaaaaaaaaaaaaaaccctctgcaaggaaggacttaattttcaagggaaaacctataaactgctaagccactgccaagtgcctgctcccacaaacagaatcatcttcctacaataggaagtcattttcactgtgcaattttccctcttctagacttgcatgctttatgcctctcttgcaacactttatactcatagtaaaggcttttgcttccaggtcttacctttccattatgagagaaacattcttctttttaaggcctttgtggtctagatcagggttatataaaatggaggttgtgatccatttgtaggttaggaattcatttagtgggtcatagtgtttttctttaacaaaatttcatgctattcagcaaccaagttacagaatttgaaattatttctattaagaaatcttaaaaatctaagtgacctgaaccattatgccccggtgagtgtattaattctcacttaatggctgtgtgtgctctctacttgagggacaaccacccgttcaacgtcatctgaagatgtaattacagttcaggcagcctcacaaagtagagcacaggtaacatccaaatgctacagacagtaaggactagggcacctgggggtaggacagcccccgctgggctgagtcagcggggaaggtttctctgaagatgtggggtttaagcagggccctataaagcctggattggacaaaaggagaggagaaaaaaaacatggtgccagctggcctgggctgaatctaaaagaacagagggactgaagggggtattataataagttagcctggaattatatggtacaaactggtaaccctgggaaagcaaagaaggggcagaaacgaggatggaatcttggaaatgtcttggtgattgactggattttggtttggatgtgaaggtgagagaatcagaaaattccaaagttttctatcccatgtgaacaggagagtgcaactgacccttgaacaacagggtgattaggggcaccaacccaccctccacaacccacaaatggtcaaaaatctgcctataacctttgactcccaaaaacttaatagaacatactattgaccagaagccttactgataacataaagtcaattaacacatattttgtatatgtattatattctgtactcctacaataaaataagctaggtaaaaatgttattaagtaaatcttaaggaagagaaaatatatttattattcattaagtgaaagtggatcatcacaaaggtctttatcctcatcttcactttgagaaggctgaacaggaggaggagaaagaggaggggttggtcttgctgtctcaggggtggcagaggcagaagaagtggaggaggtgaaaggggagacagaagagatgtattgaaaaaaaacgtttataagtggacacgtgcagttcaaacccatgttgttctagggtcaactgcagtagtattcatagtaatgtgaaaaattcagagaagttttaaaaagaagtgttatgtaataacattaacatttgctatagaagttaaacctgttttggacacctgagttgtgctgagatatccatattagggacactaagcagtacagacagaatcccattctgtaggcactcactacctgggaggaccaaagctgatactgagccagttctttttttttttttttttttgagacggagtctcgctctgtcgcccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgagccagttcttaaaatactgaaatatttccatatgagttggagaaaaactacctgtgcaacacacacacacacacacacagccctactgccacagacccttttttagatctccagacctaaagaacgatgatacttcaaaaggcctcaactccatgactagcttctgttcccactggccagtgtctatgccatattggtagtacaatactggcagactgttgacaaaaccaagtactaatggtagaagaataacttcagcttgagccagttatttgtctgaagagctgatgaaggcacacactgagatacactgatgggtggagtcctagcactcaggctgctcacagtctaacaggataccaacatataaataaataaagcaatgcgatccagagtagcagcatcgaagtagctataaagtgcaataagaggcacaaagaggatagtagtcagttacccagcccatggcagggaggcaaagcagttcctaacaagaggtgatacaagacctgagcagtgaaagatgaacaggagtttgctagggagagaaaggaggaagacaaaccattccaagctgatagacagcagcactatgtaagccacaacccaatatactgtgtacaaaataatgaaatgaaaaatgtgtaatgtctggcacacagtgtcaataataaataacaataaataataaatattagagtttttctggcagatttatttctctgattatgtttttaaaggttgatcctaaaatatatttgcattgtctaagcctacactagctaagcaagggatgggcattcaagatatcccggaaggcaggggtcagtcagtttggaatttaaaaataaagcacgtaaaaataaattcacaacatcaattagtgttgactgcacttgttagatgtgtgtaagcaaagatgagacttggtgctgctgcaggcctctcagatgcacagatgagtgtgacccaaggttgcttaatgaaatcacagaagggtggttggtaagtgtaaattcccatctcttttaaagggttgttgtttttttagaaattagactacataaaaaggcaaaccacagcctgttttagtctgcactggtcactgtcatctagagccaattgttcaagaggaaggaaacactcaacgccaaggagaagagagtcatcaccgctgctttccaaaattgttgtatgagctgctccctcaaaggaagaggccatcagtgctcaggaagaggcagagatttccgacagttttaaaggacagtgtctgcagtgtgacccacagttcaagctgcataaaaatataaattcactgacaaatgataacaagtacttccttactttcctatctgctgaatcacagccattgtttgggttgtagttcctggtttaaattagattattcaatcacaatgatgctggccaaacatgctggtcatatgccatcaggaaaacttatcaaaaatatcatttgtgctgggcacagtggttcaggcctgtaatcccagaactttgggaggctgagtaggaggatcacttgagcccaggaattcgagaccaacctgggcaacctgtagaaaccccatctctacaaaaaaatacaaaaattagccaggcataatggtcatacctgtagtcaagctcctcaggaagctgagatgggagaactgattgagcccgggatgtcgaggctgcagtgagccatgatcacaccagtgcactcccacctgggagtgagaccctgtctcaacaactacaaaaaatccagttgtgtcaagtcttaaacatataaacacacatacttttgcactaataaaatttaatctgtaccaaggcaccttttaacacccttttttccctccttctgaagaccacaaatgttctgatgtagtggaaaaagaagagaatttgcagacagacctgactttcagtgccatcttggccatttattagctacttaaccaagttcatggctttcagcttgttttctcaaatgcagaatgaaaaaaataacacctaccagaggagtcttgtaatgatttagttggataatacatatgtgcaactgcccagcagcaagggcctgcaggaagtaaaggcttgatttattactaatatattttgaaaggttttactagcacacacctcccagctcaaacaatatatgccatcagtgctcaatattgtcatgtgaaagaaaaaatatgatataaaacttcagcaatttgttctgagtggtcacttaagaaaccatgacttgcaaagtaaaattacttttttaatggcagctatcttggaacagataacagaaacagggtagtgtcttcgtgacagtaagaacctcttatacaccaaatatgatgtggcctggtatatgacatgtttttctttttcctttctgttcagttatagtcaccaatgctgtgacatgtgtaatatatatttaatatacattcctcattgtataaataactgagctatgaggaatggtacatattgcagaaatataacatgagtgctttggatattttattttttaaataacctgtgacatcactttcattgttccacatactgaagattataaacccacatctcaagggactatttatttccccttagatggcagaataatacaactacaatcatggtccaaacagccaggcttctcataaatgtggttaaggagactagcttaaattttcagtctaatatccttttaaattatacactttattaaatagaagaacgcatttttattctaaacaacatgttaaaaataagaccagtctccaggcttttaaagaaaacaaaatacttaggtatagttcatcagatttgactccctagtctaagagctggtagactttcaaaagcagaatgcaagatagggacatgcaaggacctttcactcttccaagagtgaaagatgaatacatggcagtgaccagtccatgcagcatggattagagacttttacacaaactctataacttattccaagccaaattttatactcaagttgttgggaaagcttaaaatggataatttgctcatggactgagcaccaagcttcaggagagaaagttctatagtagtgacttcactcctgcctcaccaaagatgtatcttcctttattcccttggataggacctttttgtgatagtcaatggaggtctcttaacatccttcactcaatgaatatatagagctatccaaaataactcatagagttattttagaagttttcatagtccccttctgatgctaacatagttcccattaatttaaatctcttctttctgtaacacaaagtcaaagtcagaagaaagttctgtataattgaaatctccattatatttttgctgtccaaaattacccaacctggtgttaggagaactaaaattctgcttattcttcaactttattactgtctaatatgggttaatatctctaaatcagccatgaacttcctgaatttttttaattcttaaattttttgacagggtgtcattctgtcgcccatgctggagtacagtggttcaatcatagctctctgcagccttgacctcctaggctcaagtgatcctcctgcctcagcctcccaagtagctgagaccacaggtgcacaccaccatgcctggctaatttttgtatttttttaaagacagggtcttgctttcttgctcatgctagtctcaaactcctggtctcaagtgatcctcctacctcagcctctcaaagtgctggaattacaggtgtgaaccaacatgtttggttgaactacatgaattaaatataagccatgaattgtaaaaccttctgtctatttctgaaatatgaggcaacatggtacaagggctgtgatgctgacagagccaggtttaaatcctggctctatcacttatcagctgtgcaatcatgcataaatcacttcagcctctgagccctttttcctctataaaattgtagtaactccctacagggtaaaagataaatatgcatttattcagtgccatcacaagatgaatacaaaacaaccatactctgatcaactgtgttctgtcccacaccatctcaacaccaagctatgctcttaaagtcaatgaaagctacagagaaggaatatccacaccgtgtgtatgtaaatggaaataatgacaatactgacctcacagtgttggaagcccacctccaaggtcatcatctttgaccctcccatctcagtcttactgacctcttttcagttcctccaacacagcctggtctttcctaccttaggatcttgtacatgatataccttctaccttgacagaaatctttatcatctcccttcttctagttcactcctaatcatctttctggtctctcctttaacatcattaccatctataggattccctaatactccagacttaggatcccattatagacatctcatacttccttaaagcatacatcacacctttaattacttgtgactatcttctttctcactaaactgtaagctgcatgaggcctatgtttgctctccatttatccctagctattaactcggagtatggcacaaaggaagagttcaacaaatatttttaaatgaatgtatgactgtgctgttttactgtgtaactgttaggtattatatcaactatcatagagtgatacttcattgttatctgttggagctcagaaaacaataccccaaagtattgatactatgtcaactatcatagagtgatacttactgttatcaaagtattgttccttgggagtactttgaactgaagaacactggaagagtctcagaagcaaagtctctttccctcttctgtctttctctctcctactcctctttctcccccaaggcaggtcatagaaactaggacccttcttcctgaaagccagccatgaagcctaaaaatactaaatctaaccttccccttcctttctgtataggagctggttacaaagaaattatctgacctaccttgtcccatagttgatcttaagaccgtcattccaaaaggggtctgacactacatccaggaggaaagaatgccacacagagaccaagaagaatcagaacagatagaccttgctgagtttccccattcagactattaccactaggatctttccctttttgttccatcacttttctacaggactgtccattcttcatcaaacgtaagcctaaaaatgaagagtttcccctgagttttttgggtcttcatttctgaagactcccatatcacataaaactgtgcttaaatacacttgttatgcttttctcttgttaaactgtattttattataggggcattgaccatgacccttatgatgggtgagaaaaagtatcgcacctttctgcccatacataccgtacaaccaaattgcagggctgctcagagaaagcttctaagaaaatctgcctttaacaaatctgtttctcctaacctgtgtggtcaatctgcaccatatgagcagcaggaaagacagcatcatgggcttgacagagacacagctgctgcttctctccagccgcagcaccacagggcaacctgaactaacatgtatgccatagaaagtaaggatttacaaatatacacagttaactggcttccacttgcaaatgaaaaaccgaaatcataaaaagtttactttaacactccaataataaatacaggtggtacacaattaccacagaagtagcctgtaaggagacattcctcttgtgttcattctccatcccagccctcgcccatacacaaaacaaagaaaaaacaagaaatgcagcattccctcccttaatcctttctctgtagatatgttgggagaaggaaaagcacaaacttctagccacagcttccagaccccaaaataagaaaattaaaacaggtaggtctgtctttatctgacattctatcatgctctccaaaggatgtgagacagctaggatccaagtttccttaaccttcccctcctccatatacacacaccttccttacctcagtgtgtagaaaaatgggagagaaggagggggaaagatagagattcatcagatttgtgaaaataatactctaggaaaaacaatgtcacatgtgctatggaggagtatggatgtttacaagacaggattcctgctttaaatgtagaataagagaggagtataaaagattatatataacacaaggctagaataagacatgtgccataaaagtacaaaaaaagatttgaccaatcacacactgtccaggagatttaaaaatgggctgggtgcagtggctcccacctgtaatcccaacactttgtgaggtacaggtggaaggaaagatcacttgaggccagaagttcaagaccagcctgggcaacatagcaagaccccatttcttttttttaaaaaaaatatccaggcatggtggcacaagcctttagtctcagctactcaagagcctgaggcaggaggttcacctgagcccgggagtttgaggccaagtctgcagtgggctatgatcacaacactgcactccagcctgggtgacagagcaagactctgtctcaaaaaaaaaaccaacaaaataaaaaagaggaagaagaagaaggagaaggaggagggatggaggaaggagggggaggaagagaaagaaagaagaggaagaggaagcgagaagaaggagaaggatgacagctcctggaggaggcagaggcagaagcagcagaggaagctgcagaagcagcagcagaagacgcagcagcaggagcagcagaagcagaagaaaaaaaacagctcctggaggaggcagtgttagaggtaggggttaaaaaatggaatgggattgataaaagaggtaaggcccatgggagagagagattccaggcaaagggaacaatgtggattaacacatagacaggaaaggaatgggcatatgtggtgaatagataagcaaaatggaaaggcagttagggccatagattgaaaggccttaaatgctacaggattttgttcttaataaagcaaacaataaagagtcgcagtttctgaaaagaacagtgattcaactggaggagaggtgatttatgtgacaacccatgggagctgtaccggagggggaaactgcaggaagctaggaagaccaactggtttactcttctagtagtcaggggaggcggtaataggggctgcaaaaaggggctgtaatcactcccttgcatgcaattctcactacccaggcctctctcacctttttgttctcacttggcaaaagtgcaattcaccaactccacagccatacccaagaaactgaatgtagctagagaaacatacagccacatcaaatggccttactaacttacataacagttacatcaaatggccttacaaagttagaaaagctgccctgcaatcaaaccatatgcccctagtgcatttactttccttctctgctagaggagcatttctgttctctccctttctcactctcagctgatgaccttccatcttattttgctgggaaaagggaagcgttctgagaaacagcacacaagttctcactaccataccaccttcttaccttcatctgtgcctatatgatgtgcctaacccagtttgactatggtcaaactgttcatgctcttgttttttcattagatcccatttcctcttgcctaagatatcccactaccaattctatttctttcttgttccgtcactttctcactctctcggctcatttcccttagcatacattcgattatttctcccatcttaaaaatgggaaccctctccccctccatctaccacaccatatttctgctccccttcacagcaaaattccccaaaagattaccacactcgtggtctcaattcagcttctcccattctctcttgcatccactccaatgaggctttcgcctccactcaccctctgaggaaattgctgtcaaggtcaccataacctccacattgctaaatcaagtggccaattcccagtcatttatttaggcactactggttaccttcttacggaaatgcttttttcattaagtaatcagggtatcacaccctcctggttttcctcctccaactgttccttctcagtctccttaactggttccccatttccctgacttctaaatatgcagtgttgagaagatcatctttaaaagaaaagatcatcttcactaactcctttgttgctctcttccaatctcatggttttacataccatctgtatactaacagcttcaaatttgtattacttgccccacctttcttctaaattcttgacacaataccatttctgaaaccaagttcctcttctccttccttccccaaacctactccttctgcagctttccccttcttggtaaatgacaactcctaccttctaactgctcaggccaaaaaccttggagtcatcttcaattctttatctcacaacctacatctaattcatcaactatacctctcagctacaccttcaaaaatatccagaatctgagcacttctcagcctccaccactaccacactaatccaagccaccatcgtctctaatctgaaattttgcaacaacctggtctttctgtttaccccctttcccctacatagtctattctcaacacaatagccaaagtgtttcttaagatttattaatcagagtcattcttctacccctaaagctccaaaggcttctcatctcattctgatttacggccaaattccttacaatggcccagatgtccccgcattatctggctccctgaacctcctttctgtcctcctctagtactctctccctggggcatgtccctccagacataccatcctccctacagttcctcccactgagcacacacctacctcagggtttttgcacttgaccttccctgcctagacattccctgtgcctagaatgtttttccccatgcctagaatgctctttccccagtgcctcgaatatagtaggcacctaataaaaaattaggtaaatgaatttagacagacattgaacattcattttccattttgcttttttcatttattattaacgcataaacattttatcacattgtcagaatactttaagaccataattttttgggctaacaatattccattttatagacataccacaagttatttacaatttgggactgaaaaaccaggatatttacaaatgggatattttggatgtttcttcctttgatatttgtgaacttcacttcacttttagaagtgaatctactagtgagaatatgtacctcacaggattgttgtaaagctgaatatgaactaataagtggacacagagacatcagttttgttactactgcttagattacagagacatcatgatgtcaatgaaagatcatagatcttgaaagaaacagataaaaaacatgactcacaatattgtcctttaatagcttaagacacttaacctctatgagtttcaattaaaccatctatttcaaaaagcgattatattaataataattaaaaagagatgtaaaagagtttagcataatattgagctcagagtagataatcaataaatgttcattcattcacttctcataaacaatacctagggtttttaaaattgtgaaccagaaagaaaaaaatatttttataaattatcccattacatacatattgttaaatagataataaaaattttcagtacagaattattctttttaattaacaattactcaacacttaccaaagcacacttaagattacaaaaatctatatatcaattttgtttcttttattataataaagctaggcaaaacaattatttttaattactgaatgatggtatcaataaataagttcctttttatcatgtgctttaatgtacacacacaacaggtcagtaaactattataatgatgacaagttaagcaagaaaacattttaaaaattcgcctcacttcagggctatttcttgaagcaatctgtgtgttggagtcagatgaatgccaagacattacaaaattttcagtgttttccatgttgtttcgatataagtttgagtatatgcagttggaatggtcaacaagtacaatttgaactccttcagggtatagtcatctatgcctggccaggacctagcccagtgcctgacatacaaaagacaccagatcagcactgagtaggtaggtaggtgggtgggtaagtgactgattgagtatggtagtcattagtgctgtctgtctaggcactacaaagccaatactttttgtctccctaccctgtgattgggtacagtcatttaaccagttctagccaaggaattgtgagaagaagtgacataagtaatttccattttggagcattcatatgagatcttccatgttctttttccactgctaagtgttcatgaaagcatatgctaaaaaggaaaccccgatcagccacttagtctctgagtgaaagcaggagcacagccccctgctcattcaattggaagtttatgacagtaagggtcatacattttgttaggttaagtgaccgaaattcataaattttactatagcagcaaaacctaacttatcctggataatacaagcaagctaatggcattcatttcagcactagaaattaatcagagtttaatttcagaaaaacaaaatggtacagataagtagtatagctcagtataataatttaacctctctatatgatagttctcttgctcgccgagtttgatggctcctgcctgtaatcctagcactttgggagaccaaggtaagagaattgcttgaggacaagagttcaagaccagcctgggcaacataacgagatcccatctctacaaaaagattaaaaaattagccaggcattgtggtgtacacctgtagtcccagctacccgggatgctgaggtgggaggatcacttgagcccataggttcaaggctctagtgagctatgatcacatggcttcactccagcctgagtgacagagcaagatcctgtctaaaaataaacaaacaaaaaggatagttctcttgcctacaaaatggaataatagcatctacctcatagaacagtaatagggattaattaagtgaatgtctattaagtacttaggataatatttacggtatttgaagctttcaataaatggtagtaaattactatcattaataatgcattagacacatttacactacatatgtaattttactttcatctcttactccttattcattttaatttatggtcaattttttcaattcataatatctttattaagaagtaccatatcctgtcagaaccatataaaaaaataaaaagaagtaccatccaaggcactagaaatgaagacaaataagatctaccatcaaggtattctccttacctatgattctcctttcttctgcaatagacccacaaccaagcaaactttaaaatcataaacacaatgttttattatattataatataaatcaactatgcaatattataaatattgtaccaattgaagaggtgattactttttaatttaaaaacactttatatgttatgggtctgtgtcttattcaaagtcaagatagtaaagttgtttaggtccaattcatcaaaggcaattaatgttatggcaaaaaacaaaacttgtacccacattcccactgttcctaacgcagtgccctataaacaggaggcactcagtgaacaaaattataggtaaatcagagatcagcagatccaatccatttatcttacaaattagtacaatgagatctagagggttaggcaacttgcccaaaagtatgatgtgatttagtggcagggctgatcctagaacccaaactttgaaaatgttttaaaagtctaaattctctaaagcacaaagttcctgcagtatgctgacagaggaatataaacaagtcagtgaaaaacctaaagttaatttttattgaaattagattttagcattagctagtaagaaatttaaaactcagctatcagaaagacagtgttagatttactattgttatcaagagaagaaggtacttccaaaaacctaaaagggtaaattcattaccatatttccccccaacactttatcaacacttaaaatagcatagaaagaaaaatagaaatagtttcatatgcttctttttatgtacagaatcttgtgtgaaaagaatgattttaagcaagaaaaaaggttaattcctaggccacaaatctattaaagtattgattattttaatcctattgattttaaaaaagtgaaggggttaattaaagccatgtacattaggaaactgcaagataaaaataatgtttatcatttattgtttactaactgttatgcactgtgctaaatatgcactttacacataccacctctttttacaacaaacttatggtataggtaatataattatctccattttgctgattatgaaaataggggctgcctctgagtaacttactcaggtagtggcagaaacagaacttgctctcaaacctgtttgcctctaaatggtatgctttaggttttgttgtagttgttttttgttttttgtagagacagggtctcactatgttgcccaacctggtctctagctcctgccctcaagtgatcctcctagcctctcaaaatgctaggattacaggtgtgagccaccacacccagcactaaaagctgtgcttttaaccaccctcctgttcaagctctatcaagtttctgaccctctataatttagatcaaggtcaatccatcatatctaaggggaaggctacatgatctctaaggccccttctaaaaatgattctgtgtcaccaaacacataaatcagttctgaattcacacaatatttctgacaggacactccaggcctaagggaaagtccatcaatagatgaacagataagaagaggagaaaggggaagaaaaatttaaaggaggaggagaaagatctttatcaacatgccctacaaggtgcctaacatagctagacataacattttactagacatcagggccactgtgacaaaggtgggaaaggggaacctagaacagcaattgaaagtggaactataaaggatgtacataaatttaaatagcttagcccactgatgtgatcccctcacagcaaatgaggaaggagctgcagaagtcagtgaccatgagctcaatgctgggccaacacacagacttgtaacagaaacaatgatcagcagttaaataggaatagctgggtactaagttttcagaagaggcattaccactattgtcatgcatttggatgagagtgtattttcaggacagagttgtgaaggaactagcacttgttccatcaagttgtttaaactcctaccatgttttatgcaccatccatgtggctttcatttgttacgacactgaactctgacaacaaccttggtggatgtgatgattaattttatatgccaactttataggccatggtgcccggctatttagtcaaatatcattctagatgtttttgtgaaggtattttttggatgagattaacatttatatcagcggactttaaatcagtggactttaccctccataatttgggtgggccttatctaatcagtttaaggccttaatagaacaaagtttgacttcccctcactttgggaggccaaggtgggtggatcacttgaggtcaggaattcaagaccagcctggccaacatggtaaaaccctgtctgtattttaaaaactgcaaaaattagccaggcgtggtggcgggcacctgtaatcctagctactcgggaggctaaggcaggggaatcacttgaacccaggaggcagatgttgcagtgagccgagatctcaccactgcaccccagcctgggcaacagagcgagactccaactcaaaaaaaaaaaaaaaaaaaaaaaagactgacttcccctaagcaagaagaaattctgccagcagaatgcctgggcatccaaactgcaactcttccctgggtttccagcctccaacctaccctgaagattttggacttactaagcctccacaattgcatgagccaattccttaataaaaatctctctcatagagagagaaacacacagacacacaccctaatacaatagatattgctcccaattttaccactgagaaaaatgatggcctgacaggacccattctccctcttcactacatcacacactaaaatgtgtgatttgggactcacattctagcctgaggggctcaggtgggaggtacaaggtaataagcatgcaacattgtaaccacaagccacatattccagagagccctttatgacactgataccacacatactacacatgtacccagagcctcgatgtgcccaagtgatgtactatcctctctctggtctcctaattcagttatttcaggtaaaagaaatcaaatagtcctacctaactcaatatttgaagaccttgaaaaaggaggaaaaaataattagtaaagaattaaagtaaaagataaaaagaaaaataaaaaatgatttgtgacaattaaatgatggtagcctttgctttgtttaggttctttttgaataatcatgcattcactctttcaacaactatttattttgtgctttatacttttttataggctcttctaggtattgtagagtactaacgagctggagggacacatacaatatagtaaatgtgcaggatgaaaaaagaccaactaaatttccttaaagaagtcaaagattcgcagaagaggtgagacatttctgctggaatagaattatgagtttaaatagtggggaagagggatggtattccagacagaatttctgacacagtaaaagtcacttgagtctgttaggttgctaaaagtgggagctgggatggggaattatggcagaatataaagttggaacgaccagctagggttacatagtaaggaacaatggattcccatgccaaggtgtttggcctttatcctgcaatcagagttatgaagaatttctaagcaggggagggataagaccatgggctaagccttcttagagaccactccataaaaccacatcctttatatacatagaaggacagctgggtccagcttggtcactggggcagatataaccacaggtaaatcattataaagtttaataaaaattaaaccttgaataaaaaactaagccttacagttttaataataagtttattactagaaggcatcaaagtatttcatgtgctctaacttaaaaacttaaagttgagttcacacatagtcctaactaaaaatcaatggttcagaaattggcaactagtataattataattatgcaataaatacatatgtaaaagttttcctcagaaaatgaaataaaactcaattggaatagacagaagaaaaattattattatggtaataaatacatacgtggaatctgtatcctaaaatataaattaaatataagccagtggacaaaatgtggctgagtaaagctggactttgcatatcatcaaaaatggaaaaagaaacagtgttgaattatatttctaaggagtgtagtggccaagaaaagaatctacaataaaggaacataaattaggaactaaggtactaacaactcatttgttcccttcctcttttctgctgatagttctctttttcatcaatcccaatgggattttagagatctcccaatccaatagtcctccccaccgttttactttagcagttgagttctgcaaatagttgtatataaaatcccagcatataaaacaggtaaaagctgaaagagatccaagagagggtactagagcacctaatttggcctccacttcagccttcatccactttccctctgaaacagctccccaaagagcccttaattttcctcagtaaagtgtaaaacacattggtccttgtcccaaccctcctaatttacaaatgagggaattatgccctagagaattaatttaagggagttgcctgagaaaaaagattatttcctagtacccctgctaaaattaaaatgttttctcttcctcataaacttgaactcaaatgtctgggttaaaaattgtttcttggctggggacacagtggcacacgcctgcaatcccagccctttgggaggccaagacaggggcatcgcttgagcccaggagttcaagaccagcctaggcaagatgacaaaatcccatctctatttttaaaaataaaaaaatttttaaattatttctaagttattctggaagtctatgacatccctctaccacaaattcccattccaaattcacataagggctgggctcagtggctcacacctgtaatcccaacactttgggaggctgatgcagaaggattattgagcccacaagttcaagactagcctgggcaacatagtgagccttgtctctgcacaattaacaacaacaaaatttcacataggtctataaccacatattatatgagtgcctacttgaagccagatactctgctaagagtacgttatctgctctcattcaaccatcaccacaaaccccaagagatcaaggaactaggctcacagaagtactgtaacctgcccaaggtcacagagctagcagggtggaatccggttctatctgactcctaaagccaagcttcagacccttgcactctttctaatcccaaccttttccaaatcttttcctatttttacacaggctttcagaaatgctgaactgtaaggattacttgtcatttcacagaggatgtacttttccatcaagacctgtgggggaatgcctcatgctgcagccaagcacaaaggcatcaagcccaaaaacctctaatttcacgttacagaccatagaaaggctaatccccacccccaccacaaactcctacaactccttttacaagcataggctacatacattcagtcttatggggaatagggactgtcaacaattcttaataatagggctacaaaatcagctctgagctgaccccttctgagaggctggcttttaggatggataactatccaatattttctaataggtaaagatattaaaatttgtatttagggctgccttggggcaaaggatgactatcaccgcagactaggtaccagagctggcatttaataatttgaatttgagggaaggtcaagggagttcggattggggcaccctctgggagcagagggagttgaagtgactgtcgtgtccaattacagaaaagcctgaatcaagagtatgcagccaaaactactaccaaattattggtaatgggaggagaaaatttaaacagaactgggatttgggaccaccttctggaagatgttagccaaaaaccgaacagatcctaggcatcaaggggtgtgaatttcgaggtaggctccgttgcccgggctctgagggtcagggttcccggcggttgggcctgggacggcgaagcccccgctcccccttaccttctgttggaagtagagaaccgaatagttcttggctacagccgggagggatgtggggttggttggcaagtgtaggctgccgagggcccttaaggccggccggagggctatggtggcccagggcgccagaaaagacagaagcaggagcaggagggctcggcggcccatggctcaggctggagactgcagtgcgggtgggagggcgaaaaggaggccagcagaagcgcacaggctaagccctgcccagcctgcagctccgcccgccgcaaaacagctcctcc

SEQ ID NO: 755 - DNA, 76149 bp, Homo sapiens; identical to SEQ ID NO: 754

SEQ ID NO: 756 - DNA, 32963 bp, Homo sapiens
gccaaagcgttacttccggcggaaaaggacgcgggagattcgattggaaggctgccggcgtgctactgagttcggccggtccgagtcactgtgcgtcgcctgggcccgttcctggtcttctcccccaggtgagctgggtaaaggggttctcgggaagccgaagagccggagactcctaaggaggctcttaacttcattatgaatgagacccacccagagcccggcgcttgttttttcacaagtggttctctgtaaacgggcagccatgagggtaacagaatataaacgtcagttattttattttagactcagtgcttttgcaatcacctaacgaacgtttattgaacacttacagtgccatcgagctagactcggagtgagcttttagaatcggaaatagagaggaaaaggcgcgactcttgcttctgtaatgtgcaaatacgtattcagtgggccactgtgcagagtagtacgtgctgaaaggggatcttccaaaatgctatgatggcttagaaggaacatattttaactgagccatgtgcttaaaccagagcttgaaagttttcttccttttcacatccagccagtccctaccagcctcttgaatatctcagatctgttcacttctctccgttttttactgacattattttggttcgaccctatgactgctacatagctgtgacagtaacccccccctcccccgccgccccagctggttctcctgctttcaatcttgctaccttccagtccagtctccacattgctgggctgataaagttcatatttgaccgaggcactccccattgaaaacctttcagtcgctcctatttgccctcaggtttaagcccaaactctttaacatgacttacagactctttcctatctgacttttgcctggctcttcagccctagtggttttccaccgctccagccatatagaatgtcttttgtgttcctgaagtgcactatcctccttctcaccccaaaccgtcttctgaccctgtccctgacctggctaattcttagtcagtttgcaaagccttttaaatcagaaaccctttcctgaccccacaggactggatcacagagcaccaagtaattatttgtttattctgcagatagttaaatgcttctttcgtctgtgccaagaattgctaggtactgagatccaatgatgaacaaggtagattcctgttctaatggaacttaccttttatggatggaattaaggagaatttacaaggaaactatgtgaattagactggtctaagaagacctttccaaggagttgatactgatgcctaaaagatgagcgtgatccaaccatgcaaaagagggaaagaaaaacattctaaacagagtgaacaggttgtgcaaacgtcctgaggcaggaaagagcttgacatgttaatgttcaagaatctaaggaaagaccagtatagctggaatatatttagaaaggacagttgtatgagatgagtctggaaagatgggcagagaccggatcatggttaggaggttaatccagcaccataaacaggagataatggtgatttggattaagatgatggcagaatatatgagggaaaagtgaatgatggtttctaagtatggaagtagattcaagtaccttctgatgagtgtgatgtgggatatgaaggaaagggaggaatgacaaatgactcctaggtatctggtttgagttactggttagtgagtagtaccatttactgagatgtgaccttctccatccctgtaataaatgtctcataaatgatatcaatggaaaaactgtatcgtactaagattttcctggttcatgtttttaaagcatttttcatcagtatttctcctttcactgaagattttgtctctttgtttttttgcttacttaattttcactctcctgcctgcctctcttacttttctagaattttcgtgtcaatgttactaaattattttttagggacttattatgactgcctttagaaaaattaaacaagtatgtgccattggaggagaccattagacagtgttaagaaaacaattcaaaacagccacccttcccatagctgaggcctcttggcctgtaaaatatgaaacagaaaattggagaattacaaggtgacaaagattttcatgcaaggcaagaagggtttggagaggaacgaagaaagggagaaaaattagtcatactttcttttctttatgccattagaagtggaactagttttttaaaggagtaatttcatcctttgggcacagtcttgaagcaaatacacatagtttctttcaagtgtgaagcttgagcaaagagagtaatggactagaaagactggtaagctactcatcagaaggcatgagttccagacctgattaacttctctgagtggatcagataatgttgcaaaagcactttgcaaactgtaaagcagtcaaatgaactcaaactggattatgaactttaagataggattcacatcttatacttttatgttctcttcagccccatccccagatgccagtttacactaaatacttaattgaactttttctctaggatctaacatagaataagaattagtttagattttctaatctaacccagtttttctagatcttctagtctagccggaagaagaaaaaaagatgtgttggtatgtgcatgtatgggcacggtttttcataaatgattaagttgccttctgagaacttgattatgaggtagttaagctgaaagatcaccaaataatggattagagtaaagaattgcaaaatcatccaaatgagactaagatgctgtcaggccttggggatttaactataaccatgtttatcacaagtgttacacaccatgagatagtctcaatgactaggctactggttttcaagtgtgggcaatttggccattacctgggaacttaaaatgcagattctcaggcccttatcccagacttactgaatcaaactctggagttggagcccagcaatctgttttatcaagccttctgggtgattttgatatatgataaagtttgagaaatacttgtctagtatgaaaatgggatgcagaggttgtaatcaatgagtttatatatctggtaccactgacaaaaccatctctagaatgaaaaatgcatcaggcattagcttgattccattaaatagttgattcaccaaacagctcttcttcaagcaactttctgtttataattttagtataatatgaggttataccaaatatacaaatatgggcttctgatatgtcccttccctgtgatggtaatttttcgtggtaaattagtagaacatctttggattacagttcagctccccatatggcttgtctaaaaggagagaaagcaagtattccagaatatcccatggtaaattagatatgtactatagtgtgtccacatggaccccacatattttaataagcataagtctattggagccttcattcctggacattgacctaggtaatccctggtatgtgccctttgaaaaatcaaaggccaactgaggccttaattagttctgccccaacacttacacttttgtccctctttctaccctcatttctacttttatgtgtgagagatttaaagaaagcaagattttctttgtatattattgctaatgtccctatccagcatttttatagtatttattgatttttttctaattataaaagcaatacacttagattgtatttattgattttttctaattataaaagcaatacacttagaaaatatcttaaatatataaagaaaataaaaatcgcccttaacactaccaccctgagaaaatactttttaaaaataagattatatactttcctaactatcctcttctctttccccattcctcccatcaaaaactaaattagtccccctgttatattttctcatggcactatgcatttccaaaatagaatttgccagaattgcagttaaattttttgtgtgattattttaatgtctgtctcttacactagactgtaagtctagtgactaggtagggaccttgtctgtttgtccatcaatcacactatccccacctagcatttagcagctgcacaactaataactgatgaataaataaatatgttcgcatattaaattgggatatggtttgctgtgatggagctgaaagaaatgtaatactatatcatcatccttcccaataaatgtgaaaagaaagataaactgcaaaagataccacatatgaaattgttcccaagtgtatcatcatatcttcctaattttagtatttacttattcctgatgtttcattcaattattcatcagacatgcatccactatactgcaagtcaagcagtagagagagacagagaaataaaacaaagtataaaaacacccccagagcctaggtaaataaataaataaatacaaaaataaactaggtggcaagtatgaaggaaatattatgaaaacaccaaaggaaattaattaacagtaactgtctgaaacgatcttattctattattgtccaacagacaataaatgggaagcctttttgccattttctggggttcaccaggtgaaatacaaatagtaaaaatactaatgatccctttcattacagttctcaaatttgctgtttttatagatttttagacttacttatttgatccactagagggcagtaaacccttaaataaagacaatgtaaccaaccttcctttaaaagtatagtaataagtgctggcacaattaatttagaaatgaacccaaaatttcctgcttatttaagtttttcatttattagtgagttgtctgcccaattagcaattttttttaggacagacagtatcttattttcacttagcccagtgtacgagtcatgttacaagtttattacatttcctaaagtttgaataacaattgtgtaaagaacatgatttgatgaatgcccatattgttgtggtacagtataaaattctgttttagagccctaaagaaaatagtctctgctcacaatatgaacagaagtaaaaaaattagaagtgaggataagatgtaagtaatgattaaaataagtatgaaataaggtactatatatgaaactaggctgtgtacttcgtatacaaatagaagataattttatgatttggtaaaattgtgttttatatttaacgctatgtgacaaaattgtggcttgggaagaggaaatgcaaatcatgaagattaatatctgaagttcagattgacaatttctgagcttggcactgaagatataaacagatagtccttctacgatcttactttgagtccaggaaaaacaagccatattgaacagataaatttaatataatgtggcatgtgatgaattaaagagtaatttaacttctgggaaaacgtcctagaaaagaagacttctaagaaggatcttaaagaataataagcattaccaagagaatgaaagcattttagagagaagaatggaaaaaagcaaaggcatagaaatgtgaaacatattgtgggggtggggaagcaaggaacacaactcagattgtttctcttggcataaattactagcacataaagagcaaaaagaaagttaagagaataggcattagggagaataaaaccaaatagacaatacactacaatagacaaaacaaatggtaggactacagaggtacaatagtatatggtgtagaaaaaaagaaaagccattccctttgttaataaagaaagactttttaggggaacttcaaatgaaataggaagaaaattctggttatcgtatggcgtctgcctactctgttgtaaaaattttcttgaattgcaaaattctgcttatagttcttcattcatgcaataaattttgttttgagactagtctttgttgcccaggctggagtgcagtggcgcaataccgcgcactgcagcctcaatctcccagactcaagtgaccttcccacctcagcctcctgagtagctggaactacaagcatgcaccaccatgcccagctaatattttttattatttgtagagatgagttcttgctgtgttgcccatgctggtctcaaactggtgggctcaagcaatcctcccaccttggcctcccaaagtgctgggattataggcctgatccaccacacctggccccattcaataaatatttattgtgaacttactgtgtactgagcactgttctaagcactggggttacagtagagaacagggtggactaggtccccgtctttatgaaacttaggctagtgatgggtagatgaacaaaaataagtaagcaaagacatacataggatgactatccagcagggttagtaccatgaaggataaaacaggtgatgccatagaaactaagaggaaggaggattctacttgagctaaagtggggctctctgaagggataacattagagttacagattgaaggacaataaagaaccgactattccaagacctaagggaagaatatcgtagccaaagagaatagtaagcacaaaagcctgagaagggaaatcgtttggtgtgcttgaggagcagaaagaaggccagcatggcttgaaatacagtgattgaggaggagagtggtacaaagtgaggtcagggattggcaagatctacatgacccagggctgcacagaccattgtgagatattgaggcttcattctaaatagcaggattttaagcaggtaagagacagcatgttcaggagtgagctttatgctcttttagctcccctaactcacaggtagatgtacctccatactaaaccctacactaaattggattttagaatgtggaggacaatgcctttgttgacataacatcatttgttatgttaactaaaagttataggaggcctttgttttggactaagctcctgcactaggccccagtggaccagactaaaaatcaaaatagagtcatttatacttaaagttccacctcaccaaatcaaaactacattgttatctgaccttcctagaactcagaagagagaaataaccaaatttcccacatgtgccagtttcaattgtcataacaacgaacttcgctctgcctttgatgcttacaacaaaaagtagccttatgttaaccagttattcctgtatttttctgttcctctgttcccactttaggaggaaagtaactttgaaatgaccaagctgctttttgttctttgtttctactttctttagcccttctctttctgtaaaactgaacttctctgctcagccccttgggtcacttactctattttatggaataaagtatttcccgattctagaattgttacaggaaagtagtcccaattcagacccccagagaggcttctttgatctcgcacaagaaagaattcagggcaagtccataaagtgagagcaagtttattagggaagtaaaggaataaaagacatagaacagccccgagggctgctggctgcccatttttatggttatttcttgatgatgtgctaaacaaggggtggattatttgtgcctcccccttttagaccatatagggtaacttcctgacgttgccatggcatttgtaaactgtcatggcgctggtggcagtgtagcagtgaggacaaccagaggtcactctcatcaccatcttagttttggtgggttttagcaggcttctttactgcaacctgttttatcagcgaggcctttataacctgtattttgtgccgacctcatatcttatcctatgacttagaatgccttaaccgtctgggaattcagcccagtatgtctcagcttcattttacccagcctctagacaagatggagttgcttttttattcaaacacatctgacagaatcataaataaagccaattaagatctttcacaaaattgttgtaattttgtcttttgacagttgcaatggcaaggaatttgaggttttagcacttacaatggcaattttctttgacccttctttctgcctttcctttgtatcctgtattacctaccctaccatgtcctttgagattgccatgtagcctaaggtgacaaccaaatctaggaatacataatcggctttggcagaaccttactaatgtatatataagagtcccaacaaggatagcaaaaaattaggattagcgttctcttttctgtgctcccttcagtaatacagattagtgatttatttaaattatttatctttcatctgtaaatttccatcttattaccttgagtggcaagattttatttttatagaaatgttattttgattgactatcagaattagtatcactttaacatctcccttccatagtcaccacatttctatgtttgtcatcatctttagagtactataccgaaaagattttattattttaaaaccagtgacctccactttgtcagtttgctgatgccagtgtcaaaaacagcatcacccatttcagaattgaaagtttttgccatgtgtttaaaaatgaaagtttcttaatacagctttatctcaaacagttacaaagacctttgttgtaaggcatgtattttatgttatatgttttatgttatgctaatccatttaaaaaattagtaaacaaaccaacctttttttttttttttttttgagacagagtttcactctgtggcccaggctggagtgcagtggcatgatctcggctcactgcaacctccgcctcccaggttcaagcaattctgcctcagtatcctgagtagctgggattacaggtgcacaccaggctaattttgtatatttttgatagagatggggtttcaccattttggtgagactgatctcaaactcttgacctcagatgatgtgcctacctcggcctcccaaagtgctgggattataggcgtgagctaccacaccctgccacagatcaagcttttaattttttctctctctctctctttttttttttttttttttttttttttgagaacaagtctcactctttcacccaggctggagtgcagtgccatgaatacagctcacttcagtctttacctcctgggctcaggtgatcctcccacctcagcctcccaagtagctgggaccacaagctcatactaccacgcctgactaattttttttgttttttggagagatgaggtctcaccgtgttgcccaggctgaatttttaaaaagaaagtataaagaggagaacattgctacaggcataccttggagatattgtgggttgtgtttctgaccactgcaataaagcaaatattgcagtaaagcaagtcacacaaattttttggtttcccagtgcatatattaataaaatgtttacactatactgtagtctaagtatgcaatagcattatgtctaaaaaatacatcttaattaaaaaacactttattattaaaaaatgttaatgatcatctgagccttcaatgagtcataattttttgtggtggagggtcttgcctcagtgttgatggttgctgactgcttggggtggtggttgctgaaggttggggttgcagtggcaatttcttaaaataagacaacattgaagtttgctgcattgattattcctttcacaaaagatttttctgtaccatgtaatgctgtttgatagcgttttactcacagtagaacttctttcagaattggagtcaatcttctcaaaccctgccactgcttatcaactaagcttatggaatattctaaattctttgttgtaatttcaacaatgttcacagcatcctcaccaggagtagattccgtatcaagaaactactctctttgtttatccataaaaagcaactcgtcataagttcatgccttatcatgagattgcagcaattgagtcacatcttcaggctccactttttaattctagatctcttgctattccaccacatctgcagtcacttcctccactgaaggcttgaacccctcaaagtcatccatgaggactggaatcagcttcttccaaactccaattagtgtggatattttgacttcctcccataaatcatgaatgttcttattagcttctagcatggtgaaaccttttcagaagattttcaacttactttgcccagatccatcagaataagcattatctatggcagctatggccttaggaaatgtgtttctgaaataataagacttgaaagtcaaagtgactcattgatccatgagtagagaatggatgtgttaacaggtatgaaaacaatatcaatctccttgtgcatctcatcagagctcttgggtgaccaggtgcgttgtcaatgagcattaatatgttgaaaggaatctttttttctgagcagtaggtctcaacagtgggcttaaaatattcagtaaatcatgccataaacagatgtgctgtcatccaggctttcttcttccatttctagagcacaagcagagtagattcagcataatccttaagggccacaggatttttggaatggcaaatgagcactggtgtcagtatcaagacaccagctgcattcacccctaacaagagagttagcctgttctttgaagccttgaagccaggcactgacttctctagctatgaaagtcctagatgtcattttcctcccatataagtctgttgtgtctacatttaaaatctgttgtttagtgtagccaccatcatcaactagttaagatctacttatcttaactagatcttttggataactttctgcagcttctacatcagcgcttgctgctttaccttgcagcaagttatgttttatgttttggaggtggcttcttttcctaaacttcaagaaccagcctctgctagcttcaagcatttttttctgcagcttcctcaactctctcagccttcatagaattgaagagcattagggtattactctggattaggcttcgatttaagggaatgttgtggctcgtttgatcttctatccagaccactaaaattttctccatatcaacaaaaaggctgttttacattcttacttatgtgttcactggagtagcacttttaatttccttcaataacatttcctttacattcacaacttggctatttagcacaagaaacctaacttttggtctgtctcggctatcaacatgctttcctcactaaccttaatttttgtttctgtcttttattttaaagtgagagatatgtgactcttcctttcacctgaacacctagaggtcattgtagggttaataactggcctaatttcaatattgttgtgtctcagaatagggagacccaacaagagggagagagatggtggggcagtcagacacacatttatagattaaattcatcttatataggtacagtttgtggcaccccaaaacaattacaatagtaacatcaaacatcactgatcacaagtcaccatcagatataataaaaatgaaaacttttgaaatattgtgagaattaccaaaatgtgagatggaaggtgagcacatgccactgaaaaagtggacttgcttgagacagggttgctataaaccttcaatttgtaaaaaaaatgtaatatctgtgaagcataataaagtgaagcataataaaatgaggtgtgtctgtattttattatttgacttctctgattttgtttatttggagatagggtcttgctctgtcacccaggctggagtgccatggcatcatcatagctcactatggccttgatcctcctgccttagcctcccaagcagctggtattacaggtacgtgccaccacactcagctaattctcttatatttttgtagagacagtgtctccctgtgtttcccaggctggtcttgaactcctgggctcaagcaatccccccacctcagtctctgaaagtgctgagattacagacataagccaccacacttggccttcctgatgtgttttatacaaggatattaaaacactttgagctatcatttgacatgtaacattttgctttttctgtttacaaaatctgaagtcttttttttctcttcaagatgtatcaaatgagcacactgaaatctaataaagtgatatttcagctaaaaaagaacaatttccaccaatttaggttctttaaaagattcatgtaagttcatgtacacattgaatataccttatctgaaatgtttgggtccagaagtcttgtgaattttggatttttgaatatttgcacataattaatgagatgcaggaatgggacccaagtctaaacataaaatttgtttatgttttatatacatcttatacacatagtctgaaggtaattttatacaatacttttttttttcttttttagatggagttttgctcttgttgcccaggctgaagtgccatggtgcaatctcggctcactgcaacctccgcatcctaggttcaagcaattctcctgccgcagcctcctgagtagctgggattacaggcaccccccaccatgctcagctactttttgtatttagtggagatggggtttcaccatgttggccaggctggtctcaaactccctacctcaggtgatccgcctgcctcggcctcccaaagtgctgggattacaggcatgagccaccacgcccggccacaatacttttaataatttagtgcatgaaacaaagtttgtgttaagtacttatgtgtggaattttgatttgtgccatcatggtggcactcaaaacatttcagattttgggttttggactttcagattcaagatgctcaaccggtagtttcctttgtattgatggcagacacaagttgtgtatcttcttgtaaaggtgtgaagaagctaaatgacatctttcctgaattactgggatagagcatttattaagaaacaggatacaagaattttcttaaactactctgttttaaatgtgattttcttcctattaatattttaaggagaaaaagaattaattttccaatacattgataccaccttcactttgaaagtgaaacaaatgacatctattagctttgcagtagaggttaagtggttttcctaagaaaagaatatgcactgcaatgaaagatttgccagtcatcccaatggctattttgttttgcagaccacggtgtgaacacatgaacagaagacgaaaatttcttctagcctcagtacttgctctccagaattcaagttttatatatccatcatgtcagaagtgcttctctaggataatcctggtctccaaaaggtaaaagtaaagtctgtaagtgtgagagaggaaatacaaatgcacactgtagatttcctatggctcaagggcaaggaccagatttaccaaacaaggacattagattctctcaggggttggttcttctgtaaatcccagaacagatttcactgctaatcctctattactagagaaaagttttaagttactgtcaagtcctttgctaaatacttgcctcattgaagaaaaataacttctcagagagtaagttccaatactgggtacaaaacttagcccatttctgggatatccctgggaataatataggagacttgtgtttattctttgtttatttttgcatgatcagtagaatagttgttaatataaataaataaattccttgagaccagggactatgttatagtaatttctatcctttagcaactagaaaggtgtttggcgtataattctttatcatggtgctcagatgcaagccaactatacctgagagcctaaggtcttcctctgatctttatagagtagaaacgagaggttaggtttgaagtttctccagaacactgtctctctgcatcgaagagaggacaagaatacctagtaagtaactagaactatgtaagaaagagtagtgtgccagcaatattcttaactagtctttttgtctagttagcattgaatggggaggcagaaaaggattggcagttctaactcatatctagactctaagtaatccttgaagtagttatcacactgttcctttattaagccactctctcaagcactcatttgttagctctaagagaaagaccctgtttgtgttattcatcattaaatccttggctagggcttagttcatagaaagtgttcaacaaatgttggttaaatgaatgaataagtgatagcatgatagtgtttagattgtcttaggttcaccccttttcaggttcttgcctgtcatctgaaacaactaaaacccatgggctatttgcctttcatcaaaatctgtacttagaagcagtgtggtatacagtccttacttaatgttgttggattcttagacaccgcaactttacgcaaaatgatgtataatgaaacaaatttttttctcatcaacgttataatgatgttgtttgagaatctgctataagtagttttgcttaaagtcacagtatccaagaacctatcactaacattaaatgaggacttactgtaatggaacaatttcaagcttcagagaacacaacagagtttcatgtaggctctggctctcattaactatgtgacctagggcaagatagttaacttctgtgagtctaattactcatttgtaaggtgggatcatggtacccacaatatgggatcattgtaaagttagagataatgcacagaaatgttctagtagaatacataacatatattaggatttccaaagtggtagctattattattataatctattataagtatactttaccttattgcagtatgttatcatgattaaaagcataattctctggagctgactgcctggattcaaattgcaaccctgccattatagctgtgtggccttgggcaagtcactttaattatctgagcctcaaaatggggaaagtaatatctgcctaataaggttcttgtaaggatcaaataggttaatatacataacatgcctagaacattgtctgatacattatcagtaatatatagatataaaatatttttaaaactctttctttccagtcatttattttaaagataatctgcaacaaaaatttaggttgaacaataatgccattgttacttatttagacgggtaataccagtagataacattagtgagtgtttgctgtacagtaggcactgtgctaggaactttgtgggcattatatcttttaatacaatagccctatgaagtgaatgctattgttaatgccaacctttaaaggagacaactgaagcttgggaaagttaagtaacttaccgcaaatcatcacacagccagctagttaggggcagaaacatattcaagcctaaacaatctgaattctgtctaccttcatagtcaccatattacttccaaattagcagcgaagtttgtattcagaatgacatcttcccctctctttcttagaacttaaagtgacctcggaaaggacttgtgactggacccttttggaatataaaacccatggcacatagtccttgcctatggaaacatagtccatggaaatataacctgttttctgcatatactacattgacacaaaaattttttaaaactatttccataatttctggtgcttacctttttttcccataggttattggggtacaggtggtatttggctacatgagtaagttcttcagtggtgctttgtgagattttgctgcacccatcacccgagcagtatacactgcaccctatttgtagtcttttatctctcaccccctcccacccttccccccaagtccccaaagtccattgtatcattcttatgcttttgcatcctcatagcttagctcccacatatcactgagaacatatggtgtttgattttccattcctgagttacttcacttagaataacagtctccagtctcatccaggagactgcaatgccattaattcattcctttttatggctgagtagtagttcatcgtgtatatataccacagtttctttatccactcattgattgatggacatttgggttggttccacgattttgcaattgtgaactgggctgctataaacatgagtgtgcaagtatcttttgcatataatgacttattttcctctgagtagatacccagcagtgggattgctggatcaaatagtagttctacttttagttctttaaggaatctccacactgttttccatagtggctgtactagttcacatttctaccagcaatgtagaagtgttctctgattgctgcatccacaccaacatctactggtttttgattttttgattatggccattcttgcaggaagaaggtagtatcgcattgtgattttgatttgtatttccctggtcattagtgatgttgagcattttttcatgtgttttcttggccatttgagaattgtctatttatgtccttagcctactgtttgatgggattgcttgtttttttcttactgatttgtttgagttcgttgtagattctggatgttagtcctttgtcagatgtatagattgtgaagattttcttccactctgtgggttgtctgttcactctgctgactgttctttggccatgcaaaagctctttagtttaattaagtcccagctatttgtttttattgcatttgcttttgggtacgccaatgtctagaagggtttttccaatgttatcttctagaatttttatagtttcaggtcttagatttaagtccttaatccatcttgagttgcttttatataagattcattctcctacatgtggctagccaatgatcccagcaccatttgttgaaaagggtgtcctttccccactattgttcactttgtcaaagatcagttggctgtaagtatttgagtttatttctgggttctctattctgttccattggcctatgtgcctatttttataccagtaccatggtgttttggtgacgatggccttatagtacagtttgaaatcaggtaatgcgatgcctccaggtttgttctttttgcttagtcttgctttggctgtgcaggccatgttttggttccatatgcattttaaaattgttttttctaattctgtgaagaatgatggtggtagggattgcactgaatttgtagattgcttttggcagcatggtcattttcacaatattgattctacctatccacgagcatgggatgtgtttccattcattgtgttgtctatgatttctttcagcaatgttttgtagtttttcttgtagaggtcttttgcctccttggttaggtatcttcctaaatttgttttttttgtgtggtttttttttgtgtgtgtgtttttgtagctgttgtaaaaggagttaaattcttgatttgactctccacttggttgctgttagtgtatagaagagctactgatttgtgtacattaatcttgtatccagaaacttggctgaattcttttatcagttctagcagctttctggaggagtctttagggttttcgaggtaaacaatcatattgtcagcaaacagtgacagtttgacttcctctttactgatttagatgccctttctttctttctcttgtctgattgcattgtctaggacttccagtagtatgttgaagaagaatggtgagagtgggcatccttgtcttgttccaattctcagagggaatgctttcaacttttctccattcattgttatgttggctgtgggtttgtcatagatggcttttattacattgaggtatgtcccttgtatgccactttcgctgagagttttaatcataaatggatgctggattttgttgaatgttttttctgcatccattgagatgatcatgtgatttttggttttaaaattctgtttatgtggtatatcacacttattgacttatgtatgttaaactgtccctacatccctggtatgaaacccacttaatcatggtggattatctttttgatatgttgttggattcagttagctagtattttgttaaggattttagcatctatgttcatcaaggatatcgggcagtagttttcttttttgcttatgtcctttcctgatttgggtattagggtgatgtcgccttcatagaatgaattagggagggttccctctttatctcatagaatagcgtcagaaggattggtaccaattcttctttgaatgtctggtagaattctgctgtgaatccatctggtcccagactttttttcgttggttttttttgagacggagtctcactctgtcgcccaggctggagtgcagtggcgtgatctcagcgcactgcaagctctacctctcttcacgccattctgcctcagcctcctgagtagctgggactactggtgcccaccaccatgcccagctaatcttttgtatttttagtagacagggtttcacggtgttagccaggatggtctcgatctcctaacctcatgatccgcccacctcagcctcccaaagcgctgggattacaggcgtgaggcaccacgcccggccttttgttggtaattttttaattcccatttcaatcttgctgcttattattggtctgttcagggtatctaattcttcctgatttaagctaggagggttgtatttttccaggaatttatccatctcttctaggttttctagcttgtgtaaaggtgtttgtagtagtcttgaatgatcttttgtgtctcagtggtgtcagttgtaatatgtcccgttttgtttcttaatgaggttatttggattttctctcttcttggttaatcttgctaacggtctatcaattttatttatcttttcaaagagccagcttttggtttcatgtatcttttgtatttgtttttgtttcaattacatttagttctgctttgatcttggttatttcctttcttctgctgggtttcggtttggtttgttcttgtttctctagttccttgaggtgtgaccttagaatgtcagtttgtgttctttcagtctttttgatgtaggcatttaggactatgacctttccttttagcactgcctttgctgcagcccagaggttttgataggttgtgtcattattgccattcagtttgaagaatttttaaatttccatcttgatttcatttttgatccaaggatcattcaggagcagcttatttaatttccatgtattggcatggttttgaaggttccttttggagttgatttccagtttattccactatggcctgagagagtgcttgatatgatttcaattttcttaaatttattaaggcttgttttctggcttatcacatggtctatcttggagaaagttccatgtgctgttgaatagaatgtgtaatctgcggttgttggatgaaatgctctgtatattatctgttaagttcatttgttccaaggcatagtttaaatccattttttctttgttgactttctgtcttgatgacctgtctagtgctgtcagtgtagtattgaagtcctccactattattgtgttgctgtctatctcatttcttaggtctattagtaattgttttataaatttgggagctccagtgttaggtgcataaatgtttaggattgtgatatttctcgttggacaaggccttttatcattatataatgtcctttgtctcttttaactgcttttgctttaaagtttgtttttgtctaatataaaaatagctacccctgcttggtgtccatttgcacaaactgcctttttccactcctttacttgatgtttatgtgagtccttatgtgttaggtgagtctcctgaaggcagcagatggttggtgagttcttatccattctgctattctgtatcttttaagtggaacatttatgccatttacattcgatgttagtattgagatttgaggtaccattgcattcattgtggtatttgttgcctgtgtaccttgttttttttgtttttgctttttaaattgtttttgttttataggtccttcatgatttatgcttttaagagattctgtttttgatgtgtttccaggatttgtttcaagatttagagctccttttcacagtttttttctttctttcttttttttttttttttttttttttgagacggagtttcgctttttcgcccaggctggagtgaagtggtgcaatctcgtctcactgcaccctccgcccccccaggttcaagcaattctcctgcctcagcctcccgagtagctgggattacaggcacccaccaccacgtccagctaatttttgtatttttagtagagacagggtttcaccatgttggccaggctagtctcaaactcctgacctcaggtgatccacccgcctcagcctcccaaagggctaggattacaggcatgagccactgcgcccagcctagcagttcttgtaatggtggtttggtagtagcagattctctcagcatttgtttgtctgagaaagactgtatctttccttcatatatgatgtttagtttcactgggtacaaaattcttggctgataattgctttgcatgaggaggcttaagatagggccctaatcccttctagcttgtagggtttctgcaaagaaatctgctgttaatcggataggttttcctttatagattacctggtgcttctgtctcacaactcttaagattctttcctttgtcttaactttagataacctgatgacagtgtgcctaggtgatgatctttttgtgatgaatttcccagatgctctttatgcttcttgtatttagatgcctaggtctctagcaaggccggggaaggtttcctcaattattcacccaaatatgttttccaaacttttagatttctcttattcctcaggaacaccgattattcttaggtttggctgtttaacataatcccagactttttggatgcttggttcataatttcttattcttttttctttgtgtttgttggattgggttaatttgaagaccttgtcttcaagctgtgaatttctttcttctatttgttcatttctattgctgggactttccagagcattttgcatttttgtaagtgtgtccagtgtttcctgaagttttgattgtttttctttatgctatttccttgaatgtttctcccttcacttctcgtattgttttttggatttccttgcgtcaggcttcgcttttctctggtgcctcgctgaattctttttcaggtaaatcagggatttcttattggtttgaatccattgctggtgagctagtgtgattttttttggaggtgttaaagagccttgttttgtcatattaccagagttggttttctggttccttcttatttgggtaggctctgtcagagaggcaaggtctagggctgaaggctgttgttcagattcttttgtcccacaggatgttcccttgatgtgatactctccccccttttcctatggatgtagcttcctatgagccgagctgcagtgattgttatctctcttctgggtctagccatccagccagtctgtctggctccggggtggtattcagggtttgtctgcacagagtcctgtgatgtgaatcgtttatgggtgtctcggccctgaataccacacagtatttggggtgtctcccaggtcctgcaggagcagtccacttccttcagagggtctgtgggtcctcttgggattcctggtttgttcttgcagttgttctggagctaaaattcatagtgcgagccccaacatgctgctttgtccgagttggagctgcaatctaatcctgcctcccatccgccatgatgatctaaatcctggtgcttatcttttctactgttgtttttgctttccctttttcttacttggaatcagttgtaagccaacacaggaaacagaaattcctcatgttcatttccccattgctatagcactgcaagcttatgacagaggagttccatgctcttgcctttgcagaagatcttagagatgctgaagaacagagagacgtccctaaatattttctttgaacctgaaatttttagtgactataatcataataagtattttgtgctttatggaattaactttcttacctccaagatcagatcagtagattgaatgtagttttcaatctataggtattctgcagagccttggggctccatggaagtgcttatggagggagatgggattagagtagtaatagtacctagtgctgagtagtaggtaagactctagggcccccacgttagtttcaacaagatctctattctcatccttatattagtgttccaagttaaatttcatttgaaagggggtttcattatgtaaatatacaaacatagacatacatctataaaaaaaaatgtgtacaaagttagttcggtccttcatatgaagcagtaactacacatacacacacaatagtgtatgtctgtactctccccagattataagctggagaagggatttatttatccagacaagctatctacatagaaattgcccttctgggtgactaatgggacccataattccttttagcctagaaatccatttctaacactaataactttcttttcctatcttaaaataggactcatcgctcagaggctacctatcctctcccccattcccaactacccaaaaagtttatatcatttacttaagcaagtcaaatttaatttcacacatatagatcatagttttcttactttgtgggggaagtgatatgtggaagcattaagagatatgttttttaaaatatgtctcattactttgtgtgtatttaatctgggtctataaacttggaaagggatgttatataatcatatagtcaggatattcttaagctggaatctgtggatacattataggtatgtatgactcctccagtccctaagatatgtagaatatcgtgttcatatctgttttttgtggggagagagtgagtccattgctttcatcagattttttaaggttttcaagactaagaaaacattaaggattacttatctcaccagttcttctacatctgggctaaatataagtacgctagaaaaataaacaaatgaggctgggcatagtagctcatgcctgcaatcccagcatttgggaggccaagatgggaggattgcttgagtccaggattttgagaccagcctgggcaacatggtgaaacctatcctctaccaaaaataaacaaaattaggcaggcatcgtggcatgtgcctgtagtcccagctgctcaggagtctgaggtgggaggatcgcttgagcctgagcggtcaaggcttcagtgagccaagatcataccgttgcactccagcctgggcaacaaagcaagaccttgtctcaaaaaaataaatgaataaaaataaaaaaaaaacaaatgaaacttggtatttttttaactgggatcaaacaaaaaagatagcaaattacagctattatttcagatagatcctttcagaggctccttgaactcaaatctattttcataattctaaggcattatttgccttttcactttcagtctctcatgagtgcataatggagtttcccagaggctacataacacgtactatcacaacagattgagcagagaagcagatatgagaatccagctgtctttttatgaaaccagacattaaagagatttgcaaaatgtaaaacaatgctggtctcttcttactaatttttaaaatttgaaaaacataactatttttcataaaagtatgttttttgtgttaaccatgtaaagggtctgtttttaatgaattaatatttttttgatttctcagttttaatttctcactttcatttaatttctcgttttatgagaaatgtagatagaagccaggtgtgatggctcacgcctgtaatcccaacactctgggaggccgaaacaagagaatcacttaagcctaagagttcaagcctagtcagggcaacacagtgagacccccatctctacaaaaaaatttaaaattagccacatatggtggcatgtgcctgtggtcccagctactcagaaggctgaggcaggaggatctcttgagcccaggagtttgaagttacagtaagctatgatagcaccactgtcctccagcctgggcagcagaatgagaccctgtctgaaaacaaaccaaaaaagaaatatagacagatataagataaacaagttctatggatctaatgtacagcttgagtggtaatggatgatgtgttaaataattcgactatggtagccaggtgcggtggctcacacctgtaatcccagcactttgggaggccgaggtgggcggatcatgaggtcaggagatcgagaccatcctggctaacacggtgaaaccctgcctctactaaaaatacaaaaaattagctgggtgtggtggcgggcacctgtagtcccagctaatcgggaggctgaggcaggagaatcgcctgaacccaagaggtggaggttgcagtgagccaagattgcaccactgcactccagcctggccaatagcgagacactgtctcaaaaaaaaaaaaaaattttgactatggtaatcattatacagtgtagacgtatttcaaatcaccatgttgtataccttgaatatattcaatctttggcaagtaatttttttttttttttttgagacagggtctggctctgtcacctccagactggagttcaatggcacaatctcagctcaccacaacctctgccgcctgagctcaagcaatcctcccatctcagcttcctaagtagctgggactacaggcgcatgccaccacgttcgttaatttttgtattttttgtagagacacagttttgccatgtttcccaggctggactcgaactcctgagcttgagtggtctgcccgccacagcctcccaaagtgctgggattacaggtgtgagccatcacgcctggcccaagtaaatatttttgaataaaaaaaatagatactattcacataaacaaaactctttgatattctcaataattttttaagagtattaaaggagtgtgaaaccaaaaagtttgaaaactgctattctgtaacaaatgacattttagaaatatgggtgcctctagaagttaaatcgggacggtgatgtgaatatgttgtctatatccttgtttctcaaagtatggcctaaggtacatctgcatcagtattacctgggagcttattaaaaatgcaggatcttgggcctcatcccagacttcctgaatcagaatcttcattttaacaagatctctggatgatttgtatacatattaatgtttgagaagctctaatctgtattacaccacactaacatttattttaatccagcatcgttcctaaaaggattaaagaaaactatataaataaatatcttcattatacatatgtactttataaaaatatatatagtttaatatgtaaatgcatgaacactaatagacatagttttttgaggctattattgatactgtcattgcaagcagttctttattttaaccatttggtcccactgttatcatatcataatatcagaacttcatgatacgagttcacagtcttgggtttgggtcatatatttaccaactttgtcatctcagataaaaattcaaactaatttccccatttgtaaattttacctataaaaatgaaataatgtatgttgaaaacatttgtaaactgaatgctaatgcatattagtctaagttttgctaggaattttacattaaacctgtatgcattattgcatagcctttaaagaaattccaatatatattttaaacagttcatttccctagagtttggtactaatggagttttatcccctagtgagtcaattacctttaattcattctatggctaacctacagcacaaactctagcagatttgtataggattatatgaatgggttggtatagatctatcctcagtatggcagaagaataacagcacagatctaataaaggtgagtcactttcagagctacagattttagactccccctagtggccatctggcaacaatcaaatttatacaaccatctttcaccttgctttctgtttgccttttgccactcttttttaagatctttagcaatctgaagaaaaaacaaaattctagtattagccattaccataaaatgtttttaggtgcttgttgtatttcaaaaaaattttttaaactattctgtctgttaaataaagttaacctaactgaggggtggacattaagaacctgaaagatagaaatcagagttataatacattgcaaactagaagagaagttaacagtacaagtgacagtaattatcacaatacttgatataattatgagggagaagcagactaacactaatttcacagtatttgcactagaccctttatttgtctattttaatccttcttcagccctggacttcatagatgaggaactcaagaatttagtaactgtcagacaatgagtacatggcaatagagttacactgccatgtagatgtgtactttttgactagaaagcctttagccaccattacatactgtcttaaaaaaacaagttaaattgcatggttttcatatcaaattttataatctgataagttatcaacatagtctaatgaattaaagaaagtaattttcattatggtgagaaaaatgcaattaagtgctttgtgtataaataggtattaaatattttgagattattttttgtcctctttttttttttttttttttttttttttttttttttttttgagacggaatgtcactctgccccccaggctgtagtgcagtggtgcgatcttggctgactgcaagatccacctcccgggttcacatcattctgctgcctcagcctcccaagtagctgggattacaggtgcccatcaccacacccatctaatttttatgtatttttagtagagacagggttttaccgtgttagctaggatggtctcaatctcctgacctggtgacccacccgcctcggcctcccaaagtgctgggattacaggtgtgaaccaccgcgcccggccttttcgtcctctctttcatgcacagttctcctttagttttccatcaatttggtatgtatttctatcaacttggggctgtttaatttaaatcagtaacgctaactattctgactagagaaatttaaaataagttgatctgaaagagtttaagaagaatttgagttgtgtaggagcatttatacacaaaatgttattttaaatttttactgttctggatttttcatcatatgaaaaacatttaatgaacatctccacacttttttccaccacttttctaggtctaattgtccaaaatgtggctctactggtgaatctggaaatgccaattacagatacaaactttccttaaaagttgcagaatcaaacaaattgtttgttattactgtatttggaagttgcttagatacattttttggtcttactgccactggtttgcacaggtaagaatacttaaaacatcctttttcctgactgcccttagaatttgaagatacaagtttataaggcaatatgcatttttgtagaaagataatcattcaaccccagattgtcaattcctttaaaagacaagcaagtaagaaagatgtttatttcctgaatacatattatgatgatattaaaacagtctccttttatttagggtaattaatctgtaattagaatattaagttataaatctctaatccaagttacagaaatagaggctaagaaagtaacatcatttcaaattgaagaattatccaaattgaggttagcattgaaacagttaggttcccctgaggcagaagaatctatttgagggaatatttgcatttcagaaattgaaattttattttttatctgtattgcaatttaatttgcatagtttgaccttttacgacattgtcctgagaatataagaataagcaattaaagcttttcttggccgggcgcggtagctcacgcctgtaatcccagcgctttgggaggccgaggcgggcggatcacaaggtcaggagatggagaccatcctggctaacacggtgaaaccccatctctactaaaaatacaaaaaattagctgggcatggtggtgggcgcctgtagtcccagctacgccgggaggctgaggcaggagaatggcatgaacccaggaggcagagcttgtagtgagccaagattgcaccactgcactccagcctgggagacagagcgagactctgtctcaaaaaaaaaaaaaaaagcttttcttccccctcagtcttctgccctcctcccctaatcacatgcaagaaatctatgtccacatttttgtgcttgagacaataaagggaccacaaccaggcttatcagagaaaagggatgactttttcctgctttcaagtgaagagctagagatgccaccactattcccactgccacttttatttttccttataatcattgccgggcctgatggttaggcaggtaactactttactcccacttgatcaattggttttgttgatttttctgtgctatgagaaactagagagaacaaactgcctggctcttaaagtcactttttttcctctataaaaggttcatgctgcattttcaaattaattgtgtctctgactttatggcaagtaaaatttcaaagttcattgcttcacattttttactttttttccaatcaaggtacattcaggatcctaataaaattccagaaacactggacaatgatacaactcagaatctattaactaaagcagttgaaacttgctttgttggacaaagctttatttttggagtgacggtaattgagactagctttctttttaataatctgttaacatttccattgtaatgaattatgtgaattttctaaatagttgttaggagttctgtacatgtgaaggcctgtagaaacactttaaactatgtaaaaatagcctataggtggtctgttaaaacaccatgtgtgacaacttcctctttcgaaagtcaggggagcctacttcaaatgctttcagagcttaaaaatataaatttattatatatttagaaatgttagatatttgtttttggtatttagtatttattttgccctccggattttgttcaaattctatagtaaaacttccaccaattctctagctttttaattctgtcttctataaaagagaataatggaacactgaaggcaaagtatcttgagtattgataagaatactaaaactagattaagaaagatggtcttaaatataaaagtgactgtagaagaagttaaaaaaaaaagaagttactcctttgactttgaaggagtaatagttttctgtctcatctatgctaaagggaacaaagagacatttttttccacactggaatcagggttttaaaagaggactccacaacagaagagtgagaaaaatccaaagggaaggtagaatcaacggctacagagctttacttgttaaaatcgtagacagtccttttctctcctctcttctttttcctcctcccctttttcccctcccctcccctcctctctttccttagctaaagagaactatgatagttgccatttattgagccactgctattttctaagcactgtgcagttttccattttattactaaacagtaatcctgcatttttatttttatttttattttataaaggagaagactcaggttaaataaattgtccaaagtctcaacactattaataaatgcgggaactaggatttcttcaaatcagtttaaacaagctctttactctaaggtttatattctcttacatatgctactttgcctataaaactaacagaatcgaaattggaattgggggatggaggtaatagttgtatctgttttaaccttttaaatctgtttattttattttatttttgagacagaatctcactctgtcacccaggctggactgcagtaccaagatcatggctcactgcagccttgacctccctaggctctggtgatctcccaccccagcctcctgagtagctgagactacaggcacacgccaccatgcccagctaatttttgtgggggtattttttttagaggagaggttttaccatgttgcccagtctggtctcaaactcttgaggctcaagtgatctgcctgcctcggcctctcaaagtgctgggattacaggcatgagccactgtgcctggctaaatttctgtttcatgtttaagtaaatggaagacaattttattcttacttaaatttctttgcttctttcacagaattttgaaaaccaacctggacaaggttcagatgccagtaacttcttacagcaatgctctgaccacaaaagaaaagccaaagcactagtggcttgccagattgttctaccagacccaggtattgcaggctttactgtcattgactacttccatcaacttttgcagacttttaatttcaggaaacttcagtgtgactctcaggcacctaacaatcacttacttgctttagatcactcaaatagtgatctcagcagcatatatacttctgacagcacttctgattttttcaagtcctgcagcaaggatactttttcaaaattctggcagccatcacttgaattcacttgcattgtttcacaactaacagataatgatgatttttcagcttcagaacaaagtaaggcctttggtactcttcagcagaacagaaagtccatctccattgcagaggccactggttccagtagctgccatgatcccattcaggattcatggagccttgtttcatatatggataaaaagagtacagcagaaaagttgggtaaagaacttggcttacaagctaaggagctgagtgcagttcacagcagtcatcatgaaattggagttaatgactctaatttattctctttggaaatgcgagagccccttgagtcaagtaatacaaaatccttccacagtgcagtggaaattaaaaataggtcccagcatgagctaccatgttttcagcatcatggtatagataccccaactagccttcagaagagatctgcatgttgtccaccttcgttactcagacttgaagagacagccagcagttcccaggatggtgaccctcaaatttgggatgatctgccattctctgaaagcctgaacaagtttctggcagttcttgaaagtgagattgctgtaacccaggcagatgtcagtagtaggaaacatcatgtagataatgacattgataaatttcatgcagaccacagcaggttatctgtgactccccagagaactactggagccctgcatacaccacctatagctttaagatcatcacaagtaatagtcaaagcaaactgtagcaaagatgacttccttttcaactgtaaaggaaatctaagtcctagtgttgaaaaggagtcacaaccagataacaaagtagaggctgtctctgtaaatcataatggaagagatatgtcagaatattttttaccgaatccttacctgtcagctctgtcttcatcttcaaaagatttagaaacaatagttactcttaagaagactatcagaatctcaccacacagggagagtgaccattctagtctaaataacaaatatttgaatggatgtggagaaatatcagtttcagaaatgaatgaaaagttgacaactctgtgttataggaagtataatgatgtctctgatctttgcaaattagaaaataaacaatattgtaggtggtccaagaaccaagatgacagttttacaatttgcaggaaacttacatatcctttagaaactctttgcaatagtccaaatagaagtacaaatacattgaaagaaatgccttggggacatatcaataacaacgtaacacagagctattctattggttatgaaggtagctatgatgcctctgctgatctctttgatgatattgctaaagaaatggacattgcaactgagattaccaaaaaatcacaggatattttgttaaaatggggaacatctttggcagaaagtcacccttcagagtctgatttttcactgagatcactttctgaagacttcatccagccttcacaaaaattatccttgcaaagcctatctgactctaggcattcaagaacatgctctccaacacctcattttcaatcagattcagaatataattttgaaaatagtcaagactttgttccatgttcacagtcaactccaatttcagggttccaccaaacaagaattcatgggataaacagagctttcaaaaaacctgtattttattcagatcttgatggtaactatgaaaaaataaggattttccctgaaaatgacaaacagcaagccagcccaagctgtccaaaaaatataaaaacacctagccagaaaatcagaagccctattgtatctggtgtttcacaaccagacgttttcaatcactacccttttgctgagtgccatgaaactgatagtgatgaatgggtccctcctaccacacaaaaaatatttccttcagatatgcttggattccaaggcataggtctagggaaatgccttgctgcctatcatttccctgatcaacaagagttaccaagaaagaaactgaaacatattagacaaggaaccaataaaggtttaattaagaagaaattaaagaatatgcttgcagcagttgttacgaaaaagaaaactcataaatataactgtaaaagttcaggctggatttccaaatgtccagacattcaagtcttagcagcacctcagctgcaccctattcttggacctgattcttgttcagaagtcaaatgttgccttccattttcagaaaaaggcccaccttcagtgtgtgaaactcgaagtgcttggtcacctgaattgttttcataaaaagtcacctgaacccaattcctgaacttttaaatctgtttggaaatgtttgccttcaggggtacggaaagcattctttacattttgaacacttggagagaagcaaattgaaaacaggactctgctgggagctactgtgccttttaaaatataaagccattgttttccccagggttttatctagaatactatgattaggtagttgagcactttatcttatactgtttattgtactttaataatattgttaagattgtttttgaaagtattaatgtttgttaaaatcacatatacatccagaaataaagactttgcaaaccaa

SEQ ID NO: 757 - DNA, 90407 bp, Homo sapiens
tgctgattcatggacttcccccatttttttatttctatataacacatttaaggacattaatgtactaaaacgtttggtctgtgaaatagcggaatcattagcaccaaaaggagttatggagcttgtatatattattaaaacaatgattgttactgttggtcatgggtaaaggtttcatttcatttttacatcccaaagttcttgaaagtgcctgtggacaagagaaataacacttttcaaaatctccatggggtcgtcaatacgcaccacagagactgtacttggccttcccagttttggtttatctggtagacaagaaaaccagggcccccagatgattaccaccgaagccctaaagaagagttcccacatgcacccactgatgtgcaggagggatccctacagtacatttccccccggactctgtttaggaatgcgcttttacttgctttttaaaaaaacaaaagcaacatgctctgcagatcatggagtgcctagtgcaattttctccttgctccaactccagactggaaaagggtgaaaccattatatgttctgctaatgctggcctgtggtcgaggcccttggcctgccatgctttgtaagctcaggagcccacaggagtcagaaggtcagagagcgggagccacagtcatcgccagatctccccagcatctcatggcccatcagggcagttgctgattccttttcttctccgtgcctcagcctttagttgaaattacaacaagtcaaatagctgatgcttttcccttctccaggtaagggtgaggatacattgttcacaagtgtgttctgtctggcttcactgatgagtcggcatgctaagtcaaggaagagtttctccacattatcagattccttggctgaggtctccagataatacatgtcctgagcttctgagaattcttcagctcgctgctgggaaacctctctcctttcagccaggtcaatcttgttgcctataacagtagtaaaatcaaataaagaatcagcatttgactttttgcaggctgagaagcatcaaaattcaactccatatctgaagtcaagccagacagatgggcgagtaaaacaaaacaaatgtgactgtgattactgaaatgtttactttaaaatatgagtgccagctgggcgcagtggctcacacctgtaatcccagcactttaggaggccaaggcgggtggatcaccaggtcaggagttcgagactagcctggccaatatggtgaaaccccgtctctactaaaaatacaaaaattagccaggtgtggtggcacgcacctgtagtcccagctacttgggaggctgaggcagaagaatcgcttgaaccccagaggcagaggttgcagtgagtcgagatcatgccactgcactctagcttgggtgacagagtgagactctgtctcaaaaaaaataaataaataaaaaatgagtgccattcataatggcaagaactggagacaacccaaatgtccatcggtagggcactgactgaataaagtatggcacatccacccaatggagtatttgctgccataaaaatcaattaggagtatttctatatactgccatgtaatggaaacactgggatatactgttaaccaaaaaaaaagcgaagcagaaaaaaaaagcatatacaatacgcaactgtctatccaagaaaaagggaaggatatgaatacatatattatacacacattttatttatttttttaatagaagactagaccaaaatcttaatttaaaagaaaatggttacctatgaaaggaacagggttgaggtgaaaggaatagaaaccagacctctctgaatatactttgttttgtagattttactttaggaacttaaaaatgctttatataattatacaattaatttcaaaattaaatttaaaaagcaatccctaaaaactgagagcaaaattaaacaaatgaacatgttcatcatgtgtggaataaccacacagaccgtaaccctttttttcttttaactgagacaaggtctggctctattgcccaggctggagggcagtggcgcgatcctgacttgctgcaactccacctcctgggctcaagccatcttctcccacctcagcctcccaagtagctgggactacaggcaggcactaccatgcccagctaattttttttttttattttttgcagagacagagtttcgccacgtccaggctggtcttgaacttgtgagcttaagcgatccacctgcctcggcctccagaagtgctgggattacacgcaattgagccaccgagccgggccaacagagtaactatttcaaggtgcttaagatacagtaatttaacagtgcaaccccagtggtatatagcctaaggacaaaaagaattgaaggaaacaatcttgaactgtttcagtaatcatctttttggtggtactgttggtattattattctgaggttgctatctgtgtattatgggataaagcaaatgagtaattatgctggtaccattgggaactgggacttttggcataggaaaaaggaaatataaatataaaattaatgtggttaagtaaaatttctgcagtcctgaattataaatagaagtatcagtatgaataattcatgatgtattttatctttaaaaagttttccacctacctcaaattctccaggaaacctgacaaaggtgtgtcaattgtattatctggcaacaccgcttatggtaaaaatgacccctgattgataaatgacttctggcctgggaattctatctaagaattataaatacctaatggaaagccataactttgagcttccctgaatgtggtgacttcatttgaagagaccctggaagttatgattgtggagttgttataatagatttagtctcctatggggtattgaggctgctaggccaaggcagatcctccatctgtttgacatgagccttgttccctcatactagaatcgtctgggggttgcggactgggtaggaggtcctggaaaattacgtggactgctactgggattacttccactgaagagggttgccggatgctgatctgctgtcaagctgtatttcctgtcctgtgtccttctaagtgaacacgatgccacgcgtggtctacggtagtcttgtgagtcggaacgctagcagaacctaataggaaaactctcttgaggatactacagaatccaccacacacatgcacacatacacacaagctctgtccactgaaaggcctaaaaacaatggcccatcaggagggctcctaacacctcggttgtggcctctaaatacgacttcccattgaaaagaaagcacttcttgaagaaatggctaattccaggtctggggcaggaaatgcacaagttgtggctggaacacttgtcataccagaaagcaaaaaaattatccaacattcctggggtcatgtcaaaaggactcaggagcccatttgaagaagctcccactggcaaagtcggaacaatgggagcatcaataataataattgcaagggactgaaatacatcaaatttacttatttagttagtttttgagacagagtctcgctctgttgcccaggctggagtgcagtggtgcaatctcggctcactgtatcctgtgtctcccaggttcaagagattctcctgccttggcctcccgctgggattacaggcatgcttggctaattttttgtatattttagtagagatggggtttcaccatgttgcccaggctggtctcaaactcccgacctcaagtgatccacccgcctcagcctcccaaagtgttgggattacaggcatgagtcaccatgcccagcccatcaaatctatttaaatctataaatttataataatattacaaatataaacagatgtcaatagttaacttttagaagatactggagaaccagcttattaccttgaaaagtggtgaacaaaaaagaatcaagcattcttcctgcctgttctatgagaactacccctcagagtatgatatatgtagtgttttgtctaaaaagaaaaccaaaaaaatcctgactctcatcaggcctctagacttatctataaatctgcaagaaatataggtgatggaggtgatatcaaatgacaccttggggcgataaaacaaaatttagacttgtaaagcctataggtcaaacaaatgcattagcaaaaaattctaagagagaaaaaaaatgagagtggaaacttcataaaaaaggatgaaaagatgtagctgtcaattacaacatatggaccttacttggctttttttttttttttttttaaagagtctggctctgtcacccaggctgaatgcagtggtgtgatcatagctccctgcagccttcaacttctgggctcaggtgatcctcctgcttcagcttcctgagtagctgggaccacaggtagatgccatcatgcctggctaatctcgctacattgcccaggctggtcagaactgctgggctcaagcaatcctcctgcctcagcttcccagaacactgagattacaggtgtgagccaccatgcccggcttctggaccttatttggatcttaatttgaacaaacaaacgaaaaaaaatcatgagtcgatcagggaaatttgaacactgtctaagtttttaaggatactaaggaattgttaacatattttaggtgtaaaaatgccactgaggttaggttttctttttaaaaatctattagagatatacacagatattgaaacatgaattaatacaacctctgagatttgcttcaaaataatctgagggagaaggtggacagcattgctagggaagagaaaataagattggtcatgagttggtaactgtgaaagctgggagatgtgtagaaggggattcactatactgtttctctactcttgtttatgtctgaaattttccatagtaaaattgtgttttaagccaattcctctttcatattgaactaactgtctcccctcaaatcttcatttaccttccttagataaaatcccaagtagtaatgctttgactcaagttcccaaaggctttctgtaaaacagaaggtacaaatgcagacctctcaaatgctttatggcaaaggttcaacattgtccaaaagggttttacagggagcactagctcatagaaacacagatgcttcatccagcagcctgaaggaaaagtccagcaatttgttacaacgtaacatattacagctggacaactacagggcttggagttgatcttacatgctatgtgaccttgggaaaagaacttcacctctttgagccgtggtttcctgatctgtaaatcagggatcatgacacataaagttcctcgtatcattcctggcacatatataccaattataacactattctaaagtgtttactgagcttattattaaccataatttgtaacttaacaatgcttctaaggatctctactcaaatttccctaattcaggtattgctagactatataggaacgttcctttctaggaagaaaatatgttaatgatcaaatggttactaacacttttccactacaaacagagaagtttttaatgacctggtccatttcaatgcatatatcagtcatgatagaaaatcaagggttgttttgtgctttccccccatactaaatagaggttttattctcctacaagatgaaacaaactacagcattgcccttagcagattctttctgaaacacagaatttctcaaatcagcctaaatgttaggaagggaaaaaaaattaccaaaatccaccttttaggcaataaacaattgcttcaataatgaattccatatcaacttaaaagatacatttttcttctagaacagccattcctttcatcttgtaattagactttttaaatttttagcagctcacataactttcatggccatccaacttcttccctagagcctacattgatagaaaatgttttctactttatttttctaaactgtcaccatgggataggacctatttcattttctcttcaattgcagaagaactgaaggttgactgcatgaattattagctaaagactatattcttggaaggcaccaatgtataagctttatgtgattataaatcctctaatgcccacaaatcaatttccctcctcgttagcccttacttacccactaacacagtgatgaccttgttgctggcatattgttctatctcccgcagccactcaggaaggcaacggaaggattcctcacaggtaatgtcataggtgaggatcaaggcattggcgcttcggtagtaactctgggtaatggaccgaaatctctcttgacctgctgtgtcccagatctgtagctgtaaaggcataagataagaatcaggtgaagaaggatcaggttggagaaaaaaagaaaaaaaaagctttgccttgctttggtttgaaaatgggtacacctttacccaaacaatttcatggttattttctgccctaaaaaaaaaaaaaaaaaaaaaaaaaaaagcactgaaaattaaaaaaaaaaaaatctgttgggtgtgtttctggttagggagaggggcttattttgttttgttttgttttttctttgttaagagtttccttttcattcttaaaaaaatacatataggaaattcgtcaagcatttattatgtgccaagctctattctaagcattttacctgtggcaactcacttattcctcacagtaaccctatgaggtagatactatcataatacccatttcttgcatgaataaactgaggcacagtaagattaattaacttgttcagcatctcatagccaatatgtcccagaaccaattcaaccaggcattgtggtcccagagtccccgttcttactcacaatgccatattacaaaaggcatgatacagggcaagctgtgactgttggcatttaatcagcaactggagggagagccaacctcaccacttttccagttcaaaattcaaatggatgtattaaggtattatctttgttaaagaaaacaggaatcatgccatggcagacaacaatataattttccttcaggtctcttaagttctatgaccttggccaagtcacttaatctctttgggctttgattatttctttataaaaagtggttaataacacacaacctgctgaaggttcactttttctgcagttatctaccagttctaagtcctaataactaataattctaataacaaagaagaagacaatacttgtcaatttccctgcacagagtagacaactactgaaaacgaattattctccagggtggctgctaagtgtagaacaaaacacaaggccttgagaaataagaacatcaacaaaaacaataatctttccttctaattgcacgaatttcacaggtcacaggtgtattcatgtccagggacataagattgcttcctcaggaaggctttccagaaccttcagattaggctaggttccccacccccccaccccacacagtctctcttgcgatacatcctgtcattctccctcatggcacctgacatgcctgaatcatttatttgtaataatttgtttaatagccatctttcccactaaactgaaagcttcatgagggagacgtcagggtccatttagagcaaatagagcacttggcaaataggaggtgctcaaatatttactgatggtctcatttaatctttacaacaatccagtgaggtaggcaagtgtacacctccccgtattaatggaaactgtcccttaactaactggttattcacaaagctaggacatggcatccaggccttctatttccagttgaggactcattccatgctcccatgctgctgttgccaccaaagactaactaaaatgtgcatctgtatccaaagaggatgaatccattgctgtcaccctctgctcatactagcttagctaaagagactgctgagtgacccgtagtccctgccatgaatcagcagcacacaaaggctctcctttgatctgcagttgcagctgctcttcgatgatacacatgaaagcctgtgtatgctaaaggccactgtacagatgttacggtttttgctgggacaaaggctatttctcttctctgcctcaaacctagggacacggttcccctctgccaggatgtgtcttagaataatgggctattgttttaaagctgcactgagcccctaaaacacttgtgattgcgatttaggaactgttcagtattagaaatcagtgtgttcccacatcttgagaacagcttcgagggttaaagtcactgaaatattttctagaacagcgattgtatgagcatgccaagatatgttaccttctcatagggggctgcctgtttctagctgacagttgattattgaggatattcatattctactgcctttgtcactcaacttggtttcaccattctctgcaattcatttgcgcctttcggcatctataggacattaatatatgcaaggtactgtgctaggcacatggagtatataaagatgaataaaacacagggaggatataaagatgaataaaatcaacgctgatttcaaacagctcacagtctatagaaaggacacacacagttaattaactatagcagaatacaagatgttctattaaaaaggaagagagcgtctcctgctgttagtctcatgcctgtcaatatgttttcaatactgtagccacgggctttctaaccactctcaccttcagcatgtggctacattgtttgtctactctcttctctgcaccactacttaaactccattgcctcaccgtcataataatgtactgcaatcattggtttactactctactactgagttctttgagagcaaaggctgtcttttatttgaccttacacccccagtaccttcctaacacagcacacagcacgtggtagaaacatttgaatgatggctaactaaatgaacaaaggattgtggaatcacaagggaggaactggtcaattctacttaacagattagtagggtattaaagaagatttcacagatggagctagatgatagtaagttcctaaggggcagggatgctttaccaccacagtgcttggcacaaaacatttactacaacacaggatggaggaatgaatggatggacagatggttgaagaaacaaatacatataaatactttcatgactctcctatctatcaacatagatctgactggaaagagatacagcaaatcttctatttctattatgatttatctcttaaggctaaaatggtttaaattgagcttagagtttttcttattactcattaatttataatagactaaaatatatatgagaaagttctgtgttttttccattttttttattctgctaaaacatacataaaatttatcattttaaccacttttaagcatacagttcagtggtctatatatgttttaattatattttctaccagaggtcaccttcataatgcagacccttttaagagaagggcctcttcattaattttgtttttactgatttggcgcttacttggccttaatagctacaaaaatctaataccttggattccctgccttcaatcctgggagccatcctggaaaaaatgatacttgtagaggacactgatgagggtgtcaggagagtggtcctgccactcaccaagcgggtgatgccatacgaatcactggtggattctcttatccactgactttatgaggctctgggaaagcccgcaaactactagcaaaaagacactttaacatcactgagaaaagatactcagtaaatgttaaagaagaaggatgacaggctggatgtggtatctcatgcctgtaatcccagcactgtgggaggctgaggcagaaggattacttcagcccaggagtgatcaacatggcaacatagtgagaccccatctctacaaaaaataaaaataaaaatgaatagctgggcatggtggcacacacctgtagtcccagctacttgggaggctgaggtgagaggatcacttgagcctaggaggtcgaggctgcagtgagctgtgattgcaccactgcactccagcctaggcaacagagcaagaccctttctcaaaaaaaaaaaaaaaaaaaaaaaagatgacaataagacaactatgcagttctgccctcttctaagaaaggattaaagaagttgttcctcatatgcctacatgttaatgaggcccttaaattcatgtggttgaagagggccaccctgtatctttattttatatattgggcttgaaagaatcacaggcaagttgatttggactggatttgggagatgagccaactgtcactttttatagataaagttctagaagcctgaagaagtactggggatagaaagtgtgctgtgaatacaaatatgagtaagacacaaaccttgctcttggggagcctgtggccttatggtggagtcagatgttataaaaatatcaatttttgcagtgtaataagcactttttaaaataaggtttgcagaaagtagaataaatggaatatttatgcctgggaattcaggaaagaaaaataagcctgttctttaacagcagggaccattccttattcacccttatttatggccagtgcctggaaggtagtaggcactaaatcaaataaatgaactcatatatatatgaatggaaaacccaaatatctggaagtaaaatgcatgaaatagtagttatctttacccaactccttgggtaactacctcccctccactaggacaacagaaagctacaaaaggctcctcccatcaatgcctcctgagcacactcctgtctctctttcctgtccccacagcctagctccttcttcccaccccccacactatttttgttcactttttagttagcatttatgtggatttcataccctgcttttatcttccagtgctccagctccccattcactgctgtatttggtgtggatgtctctgcagtatgagctattttaaggagtcagggctggaagagacactgagagagcttctggcccccattcaaggacctcctcctaaacacttctctgtgatggcaagtatctagaaaatgctgaagagcattatggagcttctctgctcttcccaaggcactcaaaggaaggagagcatgtacgtatgggagaaggatgcaaataaatggacccaaacataggatgcttaggttgggaatcaaggtagaactctaaaatgccagttttcattgtgctgctgatagctgggctatccttcctttccttccttctttccatccctcccccagccttctctctctctttctctctctctgtcaccaacacacacacacacacacacacacacacacacacacggtctcgttctgtcacccaggctggagtgcaatggcacaatcatggctcactgcagactcaacttcccaggctcaaacaatgctctcactcagcttcccgagtagctgggactacaggcgcatgccaccatgaccagacaattttttatcttttgaagacatggagtctcgctatgtcttcaactcctggcctcccaaagtattgggattataggcgtgagccactgtaccaggccttggctatcacttctttccataaaacccagctctgaagagccaactgtggaacttcagtaactctgacggcaggtagagcacagtgccaaacatcagtatatttatcctccttccaggtgatttagtctcccttcacatttctttccatcaccttcctcctttccttgctccaggtgataggcctagtgtgcctttcttcccttcttctttcatggcagaggagaccccagaaaggcagtggggtgtactggttggtgaaatgggttcaaatcctgcctgtcccccttcctatacttatctatgtgtagccatggataagtaagttatttaacctctctgaagccagtaaaacgaggataataccacttaccccacaggtttacagtaaggactaaactaaatataacatatgtaaaagcacccagcagaggcactgacagattgtaggtactcaataaacattctctcctttgtcctgttcctggacacaccatacttcttccaagtaccaaatcatccagaagccacaaaggctggaggggcaggaagcaggggctagagagcatgtatcctttcccatactcctcatttagtgtctttcctttttagagacaaggatatgagaggagacaggataatttaaataagtgattcataatgaaatgtagaaatcgggaggctctttcatggggctgctgtttagaggaggtagcacctgcttattggcccagctcaagagatccaaaaagaaatttcttccttatctttatgtcacttgtgacatgacaggagacaggacaaacttgccttagccattttctgtcttctaatctgtaaacacatcatccaaaattccttccttcccccataaaaaagactagaagaactctggaaataagccattatggctgagtgcattgtttccatgtgggtttcaattaggagatttaataaatggttatgaaagcagtacttcccctaacctctcacatagcacctgacaaccttagtgaatatttagcaccttacctttactttttcaccattaatctccactgtcttaatcataaaatcaactccaattgtggctccttgacctggggggaaaagaccctgaagaagaaataatagaaaagaacagctaagcaaatatttccattaaatgaaattttctcctctcccccagcaacacccatcaccggagtccttccttcagctgaggtgactggtagaaaagagaactctggttactctcaagggagccctgtgcaactctgtatgtatgtcttgagggaaagagaaaggagggagaaagtgggagagagaaatgctgaaagaagaggaaagagacaggaggacagagaaaaggagataaagacaggtgaaggagaaaattgagaaagggcaggggaacctgattttaagaatgaaaaagaaaaatcagacacgaagataagattgaagggcatgcgaccacagggatgagatcagaattggaagggtcagggcaaaatggataggttctttctaaaagataaaatcaaggatacttaaaactagttatcagtcttgagcatggacagccacgggaatgggcaacaatatgaaaaaacaaataagaactcagcatgagaagcgggaataagacagttttgggatctgtctttttggatctcctgaagcttctgaattttcctttgccccagggtgatcactgttttcctcagtacaatgtaccatgcatgtgtaattacatgggatcaaagccaaagacactgggaagataatctaagaaaattaagtcatcaaggagacagtagggtagaaacagcactaaaccaggaggcagcagccttaggatctctgtgtaacctcaaacaaaccactcaccctctctgggcctcaaattcaatgagtttgaggctgatgtaagccattttaaaacaaataaacaaaatgctttacttcaaactggaaacttaaccagaaagatgagattttaacaaaggtacaagtataatttatgcaatttactattacataatgtttcctatacgcttagggagggagttgggagtagcaagaaattctgtcaagaaagaactcttcacccagtttctcttccctcttcacttatattccagaatttccagaaattaaagtaaaatggacgttattagttctggcaactatgactcagatatctttaattaagaattatttaaagttttagcttaaaagactgaacttcaaaccaaaagaaaatgttctactgcatgtttgcaaaagatgtaaatataaacattcataactttactttcaaatattgaatcaattttcttctattttggcttggctcagatacaaaagctgtcaagcttcaagtttatagctccagatgttttgcacctcaacaaatgccaagaagttaaacgaattcttcccaatgtttcacctaccattttgttcccaacctctgtgcctaaaaaacagctagatccagttcattttaactgtctgctaaataacaaaaacaaacataatcttgcctctgacatatgagtttatggtggagttgaggagctgggaggggtaaaacgtagacataaaagacaaataagaaagaagaaaaaagagcttgttggcaaaaaattactgttgaaaatggagacattttcacatctaatgacagagtttgtgcttttaaagagaatggtctcagaagttagaatgtataggagacaaattatcaggctaagaacctggaacccgggttctaatcctagccttgccactctatctaatctcacaatataagatcctaagcaggcatttagcccctctagatctgacctttcatctataaagtgagagaggtgggttgaataatctctaagtgacctttcaatactaagacaaggtcaaggaaacttttgataaagggactgaaaactttactacatctctgcagtcttatccttttgtcaaaagcagaaaatatgactaatgttaggtagaagtaaaaccagctggagtttccaatatatctccatggcagttgactgagcccagatgcctattagcttgttacttttgatttcaccaggccacggcttagtaaaaagcatgggttctattcacttatcatgggaaaaaccctgacatttccaaagtgactctgggccctctagctatttgttattcaatctgtctctttcgttttccgcaaaaccacagactgtcagagctggaaggggccttggagctcacccagcccctgatgtgcaacaggcagtcccaggaaagggaggtaacttacccaggctcacagagcaagccaggggcagaaccaggactaagacccatgtctcaactcccaagccagtgctctttccacagcaccaggttatcctatgccttagatagaggagcaagttccaacttgctgaacaagtactttatgaaaattcaagatatgtatgtaatggtcctacaaagggtatcattcatatttttcaggggaaaacacacaaaaaaggtcaactttggaatgatttctatataaaagcagtatataatctccagcagtgattctcaaaagggcagtcccaaagggaacctgtacttagatcatatgataagaattgaattcaacccagagaggccattcaattcagttcagataattcttcactattttcatttcattcctactgaagaggtttagaaaattggcctatttggtcctaaatgaaaatgattcactcaagtttcctgggaggatgtaagggggcataggcagagtttgattggtttaatttgtattagagttttaaaaaatttaggttcagtttgacgtccagattcatttgtttccacctggggattattaattagtaacttccttttatccaataatttagttttgatactgcacactgacagcaaaaccacttgcctttgtcattaaaggaagcaagaagaggcatgggagggttggtggagactcccagggccatgctcccgtgaggtggtttaaaaaccccttgtcttggctacaaagcagatgcagctttcaaagggtgcatcaggaactcacagctaagaccctggcattgaaactggtcatccatctcgacagattcccccaacccctcaggctagactgacaaacccaaccctgggcttacgagttcccttacgagttcccttacctgagtgaatcttcggacgaggcacgtcttccccacaccagcgttgccaattaaaacaattttgaacaggaaatcataatcttccatactcatttacacagctgcaaggcaaacacaggcaaaagtgagaaaggcccagtcagacttgcccacagagctcaagctgcaccagccttctctccgggggaacaggtctgactcatttaaagagcaatttaaagctcccctccggtgaccctgccagctagacagaaacacaggtgtttggtcacagacggactttattccttctcagctacctcatgccacagagaataaatgacgcagatgtcgtttcacctggtaacctttattcctccaagctatcatgtcgcagtttcctcctgtgataaatctgttttctttcagcatgaaaaggagatgacaaacctctgtgcaggcaagctggggtgcaaaaaagcaaggacaatagcgagcccatccagagcttaaaggacgtttatggaatgtgtatgactctggaaagaagtactagtgatgcgcagactgaatgaagaggaaggaactataaagggcccttttagtctcctgcttctggaagtcttagggtcttacaaatggtagtcatagccatctttcccctctatctcctatacatctcctgccagccatgctgatgctacagggcctcccaaagtgcctgtctgttcactcctctgggctttggtatgtgccatttcttctgcctgggatgccctcccttccaccccttctgcaccttgaagtccttgaaggtccaatgccagcaattctttctctttgaatctttcactgatcttccccaaataaagttaaacactttcaacacttctctgtcctaaaacttcacttgctgtatacaattgtttgttcaaatatctgcctcatccttaagggatgggattatgcctgtcagctctatttcctagcccctgggacagagttactcttttaaatgtctatcctatagaaataaaaaattaattaatgggcatgttgcttatgtgtaggccttagtttctccaactgcgctagaaagactgtgactaaaagggcatactaaaagaatgctctgtctacttcagtggactgctgtgaagattttttaaaacttacaaaagaaccttatacaaaaattacccaggtgtggtggcgtgcccctgtaatcccagctactcaggaggctgaggcacaagaatcgcttgaacctgggaggcagaggttgcagtgagccgagatcacaccaccgcactccagcctgggtgacagagtgagactctgtctaaaaaaaaaaaaaaaaaaccaaccttgatacacataaagccctatcctggtaaaagcaattgtaatctactgggtgcttactataggattctgttatcaccacaggaaatacagagaagagacaatgtctgccctcaagaccaacatgagaaaagttaaataatgaaaaaaaaaaaaagctaaataacaatttgcgccaacagtgcaagagtggagctcttttcttaaggtgtaggcagaacagacccaatagactctggagagagaggaaatgggcagttagggagctcatgaggggaagggtgctgggagataggaaagcgtcagggtcactcctaccagcagacctggagctcaaatgcctgcaggcttgtagggcagagaggagagcccaattagctgaacctgtcaagtagccaggggagtaaattccctatgtgcaaagatgatgtctgtgtagatttcaattaatccttggaaaaatgactgacaaccaagccaacatgtaggtagctcatggggttccatcccagttcattgggcctgtgaaggaaaaacatttctctgtacaagaatctgggtccataagcagtggtagcattatacttggccctttatgtgtatttccatttgtttctacaagtatataaggtttgtatttactaacacattatctgttttacagattagtgaactgaggttaaaggaaattaagagggtggcctgaaatcataaagctaagcaccagattcatgttccaaaggcatatggtatcataaaaaatggagccagagagaccaaggttcataccctggctgcactgaccttctaagcctgtgcctttgggcaaatgacaatttttcaaagcctcagcttccccatcaacaaaatggggccaataacacctataccacagaactgtgatgcatgaaagaatgaatgggagcccctaagggcagtacctggctctttgtcacccaaactccttaaaaggattctcaaattttccatgatctggttcctgctgtcactgccagctctgtctcctaccactctcctcataatccacattctaggctcactggatttcctcagttacttaaataccatgggattgcttttctccttagaccttcacatatattgttccatctgcctagaacacaaaacacaactgaacctcgcaccctcccccaccaccccaagcctccctgagatctcagcttcaacatgacttcctccagtctgctcctctgacctacgaaggtcctgggcctccctgctctaggctcccacaatgacctcctttcctgctataaactcaccatgctacctgtaattaattattcacatatctcacactctggccccatcctcagcacctcagccctacacacatgtacactcatgactgtgagcagcatgagagcagtgacgtgtcaggttgagtccagatcctaacccctccccatcatcatcatctcattctatattattaagtcacttaatctcaaaacaaccctatgagggggacgctatactattagtatcctaatttggtagagggggctgctgagacacaagagaagttaaaaaagcagtcgtaaggtcccacagctggtaactagtggagctgagattcatacccagataatctggctgtcacattcatgtccttgaaccactacccaagtgcctttcacaatgctggctcagagcaaaagctcaagaaagatggatgaattacatgatgaaggcaagcacttaatcaatgtgatcaccctttcctcttcacctctggcttcaaatataaaactctaccaccctgtagaagtttaaataagaatcaaagtcaaactcctgataaacactcagggacatgatatataaactaaaattcaataacgctattagaaagaaaaataataaaactcacggaaggcacatggacagcaggaaggcatgaggctctgtggaccacaactctctgctttcataagcccataagaaacaggaaacacaggactggactgcattctttttctgtgcctagattgtttgacacacactcatttctacatctttgctggaggtcaaagaaccaaagcaggaaatccagaggagaatgtcaaaagtaaagactttagaaacagggctcttaaagaaagttaacggtgcccaaattatgcacctttagaaaaagaaggtgaaaaaaaggctttgtcggccgggcgcggtggctcacgcctgtaatcccagcactttgggaggccgaggcgggcggatcacgaggtcaggagatcgagaccacggtgaaaccccgtctctactaaaaaaaaaaatacaaaaaattagccgggcgcagtggcgggcgcctgtagtcccagctactcgggaggctgaggtaggagaatggcgtgaacccagaaggcagagcttgcagtgagctgagatcgcgccacagcactcccgcctgggcgacagaacgagactccgtctcaaaaaaaaaaaaaaaaaaaaaaaaggctttgtcatggtgaacattatctcatgtggttaccacctggagcaagctacagaataagttaagacactacccctttctataagaaattactctaatgctctgttgaatgtgtttttgtttgtttgttttgctttcttttgtttttgagacaggatcttgctctgttgcccacactagagtgcagtggcgcgatcatggatcaagtgatcctcctgcctcagcctcccaagtagctgggattacagacacaagccactgtgcccagctaattttttaaattttttttgtagagacagggtctcactatgttacccagggcttgtcctgaactcctggcctcaatcagtccttccactcagccttccaaagtgctgggattacaggcatgagccaccacgccaagacgttgcatgttttttaaatggacctctgggtaaaaattggtctttaataatgcaggctgtctatgtgtaaagctggactgtaaactccaggtaatctgttgtagttactgttttgcttctaatggaaaacacattactgaatgaaaagatcacaagattatctgcaaacttctactctttgacgaagcccttctgtttggtacataaagtaacagcccaggcatcaccaatccccatgtgatgagacagcgtttccccctgaataagggaaacccattcaaaagcatttacacccagccctaaattgacaacaaaagtcatgcctcatctagggagtagacacgccacaagatatgctactaccaaacactactgcagtattttatattctattattgttaacattgataacagctggcacttattcagtgctttttatgtcctgggtactcttctacatgtatttgctcatttaatcctcataactctatgatgtaagtactcatattattatccctaacttgcagaagaggaagctgagacagagatatcatcctaaaatcacacagctagttagtctcaggaacaggattcaaacctagatccatctgaccccaaagcctagttctttctgcaacaggatgctgctaccccctgccttgtaattgacattgtctctctgtcatgagggctagaggctcagttgaatgagtccccaggccctttgaactacagtgttctagaatctccctgctccggaagcaacacacccacactgatggagccagacactgacttcagattacacaagcgctgctcctcaccgtgccctccagcccaggattctttcaggacctgaagtcacactttagctgcatcactctcacaattcagtcatcattcatccctgtaactaagtaccaggcatagggaatataaacaggagcacagatgagcaagcaaaatccccaatatcattgtcaccacaatagttgtaaataagtggatatatggataagattcaaactggaaaaatagataagcaagatgaaaaaatgaattttaaaaagatacaggaaaagaaatctagtatgaaaagcttaaaaagaaaaacaaaaaccactgtaagcaatgtgaatttggcaacatttaaaccattctttaaaagtggcctttaccaggcgtggtggctcacgcctgtaaccctagcactttgggaggctgaggatcatttgagcccaggagttcaagtttgcagtgactcatgatcacactgctgcattccaccctgagcaacagagtgggactctgtcgataaataaatgaataagtggccttaaaaaagcctgtattcactgttgcacacctgtgcatttttcctctttccctttggggctcaatataacagataaagtcagaggccaggtcttctccccaactttctgacacacctccaaaccctagtcccctaaaatattttggtgacttgtccttattcaaaaactgtgtgtctcaggcaggtcctttgggccttgacttggtctgtaaatggaggggctgggtaaacaggcaacaaggccccttcccacaacagcaagtgtggttatgcttccatatcaaagaggcagcataggcgatgaagtaagagggcctggatctgttagagagcactgtgtggtttcctcatccataaaatggggatgatattagaatctataccagtgagttacgtgagaggcaaataagataatatatggaaaggtactccttttaaaaatatataaatggtttttcccaccattctgacaaaagtcatatatattgattgcagaaaatacagacaagcaaaaaggaaaagaaaatcatctatcatctctttccctacccagaccttctctggggaataattacagttagcattctggtatatatcctcctagtctttttcttttttcttttttttagacggaattttgctcctgttgcccaggctggagtgcaatggcgcgatctcggctcaccgcaacctctgcctcctgggttcaagcgattctcctgcctcagcctccccagtagctgggattacaggcatgcaccaccatgcctgggtaatttgtgtttttagtagagacggggtttctccatgttggtcagactggtctcaaactcccagcctcaggtgatccacgcacctcagcctcccaaagtgctgggattataggcatgagccaccacacctggctctagtctttttctttatatacactcgtgtctatgtgtatattttattacaaatttgttaatttaaaaaaaaaacagcatcatagaattatataaatttttttctatagaatggtattttcccaaaacccaaaatcagaactcatggtctgcaaatagaaccgattaccagagaccctcaaaatttattcaacatttgttcatatgaccctagatactcagtaagtgggggatgtagaggatagcttcacagtaacataactttgagaaatattaaatactatcacccaatcttggaggtttaaaatgttctgaaaattcccataatgaaggccagttaacttcatttaacacaggatttaccaaacatgattttagctgagaattcttttctcatataaaacaccttttatatatgccttgctactagggctccatgaaacattagtgtagtaaacactattatattttatagcatttgaaataagagctgcccaggtagggttgccagatatagttttttaaaaataaataataagaaatccaggtcatatcaccctgaccatgtcaaatttcagtttcagatggtcagatgtcaacaaatacactttaatataaatttgttccaaatattgcatgagacatattttaaagtttgttgtttacctgaaattcaaaatgaactggacatcccatctgagtactcaggtcacagtagaaatagaggccctaggcataacaccatgcttgcccagaagctgtggagggcgatgggcagggcatgagaaacaagatatccctgataaatccaaaacaaccagaggaataaaaaagggcaagtaaaacttcaagaaggcatcataggggttctttagaatctgggtcagactctggagggtgggttcagactggcacgggggctcagcaggtgaatctcaccctctttgatgatcccagagcactgtggaccttcctccaagtatatccccacatgtgtgtcaggcccatggaaggagccatgctttatgtgtctctcaccccctactatccttaaggacaaagactgtacctcaacaagacacctgtctctgcttgtcccactgctgtgttcagtaagtgtacactgaattgaaagcctttcatccatctttccgcctaacaaggttctgtccctggaagctcattattgcttaattactaggaggcaattactaaccattactataatcaactgctacaagctcacttgctttacatcagctgctaatttcatgttattgcaagttaattattctccttggccacaaatgtcaaacacccacctgtgctgtggctgctccttattcaccagactgtaaactccagcatttttacattgccctttatagtttacaaaattctttcacagacattatctaatctggacctcccaacaacctcaagagaaagctctaatcattcattctgcaagtgaggaaactgagggtttaggtaatgaagtgacttacttactctgacacactggtgagtcacaaggtggcctctgtatcctggctacctagaatttctcctctgccagaacacactatgtgtccccaggttcctggccatttggaccatgatttgaacacactgtgtgctaggaacggtgctaaatgttttccacatgtaatcttatttaatcttttcagtaggccatcaaatgggtattaatattcccattatacagataagaaaactgaggttcagagagattaattagttcaaaaatcaaacagctaatgagtaaaagtgcctggattcaaaacccaggtctttgtggaaaaaaattaagttggaggtctgtctcactccttatactaaaataaattctggatggattcaaagtttggatctaaaaaactgaaggcataaaagtactagaagaaaacattatatatatacatatatataaaaccttaaagtagagaaggctttctaagaattactcaaaatcaaggctataaagtaaaaaggctgagaaatttcactaaatgtttcaaaaattctgtatggcaaaacaataaaaatgaagaactgactgcaatatatattattaaggtctaattgattacatgcataaaaagttcctacaaaatgaataagaaaaattcaataaccgactagaaaaaataggctaaggacatgagcagataattcacaagaaaggaataaaaatagcacttacatttttttttttaaaaaactgatcaatcttacaaaagtaaattcaaactatagtaaatttatacttataaattataattttaactatatgtagttataataagaggccattcatctcagattggccaagtttatcctgtactggtgacactatggagaaatggggcacttgtatactactggtgggaggtaaatcaatgcaacctctatggagagcactattgatttaaagctaaaaacgctattacaaaccctctgacccagcaattgcacttctaggaatctatcacatttatactcacaaaggcacatgtagtaggatatttattacaacagtatttggaatagcaattataaaaacaacctaaaagtccattagcagaaaatggttatatagattaaggtagccatacaacaatggaccaccacacagcctgctatggatatctgcaagatgtattaaatgaaagaagcaaggcaaagaatggtgtgtttacagtatgaagaaagggcgggggcatatgattctatatctgtataggcacaagatatttttggaatgacacaaaagaaactggcaacagtagttgcccctggggaggctataatatttagctctttctaggaaagaagataacctccaactcttaaattatactctgcctttttattcagtctatagtagtgcttcaaaagcaagacagttttcctaatacagggagagaggccctgtttaaaaaaaaatctatttggggtactctgtttcaatctttgtgtctttctctttgcccagctgcaccccttcatgggacagggaccccaggaaggaatgtcccacccagactctggagttgcttttccagttcattgtgtgtatcactgctttctctaaaccatgtctcagcacagtgagtctctacaaggaggattcattctttcagaccaacttccctcaaaaccaagtatccacagtatggcagccaaaaccaatggatcaaacaatagcttgcttgtgtcatgaataaaaacaaaactctcacacattcttacagcttagaaattactctcacttcactctgacacagaacatttctgaggaagcagaaggagctcatctttttctccccattttacagaaatgagatttgaaaccaagatagtgacttgcctcaggccacgcagcatgtaagcaacagagccagaagagcaaacacaggtcccctgactccaaatcagagctgctgccaggacaaataagatctgcacatataaatctccattgggcaaggccacagacaaaactgtcaggggtggctggcatgaacacatgccatggattgggggtggagttaggaggaaggagctcagaagcagcccttagaatacttttcaagatatgcaaaaagtaaaaatgaaaatgaaaaataaagcaggcctgagacctccataatactattttcaaaaatcaagacaatcaaatattttattttattcttcatatattatgtttgatattttcctaattcctagaaatacaaaacggatttgggattccaaacatgagaatgattccacaaagcagcatttcatcagcattaacccaagcaaacacctgaattatcttctggtgctctttctgccatagtgagaagctggccatggggagcatccctacactaagcacagatttggttttccacatataggtgagaagagaagggaagaggccaccgcttaggacccactcagttaactccccaggcggggctaatttgtttcgtaccacagcacctgggagcaggtgcttgacaaagaggctcagatgtgcctggaaatactcctgctttgtttcctgggggaagaaaaaggatacccttcccactcatcgacccccttccaagttggagacttctgtctgcaaaacatgtttgttaaactgccctaaaaaaggcacttgcagacccaacttgctgtttctgtcttctgcacaagcaggtggggctccctctgttgtcctcctccaacaataaacaataccactgcaaagagctctgggctttgccccattgccttcccccttgtattctctaaatcagggaccgtgtctaatctttcctctgcagaagcttccctgcgcctgcttggctggaccggaagaaccttcttatcagcttattcagtctcctcccaccgggctgaacacacaaagcagcctggccagggagccagaggtcagggccacggctcagaactgggctcaagtctttcccctgatggtcctctgccccggagatcagaggcctaccaggaacagagatgtcttctccctgttggaagactgtcacactaggctggacccctccttcagctgttcagattccctcctcactggaagcaggagaaaaagtgagagggaagcaagtgtccacatgctcagcaacctgaatagatgaagacaaaaaaagaactctcccaagtttgtgacaggtcctgtgtcaagcaaaagaatgactacttgtctagagctttacacacaccaggccattattgcatccttgaatcaaccccattgggcagaatttcttacatactgttactatcaatgtttttacatctatagagcacttttagtttcctaagtgttttccagtgcattatcctggcaaattcctgtatcatggcaaattcttatgcagaagatagggtacaaattttccctcagcagggatggacgcacacacatgcacacacactcacacagcataccataacctatctgtcaccaaggcctgcttgaatacacccctgcttaacccctgtccccactgcaccaacatggctcagggactagtcagctctcccccacccagcctactgtggacttctaaccaggctccctgcagccagtctacgaagtgttttcccaaaagtgccaactaattatcagccttgaggatgcagttcaactccttaggtaggatggtgtaacaaggctcttcataatctggcccaaattcacctctcttcaattcccatatacgttagactccatcacataacaatgaaccctgagctccttaaagttgaattcaacaagtatttattaaagaaatggccaaaaagcgggaaaccttttttttttttttgagcagagtttctcatcacccaggctgaagtacaatggtgagatcccagctcactgcaacctccacaccccaggttcaagcaattctgtctcagcctcccaagtagctgggattacaggcacccgccaccatgcctggctaattttcatatttttagtagagactgggtttcaccatgttcgccaggctgttctcaaacttctgacctcaggcaatccgcccgcctcggcctcccaaagtgctggaattacaggcgtgagccaccgcgcccggccaaaaacggggaaatttttaagccaaaataagtagtctctttcaaagagttccagatttcaaaaagtctatgaaatcaagaattctgtaaccatgctgcagggtacagtttgagagctgggtggaagatgtggatgtgtaaaatttagcaacagatggaacctgagggaaatcctaaagaaaatataaattctgggattttaatcccaggaacaacatgcccagggagccaaaaacaccaaaaataaataaaataaaataaaataaaataaaaacaaataacaaaagaccagagaggtccaaacttatttcaagataaacagataaataaatggccactggtgttaacctactgaaggcaggaatggcatccaaacattaacaggtgaagtagaaagaggcacaactttcctcaatagcaacttttcaatactcatcaaaagcctttcaatactcatcaaaagccttcacaaggtccacacacttcaacccagcaagaggaaaattctgcttctgggaattttcctacagaatgcttcctaaatgtgcacaaagatttacctatttacttacttttactttctgtagagatgtggtctcactatgttgtccaggctggtcttgaactcctgccctcaagtgatcctcctgccttggactttcaaagtgctgggattacaggtgtgggccaccacatctggctaagatgacccccaagatggagggagaagtaaaacctctatataccaatagagaagggctaacagagaagccacatgatacagcattatgaaataaatacttggactgggcgtggtggcttgtgcctgttatcccagtgctttgggagggcaagaaggaaggatcgcttgaggccaggagtttgagaccagcccaggcaacacagcaagacccaacctctacaagaaatttaaaaattagccaggtgtggtgtcatatgtctatgctcctagctactcaggaggctgatgtgggaagatctcttgagcctagaagttaggcattactgtgaactgtgatcacgccattgcactccagacagagtgaaatcctgtctctaaaaaacaaaaataaataaataaatacttagaaggaaataaatttttaaaattcttacctctgggtggtgagattatgaatagcttatttcctttttttcatatttatatcttttccaatgcacattattaaaatatcttaggggctcaatagtggggagggaaacatgggacaggtacacatatatgaagccagtgaccatccacattcaatgggctcttccagaaggcagggtcttacttggcacataccaaaagccataaaagaatccaaacctttcatgcagttagctcactgctgagaattcactttagggaaataactgaacgaacccaaaatgccaaatgaacaaaaatactcattacctcttatctaaaacagtaaagaactagaaacaatcaaaatgtccaaaggaaagttccatatagaacatcaacaccatgggatgcaaggcagccattagaaatgccaattatgaaaactgtgtagaaaaatgaaataatgttgacaataggctgtaaaatgaaaagaatttgcaaagctgcatttgtcaggactgcagctatgaaaaatacacatgtatatcaacaagggcatttcaaaagtaaaaatgtgttatgctagaattatgagattacagagaccttttatttttgaagtttgttattttttaaaaaacaagttgttaacattttgtatgtaccatagacacattttcagaactttggaaacacagaaaagggaaaaataaaattgccaatacaaatgcaatcactgtcaacattttgatgtgtttctcctagtttctttttcccatgtactggctggtttggttttgttttgatcgttgttgtaatcgcatcaacatttctttaaagcagttacaaaatcatttcaattttgagaaaccagagaacttaatataaatcttgtactataacataatggtggctatcaagagaccccacataatgtcagtttgtaagtaaaaaagagaatattgtaccactatgacaaaataaatggaccaatcaaggttcctaacacctgtagatgactcttaggtctatttcagtagccataagccaagaacatggcgagtactgtgtattaaagctggaagactgaataatgtagttggaattagaaaggcatttaacagactgaaaacaagaagatacaatgatgtactaagttttcagatcagaagaaagttgaaggaaaccaattcaattggtcattaggtccagaatatttaactttctttacatttctcatacccttactctcctggcctcctgccctgcccttcaccaaggccagactctggtagctgggcagcagctgctgtgttctgcttgttttccctgccttcttcctgcctccccacttgcaggctgtccttcttccattctgctgccaaatgcaatgcagaccatcacaggcctaatgtgcacccatatcactatggacttctctagagagagaaacaagggcagggaaaaacactatctaagcaacgcacaggcttggatatgcactaaatgaggggaggctgagtctgttgtcaccactgaggggctcagtttctgcaggagtgtgatacttttgtgcttttcaaacaaaagagtccctcaacacaaactgatgattcatctattatatgcatgtcttccaaagactctgtcctctgttctaaggatagaggaaaaaagctgctgtgttggactgcctaagatgtggtacgccaccactagcatagcaaacctcactcagaggcaagaagaaatggaacttggcattttttgcctccaatgcttttagaaatgaacacttgtacaagatgcaatgcgactccactgcagcctctccaaagaactaatctaatcatgtcattcccacacttaaaactcttccagggctctggctgcccccacaaagttgtctgtaagaagtagtacagtgccctggttaagagggcaaactttggagccacactgcctgagtctgaatcctcagactgctctttctgaatgctctgaatgctctttatgagttgggtgaccctgggcaagttccttgtcctcttggtgcctacatttatttatttattattatttttaagaacaaattcaatacctatcctatgtgtatttatttacaaatagggataataacagtacttaccccataggaccgttgtgcagattaaaggaattaatacaataaagtacaaagaagagggcctggcaaagaggaagtgctcagtaaatgttaggtgctgctactgttattgttattgttgggcgaaagttcaaattctccagcagggcatgcagagccctccacagcccagcacctcgtatctttcaggctttgcttctcatgacctgttaccactatgactaccgctatgatcacgcagtcttgccaagttcccagagcatgggcccctagacaggttcatcccttcacacctttactcacagggctcatctctctttattgggtggtaaacaaccaattatctctcaaaccatacccccaccctccctgtgaattggtcactctctactttgtgcctcctctatgttctgcagagtttctccatagacacttttttttaaaatttattttcatttttatttttattattttgagacagagtctcactctgttccccaggctggagtgcaatggtgtgatttcgggtcactgcaacctccgcctcctgggttcaataaattctcctgcctcagcttccctagtagttggaattataggcatgcactaccatgcctggctaatttttgtatttttagtagagacaggggtttcaccacgttggccaggctggtctcaaactcctgacctcaagtgattcacctgcctcggcctcccaaagtgctgggattacaggcataagccactgcgcctggccagacactttattattcttgttggtttatgtatcctgtttcctccactaggccttaaggacagaggctcctgcaaattcctatctgtattctcatcgcctgacatttcagtagactaaatattaaataaatgcaaaagaaaaactgatcagtacacacaaaagctgagagtgcttttcagagaaactaaacactatgatgaggaaatcaaaccccaaagcaatttgatcttaaggagagttaattggcaaagatcatataaccaaagagaagaaaactataatttcccaagagaaagtcaaaccttgctacaatgcagtgtctctgtgtgcgttggaggacccaaagtgcaggtcaattaaatataaaatactgcaggagatccagactgcaagaaataaagaaagagaactaacctttattgcatgtctacaataagccagatacttagaaaataatagtttctataaaaacaatgtgctagacacagacctatccactttacctgcattatcaaattaaataatgcaagtcctcaacaactctgagacataagtgttggcctctccattttacaggtgagaaaaacattcactcatttcatacatttgtactgggcatctactatgtgcaagtcacatatccagaagcaggggataccatgatgaacaagaagacaagttccccctctcatacagcataaaaatagagcaatgaatgaatgaatgggaaaataagcatatacacaaataaacaagaaaagtatcagacagtgataagtgctagtagagaattaaaacaggaggaaaagactggatagctgtcacagaagttctctctgaagtgggtatatttaagatgagaattgaataagaaagagccagaccaggcttggtggttcacacctgtaatcccagcactctgggaggctaaggcagaaggaacacttgagaccaggagtttaagaccagactggacaacacagtgagacctcatctctacaaaaaatttaaaaattagctggatgtggtggtacacacctgtagtcccagctactcagagctgaggcagatgggtcccttgtgcccaggaggtcaaggctgcagtgagctttgatgatgccagtgcactccaatcaaggcaacagactaagacctctttccttttgaaaggaaagagagacagggggagacagaagaaaagaaagagagaggcagaggcagagagagacaaagaaagaaagaagtaagaaaaagaaagaaagaaagaaagaaagaaagaaagaaagaaagaaagaaagaaagaaagaaagagaaaggaaggaaggaaggatggaggcaaggagaaaaagaaataagaaagaaaaagaatgaaagagagagaaagaaagagaaagaaagaaagagaaggggagggagggaggcaggaaggaaggaaggaagagagaagggaaaggaaaggaaaggaagaaaagaaagaggaaggaaggaaggggcgagtcaagcacatgaagaatggaagaagtacatttcaggcatagagatcagcaagtacaggggccctatgtgacaatgagcttggcatgttcaaggaactgaaagaagggacactgaggctgagcacatggtcaacaagaagagaactgggagactgctgtgggacaggtcacatagagcttggaaagccagggcaaggagtttggatttcattctgagttcaatgtaaggccacgtagaggcttttaagaaatgtgacacaaaccaattaacatttttaaaatttttttctagtctctataatggagggtatgatggtgtggataccagtagaaacaaacaagactagttaggaggctactgcaaatagtctaggtgagagatcatatggcttggaccagggtgctggtagtggagatggagagaagggtataaattttggagtgtttttgaagatagagaagacagaacttgctaaaggattggaaagaggatgggaaagaaagaaagaaatgaaaagtaatacctagatatttgacttgagcacatggggggataatggcaccactttctgaagttgggaagattgggaaaactgagattggagtggagctgaatcaagagtcctcttttggccatgttaggaaatgtaaggactctcagacatctatgtggacatgaatctgaagttccagagagagagtctgaggctaaagatacaaacgtgagggtcactagcaaatggatgttatttaaagccattgaattatcagaggatatctatggagagtggataaatagagaagagggccatttcagaacctgggcatatcaccatttagagattgagggaagaaggtgactgaagaaagctcagagaggtaggaagagaatcaagaagtagagtgtcaaagaaaatggtgatcagtcttgtcaaatgctgctaagagaataactaagattaaaacaaagagatgggttgggcatggtagctcatgcctgtaatctcaacactttgggagaatgaggcaggcagatcccttgagaccagcagtttgagaccagcttgggcaacatgacgaaaccctatctctacaaaaaatacaaaaattagctggtcatggtggcacgtatctgtagtcccagctactgaggaggctgaggcaggaggatcgcttgagccagggaggttgaggatgcagtgagctctgatcatgccactgtactccagcctgggcaacagagtgagactctgtctcaaaacaaaataaaacaaacaaacaaaaaaacaacgaagtggccttagatttggcaacatgaaggccactggttgacagagacaaggacggtcctgatgaaatgagagaaagagattagaattgggggagtggaggagaaagtcagaccaaaactatggacaacttatgtaagtgcttctgagaaaagaaacagagaaactaggagatagctacaggggatataatgtcaacagatttttaagttaaaaaataaatttattttgcaatatttaagagacaaaattttaaaaggttatgggaatttgggaaggttggtttcttttcagataagaaatactacagcatatttatttgttactgaaaataatccagtgattagataaatttaatgatggcagagacatggggcctaattacaaattacaaagatctataagacttaatcttaaaaagttaaaaatgtgcccaaggctaacaaataacattggtaggcagtgaagccaggacactaatccaggtgttttgacttgcaagtgcattctctttctacacaattgaccgtaatatatacaacagcatttgcaaaaggtcccaactccaggctctgaaaataatcagaacagagtcggaaggaagcttcagagaacttgggagcaccaatgcaaacacacacccccttctcacttcaatgtaagcaacctctgttcctcacacagacttctattattgcattttcactcaaatgtcatttatgtgtgcacatctggctggggtcctactagctgcaggaccctcaatggttgccctttcatgttcagaaagagttggaggggaggatggggacatggaaaaatcacagtgcaatgtaagtggaaaaacttgaggggctaaactcttcagtgacttaataaggtatagaagctgggcacggtggctcacacctgtaatcctagcactctgggaggctgagttgggcagattacttcagcctaggagttcgagaacagcctgagtaacatggcaaaactaagttcccacaaaaaatacaaaaattagctgggcatgttggcgtgctcctgtagtcccagctactagagggtgaagtgggaatatcatttgagcctgggaagtagagggtgcagtgagccgtgatagttccagtgcactccagcctgggcaacaggagtgagaccctgtatcaaaataataataataatgtagcaaagagatttttatttcttttttaaatttcttttatttaaatagtttttggggaacaggtggttttttgttacatggctaagatctttagtgataatttctgagattttggtgcacccatcacccaggcagtgtacactgtacccaatgtgtagtcttttatccctcagccccctcccacctttccccccaagtccccaaagtccatgtcattcctatgcctttgcatcctcatagcttagctcccacttacaagtgagaacatacgatatttaattttccattcctgaattatttcacttagaataatgatctccaactccatccagcttgctgcaaatgccattatttcattgctttttatgactaagtagtatatcatggtgtatatataccatattttctttatctgctcattggttgatgggcatttaagctggttccatgtttttacaagtgtgaattgtgctgctataaacatgtgtgtgcaagtgtctttttcatataatgacttactttcctctgggtagatacccagtagtggcattgctggatcaaatggtagttctacttttagtttttaaggaatctctgtacagttttccatagtggttgtactagtttacattcttaccagcagtgtaaaagtgtttcattttccactgggcatggtggctcacgcctgtaatcccagaactttgggaggccaaggcaggtggatcacaaggtcaggagattgagaccatcctggccaacatagtgaaaccctgtctgtactaaaaatacaaaaattagctgggcatggtggcatgcgcctgtagtcccagctactcgggaggctgaggcaggagaatcacttgaacctgggaggcggaggttgtagtgagccaagattgtgccactgcactctaggctggctgcagagcaagactccatctcaaaaaaaaaaaaaaaaaaaaaaatgtttcctttcaccacatctgcaccaacatttactattttttgattttttaattatggccattctcggaggagtaaggtggtatctcattgtggttttaatttgcatttccctgataattactgatgttgagcactttttcatgtttattgaccatttgtatatcttcttctgagaattgtctatttatgtcctttgaccactttttgataagattaatttgttctttttcttgctgatttgtttgagttccttgtagattctggatattagtcctttgtcagatgcatagtttgtgagtattttctcccactctgtgggttgtttgtttactctgctgataatttcttttgctgtgcagaagctttttagtttaattaggtcccatctatttattttgtttttgttacatttgcttttgggttcttggctatgaactctttgcctaagccaacatctagaagagttttactgatgatattgtctagaattttaatgatttcaggtcttagacttaagtctttgatccatcttgagttgatttttgtataagatccagtttcattcttctacatgtcgctggccaattatcccagcaccatttgtcaaggtgtccttaccccactttatattttgtttgctttgttgaagatcagttggctgtaagtatttggctttatttgagtgtaaaaagtttttttgtgctttttgttttgttttgttttgagacagagtctcactccgtcacccaggctggaatgcagtggcatgatctcggctcactgcaacatccacctcccaggttcaagtgattctcatgcctcagcctcctgagtagctggaattacaggcatgtgccaccatgcccagtaatttttgtatttttagtagagatgggggttttgcccattggccaggctggtctcgaactcctgacctcaagtgatccgtctacctcagcctcccaaagtgctgggattacaggcatgagccaccacaccaggccaaaaggttttttttaaaaaataacaactatgtatttatgttcagcaaaagtgaagatggaaattaaggtacaggtcattttgtttctttcccttttgcctggctatctcaggaagcaagtggctaggaagtggcctcttgtcacctgttttctatgcctaccctgttttaccatgtggcaacacaaacccccactcccctgccccgtctttctctcacctagcttcccattaactgttccagtttgcttcttccttcagggcagcagacatgccatctcccccacgaagtcctccctcatctctccatctctgaacctttagaacactaagttactagtacacacaaatttagctcttgatcatatttggtcttataatcattctctgattcaaatatcagagtgggagcaagagtactttttttcagtacgaaattcaatacaattgttggctattgttaccacgagaggtagcttaatggaatgattcagatagatttgggttaaaattatggctctgttccatctcttacaggccgaatgactttgggcaagtcattccctgagactcagttcccctaactagaaaatgtgaataatactgcctactgatgacagtggtgagctgtctggagcagccactgccatcatgctggctacagctggaaggcgtggccaggactgcatgttccatggagctggcgagagccagggacaagcaggagctccaccccttctgaactggggagggagctacccaggtgccactgcagctacacaaaccatggctgcagacccaggcctcccactccacggagcaggtagaagccccaccctctcgggcacagctacagccactcaaaccacggctgcagacccaggtatccctgtactcttgggggtccaggaaggcccccgcttgcctgtgcaggctcagaggtgcctgctcccactgcctggcctctcccccactccttatgcctgctctaatctcagagcagggttggggccaagctcgggcactgtcacagcctggctgggtgtgctcatgctaggactctgttgcctcagccccctccggactttaggcaccaacaaacatgggaaaaagccaaggtgggggctgagggcggctctgcgctggcctgcacttgcccattggcacgagcagcctgttatgcctgttgccacaactgaggcaggaggcagacaagctcctggacagaagggggcgagtccctgttgagaccccaccttcaggccaggggagcctgaagcctgggagctgggctgtgagtcccacaaaccagggtggcgatttgtggtgcctttttcagcctgcccatggccacccatggaccaattgcatgcacttcttcccctctaagacccataaaagccctgggctcagtcagaccacggaacagagggaggatgggacaaccagttgtagagaggagctaccttctctgctgagagctgcagacaatgggacaacctgcttgtagagtggagccactcactttatggcctcctctctgctgagagctgcagacaatgggatgacctgcccgcagagaggagccacttcctctctgccaagagctgcagatgacaggatgaccagctgcagagaggagttaccttctctgctgatagcaggagctaccctctctgctgagaactgaacacttgttgggacaacctgcctgcggagaggagctatcctctccgctaggagttaaacactcatcaggacatcctggccatggagaggagctgctcactgcgggtcttctctgagctgttgtattgctcaataaagctcctctctgtcttgcttacccttccgcctgtctgtgtacctcattcttcctggtcataggacaagaacttgagactcactgaatggtgaggctaaaagagttgctgtaacacaaacaggattgaaacatgtcccttgctcaccaggttatgagtgaagaggagagacgagctgtggccctccaggaagcccagacctgggagctccctgatccagggctgtgactccctcttctgggccctgtggttcctggtgcctccaagcttccaggcaccacctcattccccagtgccagctgggaaagctgcttgcggcgcacctggtccagctgcagcctcacagagagctagcgcccatgcaagcaccttgagctgcccgcccggcagcagcagctgggatgtctggctgtgcagaggccagactccatgctcactcacacacctctctctgctccacgcctgactccagtctcccttggaggcatgggatccagcccggtagcatgagctgagcacagcctgccaggccgagtgggcggaacaagcccagaaggcctgagcaaaactagggcaaaggcgccaccggccacaggtttccagccagaaaagcaacgccccaaagatcccatgtcactacctcaagggctgttgtgagatttaaatgagatatttttgtaaagcatctgtcacagtacctggcctataggaagtgctctataaatattaattcccttcctcctaatgactttgtgaatgtcagttttatctctccaacaagatgttcttgaagacagatcatatattttatgtatttcattagatcatccacattcctagaacatagctcaatgcatcataggcacttaattaagtacttcttggtttgatcacaagtgaaaatcacggctgtacgtatgcctgacaatagaccagtgtttcctaaatgctggtaccagttgaactgcattaaactcatccaaagagcttcttcttattaggggtgggggtgaaggggtgggagagatagggaacagggccttgctctgttgctcaggctggaatccagtagcacgatcacatggccagtgaagcctggacctgccaggctcaggtgattgtcccacctcagcctcccttgtagctgggactacaagcacatgccaccacactcagctaatttttaaatttttctggagacatggtctcactatattgcccaggctggtcttgaactcctggcctcaagtgatcctcctgcctcagcttcccaaagtgttggtattacaggtgtgagccaccgcacttggtccaaagagcttcttaaaaataaaactgctagatcccttccctagatattctgattaagaaagtctgttccattaacttccaataatggagaaaggtcttccaatttttactttagtatttttattagatatttttgcattgcttgaatttttaaataagtatcctttattttataattttaaaataaagacaacttttaaataaaaaaaagaataactgaccagaatcagaagtgaaatctagaatactacaaaatgtttctttcattagtaatgggcaatttaaaaaataataataatgaagtaaaaataccccctggtcacaactggggaaatatgaacatggcctgatatcagatgatcattttgttttttgttttagatacaattttatgttgtatcaaatgtctttattcttagaatacacatgctgaaatgagagtttcaggtgaagtgttataacatttgcaactttcaaatggtccagcatatatgtatatatgcatatgtatgtatgtgtatatatatatatgtatatatacacatacacacaaacatgagaaataagacaaaatgttaacaattgtttaatttagttggtgggtatttgggtgttcaatttgttactctttcaaattctcagtatgattaaaatttttctaatagttgggggaaaatattctcagttgattctggtgataatctagcttgggaaccactgctttacccaatagatttgttcctgaagttagaaaaataagaattctgagatacacaacatataaatgctctgaaagcaatagtatttaaagaaatctcatgtcacaatctccccataaaacactgtctcctaattaattgttcataaacctacatttcacataggatttgcttaaggtcagcgctcagataagggcagacttgaaatgttggttaagggaagaagaggcatgcacaagcacaaagcctgagggttgtacttgactcttgtctgctcctgtcttgctgatttacctgctgaatatttatcaaaccagtctcctcctctcttctactcgtgctactgccgtgggtcagacttcatcctatctcccctgcaccagtgctgagagccccagctgatggccctgcctcaggtcctacccagctcagattcacttccaccttggctaatacatatccaaaacacgtgctggctcattgctcttctactgaaaaccctacaatggcttcccatttcaaaatcaagtccagaactcttcaatctgtttataatatcctctcaattttgccagcctcaattctcaccaaactcacattttatagcccagtaacagtgaattccccgtgatacgtctcacctccatgcttcagcccatgcattcttattccaccttgctcaggcatcactctccttctgaaagctttcttggattcaccacctgccatgccttccctcccatctcccatacagaggtcagagtctcctatttggttctcccacaatacctcgacagagtttaatccgtgcagttaccccactgctcacaattatttacttataagactatctactccatatcccggggcctcttggggaaggactggattttattcatctttgcagccccagtacttacttctgctttgcctttctgatgccccattttctcatctagagaatcagaagaatatcaccaacttgaaaggttagcgttaagtttaagtattcaaagcttaccacaggcatacaataggccttcagcacatttgatttataaggtcagcatctcttgtttttcgctttccaattctgcccttcaggaccaacttcttacactggccctgtgtccagcaaggacacagcgagcaagctccccacccatctacatgccaaaatagtgagggtctcaaactccagatctgcctcaggcttccccaccctgccagtgccctctggactctaggatgactcaactaaggaaccaatgcagtactgcaaacatttcttgagcagttttatggaaggcaatgtccctgatgcagtggaaagtgatataacatgtacaaaaaatgtatgacctcttatagggtaggggaagggtgaggagacaattagacaagtgaaggcagtacaattcaaagaaggaaaacattgtatatctctgggggtagacagaaaagccttagaggaagtggcatttgaacaagaccacaaaggatggatttaagctaagaggctgtttccagaattgtgtgtgttccacaaaacacaacactgaaatgctactgttactcagatgaaaagtaaatttagaaaatgctgcctacgatgtacccctctaggagatctgcaatgcacagtaacaagcgtgaagtaaagaaccctacttaactgtgttgaactcagcatcccaagtttgtttgactactagttaattccctatttctttcctcctggaggagagagttatagcatctttcaagatctgaggtgtcttgaagtaggaaaccctatttaactccgtttaaccgagcatcccaagtttgtttgaacgctagtaagttccctatttcttttcccctggaggaagatgtatagcaacttggagaacacactttaagaaacaacaggttaaatgttaccctttcaaagctatccatttgcattttaccaggacttcacattgataataccttcatatctgattttttaacaacaaaatcagcaattttttaaaattctcctgacattttatcagaagagaaaaagcaatggaagatgctgcagaactaagaagtttctcattgtgaagcacagtgtagaccataagccttttaatcaaacgaaggaaacaacacatctctgactgagtccattcattctttgttaggatgtttacactgttatagctgccctcactccctctgcaacctgctgactgtgtaaaaaacaccagacttgaaagcaaagggaacaacattgcataacaacaagccctcagggcatgttttgctcctttatatttaccaaacagttgtgcttgtaaaagacaagaaggaaaggggcactgcagctcatccccactcctgaaattacaatgctgaattatccagtctgagagttaacatgtttactgggagtgaggcactgtgctcatgatacaaagaaaaataacgtatagctgttacttcacaagccaggacagataggtaaataaactgtaatgcagcaaagtgcaagcaaacacttctataataagaggggagtacacagaagctgggactccttacctttgcctgggcttaaggtcaaaagagaagcatgttaaaataaggaaaaactcctctttgttcttaaaaaattgaaaaggagttttccaggcaaataaaatatatacataggtatagataaacagatatagatagatgatatagatatagatacaaggccaggcatggtgactcacatctataatcccagcactttgggaagccaaggtgggaggattgcttgagcccaggagtttgagaccagcctaggaaacatagtgagacccccatctcttcaagaaaattaaaaaattagccagatgtggtggtgtgtacctatagccctagctacaagggagactgagatgggaggatcacttgagcctgggaggttgaggccacagtgacctctgatcatgccactgcactcccacctaggctacacagcaagaccctgtctcaaaaaaaagacatagatatagatacacatacacacatacataaaaaaaaataaggccatagggctgagtagaataggatacgtgatatgatttggatatctgtccccttcaaatctcatgttgaaatgtaattctcagtgttggaggtgtggcctagtgtgaggtgtttggatcatgggatagatccatcatgaatggttagcaccatccccttggtgatgagtgaattctggctccggtagttcatgtgagatctggttaagagtacggcacctctgtcctcactctctcttgtttccactctcacatgtaacattctggctcccggtcaccttctgtcatgactgtaagctttctgaggtctcaccagaagcagaggccagcaccatgcttcctgtaaagcctgtaaaactgtgagccagttagatttcctttctttataattttcccagcttcaagtatttctttgtagtaatgcaaaaatggactaacaataggatagggcaagattgaaaagaaaaaaaagagcagccaatctggagaaggtgtcacactgaactactgcatctaatttcacttattccaaaaaccccacaaaaattcagtaaagtgctttatttttattaaaaaaaaccttataagtacagagaagataagacaatggtgtcaaattttggaagcttgggaagcagatgaacaagtagtaattgacttagcatactcagaaaatgtggaattcagctgatttaaaccacagaatccttaaaaaacacaggaactgacagtaccttgtactcctagagcaggcgtataggatgctagaataaagaacacaagagagaaggctactcaaggagttagatacctagattccccctcctcattaacaaaactccaaaggcctgtctctggggagcacaaaacagaaatatccagcatttgcttgaaataatctgaggaaggggattgcgggatacaaagcaaactaaaatatccatcaagtgaaaactagtgaacctgaatgatgggtacatgggaattcactgtattgccctccctacttttgtaaatctttagcattccccataaaaaaaaagtaagagtgtctttggcctggcagtatccagcgtggatgagggggaaacatatcacagataaggcactatgtctacagaaggtagagtgcaaaggttcccatgtttcttctcccgagtaccaaaacatagtcagatagaaccccaccatccgaagaagagtgaaagactctttgctggtgaatgtacccaagggaaaacctgaagatggtaacatcaggggagcccaacaaacagcccatccagatcaccgtaccgtgaggctcagagctaattatctccattctgtattcagagtttcctgacagtactttttaaaaaaagctttatgtcacataccatataattcacccttttaaaatatgcaattttctctaggaactaaatgaaaaaaaataaaatgtacatttcaatggtttttagcatatttacagagttgtacaaccatcaccacaatcaattttagaacattttccattcccccaatgaaaatcctacacacattagtagtcactctgcattccccccactccccagccgcaagtaactactaatctatttttttgtctgtatagatttgtccattctggccatttcatataaatgaaatcctacactctgtggtcttttgtgagtgacttctttcacttagcataatgtcaaggtcttgacagcttttttcctccccctcttaatcaggagcaacacagccaaggatcacattttagagtgacatcttgggaaagcctctaataaagatacagaccatggcaaacacaaaaaaaagtgacttgaaggaaacagataatatgcaagggcggaaataccattaatattctcacaaaaatgaaataaaactacatccatgaaacaaaaataggatgctatataaaggaaacatagagaacaaaaagagctcttagacattgacaacataatagcagactttttttaaatcttcaataaaaggattgaatgataaaatcgaaatcttctaaagaataaaatcaaaagacaaagatatggaaacagcagagagaagttaagaatattctaaaggtccagtacaggaggggtcctatatccaaataagagaaattcccaggaaagagcagaaaaaagaaaaatcataacaatatattcaataaaatttcagagaactgaaggatgcaggttgccaggttgaaagggcccagcacacgaagcacactgtgaaacttcagaaaactgcagacaaagagaagattttacaaactgtcagagaggagggaaagacaaataggttatatataaagaatcagaaatcagaacccttccaacttctctacagcaacaataaaaagacaataaagcaatgcctttaaaatctgaaggaaaatgattttcaacttagagtgcaatacccaaataaactaccaataaagcacgagaatagaagaaagatactttaaagtatacaagacccagaaattcatattccatgcaccgttttataagaagctcctactttgggaggctaagacagcaagattgcttaagcgcagcagtttgggagcagcctgaccaacatggcgagaccctatctccacaaaaagtgaaaaagttagccaggcatggtggcatgcacctgtggtcccaggtacttgagaggatcacttgagcccaagagttcgaggctacaatgagctgtttcacttcactgcactccagcctgggcaactgagtgagaccctttctcaaaaacaaacaaaaaaaagctcctggaggatgtccttcactaagtggtataaaagaaacatcaagagatctagtccaaagacaagcaacagaggacgccaacatgactaccacaggaagtagccaaccagaataaagaagtataactcaagagacagacacattgaagacagccatcaccaacaaccccactgccattaaaccctcttttgtgttgtgttcaaatattttaaatatatgattataaagttttcaaatatacataaaagcagaccccccaacacccattaccaaagttcaacacttaccaagattttgacacgttaacttaatctatccctttccccccctatttttttctttgcttaaatattttattattattattattattattttgagacagggtctcgctctgttgcccaggctggagtgcagtggtgtcatcatggctcactgcagcctcaacctctgggatgcagcaaaccacctgcctcagtctcccaaagtgctgggattacaggtatgaaccttagcatccaggctgtttaaatatttttaaacaaattctacatcatatcattttattcctatgtacctcagaactcatctctatattattcatcttcttacattatactattattatcacacctgaataaaagtaacagtaattccttgatatcatctcaaaaatttctttttacacacatctacatgcatacttgtagcagcacaattcacaattgcaaagatatggaaccgacctaagtgcccatcaaccaatgagtggataaagaaaatgtggtatatatccaccatagaatactactcagccataaaaaggaatagaataatgtcttttgcagcaacttggattgagctggaagccattattctaagtgaagtaactcaggaatggaaaaccagataccttgttttcttacttaagtgggaactaagctgtgaggacacaaaaacaatacagagcaatataatgaaatttgtgacctggggaaggagtgggcaaggggagtgagggataaaagactacatactgagtagggtgtacactgtttggttgacaggtgcactaaaatctcagaattcaccactgtagaatttatccatgtaaccaaaaaccacttataacccaaaagccatttaaaaaaatttttttaatgtcttttcaatgccaggtgtggtggctcatgcttataatcccagcattttgggaggccaaagcaggaggatcgcttgagaccaggagttcaagagcagcctgggtaacatggtgagaccgcatctcttcaaaaaaaaaaaaaaattagttgggtgtggtggtatatgcctgtagtcccagcttcttgggagcctgaggtgggaggactgcttgatctcaggaggtcaaggctatgttgagccgtgttcatgccactgtactccagcctgagaaacaaagcaagaccctgtctcaaaaaaaagtctttttttggctgcgtgtggtagctcacccctataatcccagcactttaggaggccgaagtgggcagaacacctgaggctaggagttcgaaactagcctggccaacatggtgaaaccccatctccactaaaaaacaaaagttagctaggcatggtggcacgcacctgtaatcccagctactcaggaggctgaggcaggagaattgcttgaacccgggaggcagaggttgcagtgagctgagatcgtgccattgcacttcagcctgggcaacacagcaagactccacctcaaaaaaaaaaaaaaagtctctttgcaattaaactaaattatgtccccccacaagttcatacatatgttgaagccctaattcccagtaccttagaatgtgactgttcatgtatttggagatagagccattaaagaggtaattaagttaaaatgagattgttagggtgggccctaatccaatctaactggtgtccttatagaaagaggagaataggacacgtagcaggacactgggagtgtgcatatatagagaaatgaccatgcaaggaggtggaaagagggcagccatctgcaagccaaggagagaggcctcagaggaaaccaatcctgccagcaccttgatcttggactcctagcctccagaactgtgaaaatactaatttctgttgcttaagccacccagtgtgtggtattttgttatggcaggcctagcaaactaacacatagactatccgaataaaaacaaggttcacacatgacatctggttataattcttaagtcactttattatttttttcatgtcattgacttgttgcggaagccaagtcagttgtctgacagaatgttctacattctaaatttctctgtttgtttccttagagtgtaattccacttgtcatcctttcccccatctttccaatatattaaagttagctctagagacttgatgagattttaggagtcaacatttgggtaagaatattccgtaagtggttctgcgtattctttttttttcttttttttttttgagatggagttttgctcttcttggccaggctggagtgcaatggtgcaatctcggcacaccgcaacctccgtttcccgggttcaagcgattctcctgcctcagcctccagagtagctgggattataggcatgtgccatcatacctggctaattttgtatttttaggagagatggggtttctccatgttggtcagactggtctcgaactcccaacttcaggtgatccgcctgccttggcctcccaaagtgctgggattacaagtgtgagccaccaggcctggcctgcatattctctttttaacctgacaaaaaatgcataggtaaacttagtcgaggttcttttctgcctctatttgtcttgaccatgtgctgatgaagcacctgctcatctccacactatttgtttgggttagttggtgacgttcacttcatcctacagaagagttttgctttgacctaccccttgagagctgaaaggacgccaaagaaagactggaagtagaaaagacagagccgtccactctttgtgaccatattccatatgtccagtgtgtgcccacactacaaccctatcagatgtctcaatagtagtgatccttatttcctaggactcactcacatccttgcccactgacttccccattagagccttttaaaccccctgggaatctaaagctatattatgacccagagtttagatctaacagtaacaaagcttgctaggtttgtgcttgcttcttggttttttaaaaaacaacatttgttttagtaatacaaacacaggtggttaaactgtacagaaaagtaagagaacgatgaacacaaaagtcaggataatcattatgtctggtgaggaggaaagggggtatgatttcagggcagagagtagacaaacagcttctaggatacaaataatgttccatctgataaattggatggcaaattcacaattttctttcttttattttttgagacagcatctcactattttgcccaggctggtcttgaactcctggcctcaagaaatcctccaacctcagccacctgagtagctggaattgcaaacatgtgctactgcatctggtcacaatttttatgttcttctttaaactgtaaatatgtatttaaaacattctttcatatgcattgtatgtttcgcattaattatttttatgtaagcagtccaccatagctagaacacagggtttgaagagtagagtaaaaggagaaaagaatggaaaaagagtgtactctaaaggtaaataggaaccttaatcatgctctcttgggagtaacatcagggaacatttatacccaatattaattaaaatgactttctcataatctatctatcaagaatgataggaaaaatccattttttctaagttacctagatatgaaatacccgacatcttaagcatctcactggggaacataataatatggttttgatgtatttttccagggagaggagtttcagcttgccctagggaacatgtttgcctcaaattctttttttttttttttttttttttttttgagacagagtcttgctctgtcactcaggctggaatgcaacggcatgacctcagctcactacaacctctgctttccgggttcaagtgattctcctgcctcagcctccggagtagctaggattacaggcacatgctaccacacccagctaatttttgtatttttagtagagacgggggtttcaccatgttggtcaggctggtctcgaactcctgacctcaggtgatctgctcaccttggcttcccaaagtgctgggattacaggtgtcagccactgagcccggcctgcctcaagttcttaaatgacacaaagctgggagggatgtggaacaaatgttttatattacagaattaaaatatatcttggcaagctagagtgacaggtcaaatttaggccaatttctaataacatctcccatttgttgagaacactcgatatgccaagagctttacataatttatctcacttaatccctacaaccacactgtgaagctgaaatccaggaaagtaacttgcccaaggtcataaggcaagttaataacagagttatgatttgaacctaggtttgcaggctcaagtttcagtctcaagtgagattccttcagccaccagaaattaacattcaaaactgaatcctctgctaccacactgggaattaagaaaacaataataaataaataaaaatctcaatcctctttaattcagcatgtcaccctcagaaaactgcatcacccaacctcaagccccttgggcatatgagggtatcaagtacctccaaagaatgatcagatcaaatgaaaaaaaaaccaaacaaacaaaaacaaaaaagaataatcagatcaggccattttcattaatgtaacacttggggacctcgacagctgccaggaaacctccatctgtcctcaagagcaagtccatcctcaaaagcaagctgtaacaggattctctctgcaacccattcccagctcagccatgtctgcctccccatctgtatttaagactgcaaaactcaagctctgcagttataaacggaggccacttaccacaaagattgctgagcaagagccctcagccaggctattgcctaccttcaattttctctcgtcctcaggggcactgtgatttgatgggtgtgtacagctgagagaacagcacaaccggctccagtgcacagtcatatccaatggagctatcccaaaagacagccagagaattttaatgaaaaccagaaaacccctggctgctaagtccaactgcggttcaggcctgccagcccctccccctgcagctaagaatctctgagccagctttgccccaaagagcagggaagaaaatccattttgcactcagtaaatccttccatagcagccacttcgcagagtcatttaggttaaaggtgaggcatatgataactgcaacaggacccagggaccctgagaggcacagggtgtggcagcagcagatttgagccaacagattatgaaacagtcatttaaaaaaaaacaaaaagtctttccttctgccaaagctctctgcccacagctgcatacaaggctagtgaggaatcttaacaagcttaaaggggccgtatttcagatactccagaaccaaggtgggaggaaataagtattttgagcacttactatgtatcaggtgctctgatctcatttcatcctcactgtgagatgggaactgtaaactgcaggtaacagataagaacattgactcagagaggttccataacttgtccaaggaacacagttagcaagaggggaagcaagactgaaagttcagtgtgggtgaggctcatcagaagtatcaaactttttgttcacagagagcagaaaaaaataaaaagaaaagaaaggaaaagaaatactaaactcaaaatcctgactaataaaaagaatgatcatttattgaccactggctatgtgccaggcactaagctaatatttttacatgcaccgtatcatctaatcctcacagcaactagataagatacaggtcattattacctccatttaataatgagcaaactatggctcagacattcaataatttgatcaaggtcactgcatcaccaggattggaacccaggtctacctaattctagagtgctcaccttaaaacactcatcctaacagcattcagaagggagccacctagatcatcatgccaagcacgcaagttgcagcaagatttctgctcccctccccagcaggtaatgcatattccagacttgcctttcaattcctcccagcaatcttcagtggaggcacagtatcactggctctggggaaggtgatagctatgtctctaccttcccatgcaccatggactcagttgtcccgacatgagtgaaggagaaggccaccaccatgatccagagactcacatgagtatagaagcagacagcttctttccccaggccctgctccataggcccatgcaacctcaagcagcaacctcttcctcaacagctcacaggcctgttttgtattcttaacaggagaccacgtgcctcctttttaagcaactgtgatttcccaagggagatgactgtctagacacagcatctatcttgacaaccagactgggccacacgatgttaggtttgataatttaattttagggtctgtgttcagctctccagtgaaggctctgtgcttggcacccctgggtaatcagatcgagtatcactcagtgcaacagctgacaccctgggttagaactgtctttccagccaggcaagtgttacttgcgggaagtcacaggcatcttatggatcacacacacacaggcacaacacacaaacagttccattaatgaggctgaaacttgatagaactcttctatgcatgttcagaattaagtgccaggctttgactggtggtggactgaatacttaatatgtatcaggtactgtggtgggtacattcacagccaatatcttaactgacccgcacaacattctgtaaggtagatagaactgctattatacagatgaggcaactaaagcccagaaagatagcataatttgcccaaagtcacacaggaagtggcaaagctcaggttcaaattcttttttttttttttttgagatggagtctcactccacctcccaggctggagtgcagtggcacgatcttggctcactgcaacctccacctcccaggttcacacaattctcctgcttcagcctccacagtagttgggaatacaggcaggcaccaccatgcccagctaatttttgtatttttaatggagacaaggttttattatgttggccagagctggtctcgaactcctgacctcaagtgatcttcctgcctcggcctcccaaagtgctgggattacaggcatgagccaccaggcctggcctcaaattcatttttaatacaacttcaacaccctttcagtcaattatgagtccattcatttattcctcagatagttattgagcactttctatgagccagctactgtgacacctacagaggatacaactgttaacataaggtaggtccagttaccaaagaactactgttctcatgaggatagatgacaatgcagatagataattacagaatgatgagatgaggcctcagaggactgatgggatcaggcctctctgagaaagtgagatgtgagctgagacctgaaagatgagaataagccaggcatttgcaaagctaggaaaagagcgcaggcaatagatacaagaagtgcaagggttagctaccagaaaaggcttggcgtgtccaaggaacataaaggagaacagggaccaaggctgggtgagcaacagggaaaaaagaacggttgagatgacacagggcctcgttgaccatggaaaacactttgaattttgtccaaagggcaatgggagatcaaagaagagttttaatcagggaaatagtgtaatctgacttgcgctttaaagagataattctggttgctgtgtggagaagtgagtgtagggagtgggcaagacttaagaataggggagagataatggtggcctggaccaagataatggtaggggagaggattttatatttgggaataacaaagaaaatacttgaggtgatactaagtgtttttttaaaaaataaataaataaaaactttgaaatttaattacaattttaaaaaataaaaagacaaacgaattttttttttgagacaaagtcttattctgtcacccaggctggactacagtggtgtgatctcggctcactgcaacctctgcctccagggttcaagcaattctcctgcctcagcctccctagtagctgggattacaggcgcccaccaccatgcctggctaatttttgtatttttagtagagacagggtttcgccatgttggccggactggtcttgaactcctgacctcacgtgatccactcacctcggcctcccaaagtgctgggattacaggtgtgagccactggacccagccgaatgaattttttaaaaaataatgaaaatacttgctgatgaatggtatgtgaatggtgaagggaacaaactcctgggtttctagcttgaacaactgggtagagagtggtaccacgtattaagagagactggaggagaagcaaaatgctcgtgagatagccaactatatcacactaagaagaaaaaaaaagtggaccccagttgtgtttgttcaaggggaagctaggaattaaaggcctgaagctgctactctggtgaagataaagtgtttgggggttatgatagagagtaaagtgcaagaatctgaaaggatgccttaggaaacaggggttccacttacttcatgtggccatcactgccaaactgggaccaacgtgcggaagacagacaggaaaggaattcagtctgacataaggaaggctgtctcgtggtcagagtgaaataagctgccttgggagtgggagagggtgaatgatgacttctctgtcattggaagggttaaagaaaaaaacagatgactccttgactggagggttagagagagaattcagtaattgaatagggaaaatgctacataaaatccttctaaactctggaattctgtggttttaagataaaatcttaattaatctaaccttcaggactggagtttctccaacagggcagaactcccttggtatgtcctacctctcagaaggcaaatgagatcaacgttagctaattttagtcactataaagtgactcctagttcatttctaagtgtcaaacaagatgctgaaaggctttttggtgtaggtgaaaggcatatgctatggaactggatatcccatatctgcaattgattagcgctgtgtcctctggcaaattatttaaatcctctgaatctcagtttatttctttgaaatagggggaaagcaatgcctacctcaagatgtttactgtgaggaccaaagccttatgcctgatacattctattaagaaaaataatgaggctgggtgcagtggcgcacacctgtaatcccagcactttgggaggccaaggcaggcagatcacctgaggtcgggagatcaagaccagcctggccaacacggtgaaaccctgtctctactaaaaatacaaaaattagccaggcatggtggtgggcgcctataatcccagctacttgagaggctaaggcaggagaatcacttgaacctgggaggcagagtttgcagtgagccaagatcgcaccactgcattccagcctgggagacaagagagaaactccatctcaaaaaaaataaaaaaaaaaaagaagaagaagaaaaatagctaacatctattactacagatccataactatatgctaggcatgtgctatgtgcatttaaaaaaatccaatccttacaacaacccagaaagtagccactattgttattccattgtaaaaatcagaaaattgatttctaaaggtaaagtaacttatccaagagtcatataattagtaattgcacaaattaggaaaaaacaaacttcgacaaagttgaaagaaaaagacaaagaaaaccatatttagataatttgaaagaaagttacctactgttgaattaacaaacaattcattttaccaactagtcatttagtaaatatttattgaatatataaataaataactgaatgaatgaatgattccaatgaatatttcttgagttcctgctaggcacatcatcaagaagctagggttacagaaaatgtccatcaatttaattgagagtttgccattaacaccacaatcttcaaactccaaataaactgccaacataacaacacttagtccatgataaaaagtcctaagaaatgccattctcagctaagcgcagtggctcctgactatagtcccagcacattgggatgccaaggcaggcagataacttgagctcaggagtttgagaccagcctgggcaacatggcaaaactccatctcttcaaaaaatacaaaaattagtcggctgtggtggcgtgtgtctgtgttcccagctacttgggaggctgaggtgggaggatcacttgagcctggaatgttgaggcttcagctagccgagatcacgccactgtactccagcctggggaagtcaaaattcttggggaagtcaaaactcttagaggagagctctgagcagtaggcagataaccaagagcacacaacaatggaagctgagaaaggaggcggtctcaaagaaaagatgagtaagacttccacaggaagcagaaatcaaaaagaaaaaaggctgaaaaaatggccgacttaataagtaggagtttgtcaatggacttctctggaactgtggggaaagaaaccaagtttcaaagggcaactggatgaatgggttaaagaggaagaggaggcagtcttttaaaaagtttggcagtaaaaggagggaaagggtaagaaaagtaagtagtctgatgaggagaagcagcaagactgttaataagagtataaggtgaggagcaggagccaaaagaaaaggaaaagttgaagacagaagatacatggagaagatgtaagaaagaaacaggaggaccagactccagcacgtcaagagggaataggatacaacacacaagtgaaaggctacccttgggaaataagtcaccttctgctctaagacagaaatgaaagaaaagagattttgacaaatggacatggtgaaaagttactctgaatcaaccttgaatacagtacagagagtgatcacattgaataacactattttgggctgggtgcagtggctcgggcctgtaatcccagcactttgggaggccgagttgggtggatcacctgatgaggtcaggagttcgagactagcctgaccaacatggagaaagcccatctctactaaaaatacaaaattagctgggtgtggcggtggacacctgtaattccagctactcaggaggctgaggcaggagaattgcttgaacctgggaggcggaggttgcagtgagccgagagtgtgccattggcactccagcctgggcaacaagagcgaaactctgtctcaaaaaaaaaaaaaaaaaattgaataacactattttgaacttaaaataatattgattttcttggatcactcctaacttggcattgaaaaggacaaccaccatttggatgtaagttctatacagttaaaaatcagaatcttctttttctggacaggaagtaggatttattggtgggcattaggagggagcagcacagtggaagccttcgtgaatgcagggcctgccacttgcccagactggagatgtatttgaccccacagccatctgggatgagccacttctcataccagagccaccacgtcttcaaattcatctgcactggctgggcacggtggctcacacctgtaatcccagtactttgggaggccaaagtgggcaaatgacttgacgccaggagtttgagacgaccctggccagcatggtgaaaccgcatctctaccaaaaaaatacaaaaattagctgggcgtggttgcatgtgcctgtagtcccagctactcaggaggctgaggcaggagtattgcttgaacccaggaggtggaggttgcagtgagctgagatcacaccactgtactccagcctgggagacagagtgaaactctgtctcaaaaaaaaaaaaatcatctgcatcgaactttgaaacgccccacttctttcagatgtggatcttctggtgaccagggaacttgaacttggccctgtggagggcctcaatcacatgctcctggttctatagcttgatgtggatagacaagacaacttggccagtatgaaccctgatcaaggctccttgaggctttccaaaggcacctccactgtctggagcctacactggggacagtacaaggtcagagacataaacatatattagaaagggctgtctccaaggtcctttagagcaacccatacaagaaacaggctgcatacactaccaaggaagctgctgtttgcagctattgaacaccaggccccaaagaggaaaggaactaggtcggcttaattggttgcagaaaaatcagtcttactgagatgttggttacgttctgtttcttaatctggatactggttaccctgatgtgttcagtttgtgaactttattaagctaaaaaaaaaaaaagtttttataaactttttaactttaaaactttttttaaaaagtttttaacctaggccatgtgcagtggctcatgcctataatcccagcactttaggaggctgagctgggtagatttcacttgaggctagaagtgtgagaccagcctggccaacatggtgaaacactgtctctagtaaaaatacaaaaattagacaggtgtggtggcacatgcctgtaatctcagctactcaggaggctgaggcaggagaatcgcttgaacccgggaggtggaggttgcagtgaccactgcactccagcctgggcaacagagtgagactctgtctcaaaaaaaaaaaaaaaaaaattagtttttaacttagaatcaccactcctctactatttgttcagtttttaaagagtaactcaagaaaactatatattccttcaggcagggaacacgccttaccattcttttagatccccatagcactaaatcagactagatatacaataggtatctaatgaatatatgttgatgtgattggaaggatgctaacaccaaatgtcgagacttaaaacaaatctaggccagttgcagtggctcatgcctgtaatcctagcactttgggaggccaaggtgggtggattgcctgagctcaggagttcaagaccagcctgggcaatacggtgaaaccccatctctactaaaaaaaatacaaaaaattagctgggtgtggcggcacacacctgtaatcctagctactcgggaggctgaggcagaattgtttgaacccaggaggcagaggttgcagtgagccaagatgcaccactgcactccagcctgggcaacagagcgagactccatctccaaaaaaaacaaaaacaaaaaaacccacaaatctttctctaggaaatggcaacttcatgactacaaaatctggcagcccccactttaggcagtgattccacttagcatcactaatgatctggacaaactaaaattatgtgcctccttttgtgatgatatgggaaatatacaacctcagctttagaattcttgcccaaaatatttaacctgtatataatcatgtagaaataattatacaaattcagattgtgagatattgttaagaaaacagatctggaatcttaaaaatatcataaaacacaaataagcagggagactcctatagatttagagactaaagaggtaaaacaactacatttaatgtgtaatcttgtttggatcctggattaaaaacgaaccaacagttataatgattaacattacaacattaacattattattaacggtatttggacaatatgggtatgatagattgcaaaaatggctgtgattgttcatgcccctgtatccatgcccttgagcaatatgactttgcagttattcccatcaagaggagcatgtgacttgctttgaccaaaagattgcagaagtgatgctgtgccaattccaagcctaggccttaaaaggctttgcactcttccactctcttagaaccttcccataagccatggaaacaagcctgttctagcctgttctagacccctctagagcaaagaaaagccatccaaactgaggccgacttagaccagccagctcctagtcagtccagcagctgactccagaggtataaaggagcccagttgatcagctgagcctaatccacattagaagaaccacccaactggcccgtggaattatgagcactaataaactgtggtggttttaagccactaagttttgacatgatttgtttatcagctagctgatcaaaggcaaaatttaaatgtggactctattagatgacataatggaatcaatattaaatttctaaggcatgataatggtattgtgaagaagaatatcccccttacacttaggagaatactgatatatttagagataaaggatcatgatgtctgccctaccccctagtgtaaatatgcatttataaagaaagataaatcacatgtggcaaaatgttagcaattggtaaacctaagtaaagggttttttggttgtcctttgtattaatatgtttgttttaaatttttcaaaataaaaaattagatagaaaaaaaaccacacacctctatttaccccataacacagcaagttaccgtgcagtgaacagatcctttccatctcccaccccctgaccctttttactggaggaaacactactactgctgagtggggagggaagtagatataaagtgcagtaaaccagggttatattatgatatagttaaatgaaagactcattaatagttaagaaatgtttaaaggtagatgttaacagcaagcagccattaaggttttcttcctaatataatcagaagaaaaatttgtgtagggttggatgggacttgaaaagaacaaagctttggcaagaaacgtgggcaggtctttgaattattttttgttggaaaacaaatattcctgtgtttctctattttaagagatttctcaaacacctgcaaatgagaagggtatcttgtattcatctctaccccctgaaaatccctaaagaatcttaccaatataaccaaaatctgtttattcacaacctaatgaaagccttctttatttaatttggattttccctcaagggatatgcagcaattattaacgctgtatattgacttatgtgaacaaacccagaggcctaggttcaaaggatatggctttctgaactaaaatctaaggacttcagctttattatgccatatagaaaaattccacttagagtgaatggcaaacaaagcccattctctatataaaaaacagtaatccaggtaggaagattttttttttagaaatatcactacaagtctgttcaaagatctttgaacttcgaaaaagtccagagcaatcccatgtattaccattgtcagatgagaaaaacattcaacttatataagaaagagaagaaaatattgccaggtactctacatttaatgagttggttgttctcgttcatcagaactgaaaaataaatgcagcaaagaatttgttttaggcatcattgggctcaaagccaaatccacccctcatttttcttacagaattccttgattttttagcccacaaaccccaggatgcttcagaatatagtttgaaactatagctttaaattaaaatggctgtgcaaaaggcaggtaccacatacagagagaatcttccagttatctctacaaacttcatcagattcagagaaaccaagcaggctatcaggtcttcaaggaatctttgatgttcaaagagaattttactgtatacattaattctcaaaaatgttcaggggcactgtaaaaacaactgcagggcaataggctttcctagccgaaatctgcacattagcctatctcatgaaaggactagccgtcagcagacctagacatggtctaacacagacactgaactcccattgactcatcaccggaagtgtcaactgtttaaagaagggtggattactcatttattcatttattctgtaaacatttttttttatagagacgaggtctccctttgtcacccagcctcccaagcaactgaaactacaggcatccacaactgtgcccatatatatattttttttcctagagataagatcttgccatcttgcccaagctggtctcgaactcctgagctaaaacgaccctcctgccttgacctcccaaagtgctagcattacaggcatgagctaccacacccagctctgtaaacatttattgaacaaattgtatatgccaagcccagagtaggaaaacacagattaaaagggcatacccactgcccaccaggaggtcgcaaatgaatggagaagcacaatccaagcacttagtcaaactgcaataaacagccttgccacggttaagcacttgagcctagatcctgactctaccacttattggcttggtggctttggacaaaattgacttaacctgtacaagttttgtctcctcagctgtaaaatgggtatggtaaacctattacattgagttactgtcagaactgagattacgtatatgactatacatattatagtaactttaggtaaatgttggctataattattaatctttgttattatctgagtggttacactaggtatctaaaatccaccctgagattctaataattagctgtgtgacccagagtaagtaatttaaaatctctgggtttcatgctcttcatttgttaaatgagaggttatagctaagtgatcctaaaatctcttcaagctctggaatattaaaaggctctatgattgatcttacatggtttcatatatgtctcaatgacactgctcagataaactggtgaaacaaagcaactgccaaataaatcacctttcttcagtagttgtctgaatctttcattttacttcctttaacctcattacttacccaggcatatatgggatatactaagctgactgagagctaaggctttgttgtaccaaattgtgcatccttaatcccaaacaccgtcctggaaagtgataggcacccagtgtcttaaaattaagattcatacttccctcgggaccaaagctatacatatgcaaggtgagtggacactctgaggtgtaggcctgacctctagggatccttttctaagtgtcaccacttagaaaaagggctggagaggtattccaccctttggccttcagtttcctcattggtaaaatgaagggaatctattagatcaggggttggcaaactatggctcataggccaaatccagcctatatctctacccccagcttagaataatttttacttttttttttttaagagacagggtctcactctattgcccaggcttcagtgcagtggcgtgatcatagctcactgcatccctgaactcctgggttcaagccatctccccaccttagtctcctgagtagctacaactacaggtgtgtaccaccatacccagctaatttatttttattttgtagagacaggggtctcactttgttgcccaagctggtctcgaactcctggcgtcaagtgaacctccccacttggcctgccaaagtgctgggattacagctgtgagtcacagcacccagacaatttttacattttttaatgattgcaaaaacaaagaacaatatgcatcagagatcatatgtggcccccaaagcctaatatatttactttctggaccttttaatagaaacagcttgctgcctctggattagattatctctaaagtccctttaaaccctgacattttaacattctaattctgctgggtttccttgaattgtgtgattccggctcttcacgcagagcagtaccaagtctgaaacaataccaaaggcacaacaggaactcaactacaatttgctaactgcataaatgaattctgcagcagcaaccctaagaactaaatcctctaccaagggggcaagttgggtcaatgtgtatccagtgactgcctaataaatgcccccagggtggacgccacaatgagaggaacaatctactcttattggccttttggatgacggtggcacctggaaaggcctggagctcagataaccaggattaaaactcaccttgttccaccaaataaaaaaatacatgtagccatcccctgaacaaaccccttgggcaaattataaagctatctagaaagagctatcagaaacacagatcatctaaactgatcatcttaatagccatggacccaagagaataaattccatccacaataaggcatatagaataatttagctcacaacattatttctttttccctctattgttgttaaaaatacacgataccaaaacaaggaattcaaatatttatgtcagggcaacaagccaaggaaagtcttgagtatatgatcctattaacaataatagaagatagagcaaggtaaaagaaaaaataaagctccctgcctcgactcttgaccacacatactttcccaaaataaacagccagcaattattcttttaatgttcctcctctgttcacccataaatcactgctatgtataaacctcttgctgattcaaaggattttttttttctttcagtcttcctctttttgattgctaacaatgagttctgaaaagggctgagagtgcttttccaccatccctcagtagagcatctccatttacaagtacaatacactccaaccacacacttcattgtcatactgttacgtataaatcacaaagttgatctagagattctgccttttctcctttcctctaaagaagcaacttggggctgggcatgctggctcatacctgtaatcccaacactttgggagataagaggatggcttgaggccaggagtttgagattggccttagcaacatagcaagaccctgtctctacaaaaaataaaacgatgctcacttctctccacaaggccccgtatgcccagtaatgacatggagtcacaaatctcaccttctccccaggcaccctgctctagatatgctggcctagaaggtttaaaaagaaaaaaaatcccacctctaatcccagcacttagaggctgaggtaggaggatcgctgaagaccaggagttcgagaccagcctgggcaacatagtgaaatcctaaaaaagtaagaaattagccaaatgtggtggcacatgcctgtagtcccagctgcccaggaggctgaggtgggagaatcacttgagcccaggaagtcaaggctgcagtgagccgtgataacaccactgcactcagcctgggcaacagtgagacactgtctcaaaaaaaaaaaaaaaatcctgaatattataatgctcatttctaagctcttcataaaccagaagagagacagtttaaatttggattctttccccgactcagtaggtaagctttttctttttccaatagccagaggaggtaggcaaacattggcccctctgctgacctttctatgaacctcaaaaaaaatctctttacttcccaaccttggggttgtctagccaatcaaaatgagtttaatgttagcctgcatccttgtttgagaggtaaggagcctgcattaggttcatgctgtctgagctctgcgacctctaaggaaaggtcctgtcgtggctgctcgctgatgccagccccaaacagcctcacccaccgtctctccaaatcccattgctgtaagccctgctgctgggccccagcatggccctgagtggctgtactccacccttcttagatgctctgcccttctccctgctggagcatgtgagctggagcatccactcaagctcgaaaaagaaccacatggttaaaaagaaactttttaaagtaggtagataattaatgtaaagaggggcagactgcctctacaataagataagtctgatatcgccttgttttgtaactataaaagtccttgcaaactatttattaatgtttgcaaaaagatgctgggtgtggtggctcacacctgtgatcccagcactttgggaggccaaggcaggcggatcatgaggtcaagagatcaagaccatcctggccaacatggtgaaacccccatctctactaaaaatacaaaaattagcttggtgtcatggcatgcacctgtagtcccagcttctcgggaggttgaggcaggagaatcgcttgaacccgggaggcggaggttgcagtgagccgagattaagccactgcactccagcctggcaacaaagcgagactccatatcaaaaaaaaaaaaaggaggccaacatttgcctggtttttctggggggcagaggcggggggtgcagggggcagtttttgtgttttttttttgagacagggtctcactctgttgcccaggctggggttcagtggcgtgatcatagctcactacagcctcaacctgcggggctcaagcaatcttctcatttcagcctcccaagtagctgggactacaaggtatacgccaccatgcctggttaattttttttttaattctttgtagagacagggtctcactatgttgcccaggctggaacatgtgccttttgaaggtaaagttcaatagaaaatttgaggtgattcaaataggctttggaaaacaccttggcctacttattgattattatcaggcatctttggaaataactacacatcaattatccaaagagactattactcttttaatagtgtacaatcattttaacagtaagaataagaatggtacaactattctcactcctcaaagtagaattggccattccccttccttttggggcccacagtaccctatagagattttaataatggggccaagcatggtggctcatgcctataatcccagtgctttgggaggctacagtgggaggatcacttgagcctaagagtttgagaccattctgggcaacatagggagacctcatctctaacaaaaataaaaaattaaaattagctgggcatggtggtgcatgcctgtagcctcagttacttaggaggctgaggactacttgagcctgggaggttgaggctgccctgagacatgattgagccactgcactccaacctgggcaacagagcaagaccatgtcttaaaaaaaaaaaagactttaataataggacctgaatccctttatttactcatttgtttgcatgattgtctctcaacaccccgctccccttactacccacactgtaagaaccttgaggttctataagagccatcatattccttcttgagccctattgttcaacagactgtctggcacacaacaggtacttcataacaacaggatgatggaaaaggaggagaggggatcgctgaaaatgaaaaggggagaggcagtaagagttaagaaggcagaagctgaatttgttttattcattgttacctggcctgcaagtattttttaaatggactgaaaaaactaaatgagcagtggtaccaaggcatgaaattatagagctttgttttaaagtgatgaatatgatccttcatcaattctaaaaatactttttcttacatttttgactggttggaaactaggatgcattttataatggcatcttagcattttgtgatagtgtattaggaacctcattttctttttctcagtggtacataaaatacttgtacatgttagaaatgatggtgacatagattccatgaaatgcaatcatttggtgtggctgtggtaataagggttggaaaggttgcagtgaaccgagatcgcatcactgtactgcagcctgggcaacaaagcgagactctgtctcttaacagcttttgagtccctgtgtggttcaaactagctaggtgctcaccaaacctattttgttttcttcctgggcaaacaggcctttctcagttgttactgggtcacaactaaattatggggtcacaaactaaattataatcaatagattgaggacagaagtgatataagccactttcagacctggcccatggaatccttccatgtgagatccttccatctccttctccatctgcaggttaaaaggagaaagctctaagaacagaggagtcacaagatggaaggagcctgggtgcccgaaacattaaaggcagcttagccaggaataaccatgttgaactgctgtacacacaagaaataaacttcatttttattgagccactgaaatttgggggctggtagggaagttacctgctctaaaacctcctggttccggctgtacctgttcttttcatggttacataaaatacctcagtatccttcccacacattctctctttaccccaattagagttgggttgcttccgtccataacttaaagagttctaacacagccaggaagaatgaagagctatcatttgaagcggcaagaaggtggaagtaagcaacgatccctaagtgtcttgggaacacctagaaaatttgtcagaacagggtaataattccaacaaactgatgacagtccacgaaagacccttttcactttccaagggcttctagctttaaactcataaagcacttacagttaaaaaaaaaaaacaaaaaccctcttccccaccctcatttcattctcagaagcatgtatgaagttgtaatagccctgacgtatggtttacctactaagataccctcaggagttctcatctagcaagtgagatacaccttatttatcatacatagccagctctgctgtcccagaatctattggaaaatgaatcacacatagctctaagaattcaaataattactctggggtaaatagttctgggtatgagtgtacaaccctggctagagttttcaaagataaatattcaacaatcaccaaagcttctggtagcatttacaatactataaatgagattacaaaaataaacaggagaatgatgccacaaatgcctccttgagcaataatcaggtttgccaggaactggagaccagtgatgacagagcaggcctcctgctcaatttccagaaacatttctctttgagccaaatttggtctttaagaacaagctctggcatctgtaaaacacgctacaggcttgttataaagcccatttatactatatattgagttacgtgactcagaacagcagcatgaagctgggattgtcatcagtccttccttttcagcaataaaaacaggctcaaacagatcaagtgctcacagccccaggatttgtgacttgagccaagacttaagctctgatctcctgacctcggatcctctatccatttcgctatagcccaaactatggaataccagggaagagaaatggcctggctagaggagacttttccccactgccataattcatcaacccatgttggaagctagttttccatgttgcatgcagccatgtgtgggaacttaacagcaagggctaaagggcctgagagagatgtctggcctgcctccaaagccagctgggaaaacattccctgacaagacactgtgcccacaggggaacacgagagaagaaggagcctgaggcagcagattagaagtgctgagccttccatgtgatcctgtcttaatcttatagttcaaggcctctaagaaccagttgacaaggtctctcagaactgcaaagatagaatctggagcaaatgagctgaagttttcctttgttggggagggagaagggatccactacaaacctagctgacctcaatcagcattctctcagatgatttttatgagccacttctaaaagacaaattgccaagatcaaacactcatacattgactgggaaaagagacagtgaggtgcaaggcaatattaatatattaatgttttagtaaaaaaactttccctgtgacttggtgatctaccacctcagagagaagacacagggaactggagctgtccttcagtgtgttagaaaagttgaagagctggcctcccctaactatcatgaatcccctgggctccatagatggaagggaggcgtctatgccctgcaccctgggtggttcctccagaaatagaaactctagtgttttgaaggagcatgaagtagaggaaggagccttaaaccactgtttagtctccttccagctgtgaccttaagcaagtcacaacctctttgagcctcagtttttgtacttataaagccaggataagaacacctacattacaggattgtggggaggatcaaataaaattataaatgcaaagggcagagcacagctgctcaattaatggttagtgcctaacttttgcccctcaacctccacttcaatttcttagtattgaaattgtatatttagtaattctaatccttagtaactcagcggtacttagtaattttgagaaaatcacatatattacccagtgtcttggcaatttcacttgcttttttgaagcataaccatctgtgactttagttgtgagcatctccaataactctggacccttgagtctcttactaatctgctctatgcttcctaaatgccttcaaaaaaaaaaaaatctaacccacaggtccctttttaaccttataatctttctctaatctggaagagattctaaaccttatagatatttgacaaattgctgggaacttaactgtcatatatgactaaattttccataagacttaaaataaaaagtttgccaaagttttaatgactttaataaataagtggccaagtgttatggttcatgcctgtaatcccagcactttgggaggccaaggtgagtggatcacttgaggtcaggagcctgagatcagcatggccaacatgacgaaaccccgtctctactaaaaatacaaaaagtaaccaggagtgatagcatatgcctgtaatcccagctactcaggaggctgaggcaggagaaacgcttgaacctgggaggcagaggttgcagtgagctgagactattccactacactccagcctgggtgacagacagagggagactctgtaaataaataaataaataacatgcttatgaccatagggacaacaggaaggatgaggttcttgtggtcttcttcattatcttcctggagtcatttcctcttaacatcctctcatcctagacagggtcaggtgcccctcctctatgctccagtagttatctctatgtacactgccagcattatgaccatactgtatgataatcatctcttttacgtctctttctttagcctacaatctccttatagtcaaaaacagtgtgctgtcaaatcttgattgctactacccatgagcacagtatctggcatataatagatataaaacttgtgtttgatgaatgaataaattaggtttttagatctgggagaaactttagaaataacctggtctaatacaggccttcatttcacagacaagaaagctgagcctgtccctggtcatctaggtggctaggaaaaacaacattaacaacaacaacaaaaaagaaagttgaggccacgcatggtggcacacctctgtagtcctagttactggagaggccaaggaggaaggatcacttgagcccaagagtttgagaccagcctgggcaatagaatgagaccctgtgtctacgaaaaaaaaaaatacaaaaatcagccagatgtgggggtgtgcacctgtagccccagctactcaggaggctgaggtgggcagactgattgagcatgggaggttaaggctgcagtgagtcgtgatcatgccactgcactccagcctgggcaacagaacaagaccttgtctcaaaaacaaaaaagaaaaacgaaaagaaagctgagcctcagaaatgtaaggtatcctcagaagcagcaagaagatggcaagtggtggcggccaggtgccattttgactgtagttcaaaagcagacatcacctggcactcacctgcaagaagaagcgtgtggcttagtggacacagcatgggctctataggaaaagtcttgctcctgccacctacccgtcatgtgattttggacaggttacttcctctctctgagtcacaatttctgcatctgcatctgcatctgttaattggagctattaatagctccaaagttgttagggttattaaatctgccaccatacataaagtgcctagcatagcacctggcactatgtaaatgtttactgaatgaatcatgaatgagtacctgtccagcacaccacaacttcatgaacctggtttagactttgctttcaggtctctgaccacagcaaagatggctgggacacccacaattatagaaccatgaacttggagatctgttccttgcaaggactggactttaaagcatgtctataactttgctcactgttcccttcccctgagttgcccttctcaccttcctcattgacacacaaattttatccatcttctgctgcgcagccagatctaccctgtcttggaagccatttctaacacttattacttctcagtccttcctgtctcactgatcactttctaccaagtagtaaaggagtgctatgatttgaatggtttgtgtccttttcaaaattcatgttgaaatttaatccccaatgcatctgtatttagaggtgggaactttaggaggtaattaggccatgagcgctccatgcttatgaagggattagcaccttacaaaaagggcttgaaggggtgagttgtccttctgtgccttctaccatgtgaccacacatcctttggaggatgcaggaacaaggcaccatccaaagggcacaagagtagaaaagcagagagtatccttcagcagacaccaagcctgctggcgcctggatcttggacttttccagcctccagaactgtaagaaataaatttctgttgttcacaaattactcagtctcagatattttgctatagtagcacaaatggactaagacataaggtgtatctgtttggttttttagatatacataacataaaatttaccatcttaacaatttctaagtatacagttcaataacatgaagtatattcacattgatgtgcagccaatctatagaactttttcatcttctaaaactgaaactctacacccactaaacagcttcccacttctctcctgcccccagctcctggtaaccaccattttactttatatttctttgtatctgactactctaaatatctcatataattgaaatcatacaaaatgtgtttttttgtgactggcttttatttcacttagcataaggtcttcaaggtcatccacgtggtggcatgtgtcacaacttccttcctttttaaagctgagtaatattccactgtatgtaaataccacattttgtttatccattcaaccatcaatgggcacttgggttgcttccatcttttggctatggtgaataatgctgctaggtgaacgccttaatcataaagatgtgtttcaaccacctctatagttctcaaggtgcctgacatgtgatgggctctcaataaatacttatcaagtaaaaaaggactcagctttcaagattataaggtgaaaaaatgaatcatcttccacataaaattgcaaattgtccagcagaaaaatcacacagcacagactctgcagtaagacagtcttgatttctggtcctggatctgcctcttagctagtcatacgatcttaggcatgctacttaagttttcagagattcagttttctcatgtgatttttgccaaaattaaatgatataacatgttaacacagtgcttggcaggtcatcaactaaaaaaaagtttgccaatattattattataaagttacagaatgaaaataacttactatacttgcaaacatgccattttgcttcctgaccataattttaaaagcaaaaagcatgcagaattctaagaccaaacaatctgtggcaggtaatagtcaaaaaaggacagttccacagcagtaacagtaagtacagatttgtatcattgaatttggaatcttgagttatacagctatagctcctcagaaggtagaaattttgtcacttcaaagggacaggcttaaatgttacactaaggatcttcttactcaacaaaatagtctgtctgatatctcagaaatgttttaaaatccggatcacttgagggttttttttttttttagtgctaaatctattttgaatttaatcattcatattttgaggctgttagcaaaaagatgaaaaaatagatttttattactatttcagacagaagtatatattttaatctctctcaaaagaaattgagctctctacccaacttccaattcctgtaggacatgaattccttttcaggttgctacctaaattttccaggccagaaacattctttccaatgttaactcttagaaagcaaagttcttgagttttggaaggaaaagcttattcaagtttcttttgtctgccaaaacaattaacatttaacatggctaattaaaatagctctctgcaacaaaatcagaaactgggcgttgggttgagggagaggaaagggaagaaaaggtaagagatagttgcccaaatgctagtagtggccccaaaatggcccagatggaaagggaccattacccctagctttcctaggacaatcacaacttcatataaatttaacactatactgagatgatttgttaagtggataactaaatgtgatttgatgtgtgtacttttagaaactttgcaattaaatgaatttataaataagagagaaaagtattcgtcagaccatgaattccaattgtggattcagaacaatactgtcaccatatgccacaggccaattttaatttggctcccacatgatggctaagagctactgtcggctttgcccatcctacaatgccagcctgtactgggaagcacaccaggtgacaggcaccacgctgagacctgagccttgttttacccttgcaacaaaccctgtgctctaagtattggcatctcccctctcaccatctttacctctttatttttaattaatttcagacttacaaaaagcttcaagaaaactactaattacccttcacccagattactcaaatgctttacattttctttatcattctccctctgtaatggacatttctttaccctgaaatacttagtatttcctagaaaacaaggacagtccttgtgtttccacggtataattatcaaaatcaggaaattaacattcatcctatactattatctaatctcaacccttattcaaacttcaccaattaaccaaataatggcctttatggcaaaaaataaaataaaatttctctaatatccaatccaggatcatatgttacatttagtttttaatgtgtctttagtcacttttaatctagaaccattcctcagtctttgtttttcatgacctttacttttttgaaaaatacagaaaaaaaatattatgtagaatgtttctcaattttggtttatcagatatttccttagctatttctgattagatcaggttctgtatctttggcaggaatgccacacgagtgatactgtgaacttctcagatgttgatttgtcccatcactggtgtaaacgttgatcacttaaagtggtgtctgccttgtttctccactgtgaagttactattttccttgtaacttgtaatttccttgtaactattttccttgtaataagtaccttgtgaagaaacattttgagactagacatcccctattatagatgaagaacctgagtctcagagcagttatgacttgcccaagatcgtgtagcatgaaaatgccataacacaaattcaaactccagtttgtaggctctcacacttgggatctttttaaagcatccctctgtctcctgaccagccaccaatggctaaagcagccttctctaatgtctttttgagacagtttcactctgtcacccaggttggagtgcaatggcacgatcttggctcactgcaacctctgccttccaggctcaagtgatcctcctgcctcagcctcccaagtagctgggactacaggcacatgacaccatgcctggctaatttttgtatttttgtagatctgggattttgccatgatgcctaaactggtctcaaactcctgggctcaaatgacctgcctgccttgacctcccaaaatgctgggattacaggtgtgagccaccgtgcctggcctctttccagggtttctgtgtgcaaaatcgaatatattttcttatcctcaatttagttcacaaatatatactgttctgcaccttccttctttcttttaatatatccttggagatttttccatatctgtacttagagaacaccctaattcttgtttgcagtttcatagttttcccttgtgtatacatacccatttatttaaccagttccctactgatacacatttaaggtggtttccaattatttgctattagcaacaatgatgcaaggattgtgctttctttttaaattggtttcagcaagtgacattctgttcatggtccaacaggatgcagtgtggagtagcaggaaccaagtagcaggaccagcttgagttaatcaaaactgggttttcatctggccacctctgctaactaggtatacgaccctgggaaagttacctgtagtttctgagccttcatttactcacttgtaagtgcaaaatctcgcctactttatcagattgcttttggggccaaataaataagataggctcacaatagctacatttgggacaatttgaatatcagaaagcataaggttgagggggaaaaaaggcaagaagattagtaatagattataacacattgtgagaaaaagaaatcatgggtccaagtgatattaacaaaaaagcgggggcggggtggttggggccagacacagtggctcatgcctgtaatcccagcactttgggaggccgagacgggcagatcgcttgaagtcaggaattcgagaccagcctgaccaacattgtgaaaccccatctttacaaacattagccggacatggtggtacacacctgtaatcccagctactccggaggctgaggcaggagaattgcttgaacccgggaggcggaggttgccgtgagccgagattgcgccactgcactccatccaacctgggcaacaaaagcaaaactctgtctcataaaaaaaaaaagcagggcggcagaggggttgggggctgaaagctaatctatcatatgataaatacagaaggaaagagaattagaaaatcatcccttcatgaataccaattgaccgaggccaggattatcgatagatgttaaaacttttgaattaaagttattgaggaacaggatactcaaacaatctcaagatatcacctcacagataattttattaattacaaagggaaaagggtgccctttcaatggagagatctggcaataccacctcaaccaaatgatcaaacctcatgtcaccagtgatgttacaaactgacattaggtgtcacctatgatgcacggggagggatagaacattgcaaaaaattctcaccacaagtgtttaacttgaatctaataatgagaaaacaatcagacaaatccaattcacagacaacaaacttggaatcttcaaaaatttcaatatcataaaaggcaaaaaaggcaagggtactgtggtggttaattttaggtgtcaacttgattagattaagaaatacctagaaacctagtaaagcattatttgggggtgtgtctgcaagactgtttccagaggagataagcatgtctcagtggaccaggtgtggaagaaccaccaccaatgttggtgggcaccattcagtctgctgggggcctggagaaaacaaaagcagagaaaaggcgaatatgtcaagctgtctgctggagctgaaatacactacactcttcctctcctgtcctcggacaacaactccaggctacctggcctttggactccaggacttaacaccagcagccccccagtctctgggtcttcagcctcagactgagagttccactgtcagcttccccagttccaaggactttcaacttggactgcactaagctaccagcatcccagggtctccagctcatagacagcctgtcatgggacttctcaacctccataatcacacgagcctatcgccctaacaaatctcttcccacctctctctctctctctctctttctccctctctctctgtctatccatccatcaatccatccatccatcctattggttctgtctctggagaacactgactaatacaggtaatatgctacattaaaggaaactaaagaacacaactgtattgggtaagtagtcttgataagattctggatcagaaaaattttttaaaagttataaaggacattggaacgactgaggaaatcagaaaaatatgattgtttccatgtaatggtattgtgattacatgggagaatgtccttgttcttaggggatatatgcttaagggcctagagacaaagcatggcgatatctgcaacttactttcaagtggtttagaaaaagtatctgtgtgtgtgcacacgtgtgtgtgtatgtgtgtaaagacaaaagcaaattaatccagataaaaggtacatggaatgtttttcgtttgttttttgtttttttaggtgggatttttttctttcttttctttttttttttttttttttttttaaagatggggtcttacaacgttgcccaggctgctcttgaattcctgggctcaagcattcttcctgttcctgagtagctgggactaccagtgtgcaccacagtgcctggcttcactgtactatttttgcaattgctctaaaggtttgaaaggtttcgaattaagttggaaaaagaatcaaataaaacataaaccacctggcacccagtagatgctatgacagttcacattatggctccagtgaacaaaaggtctacagaaaactcttcccccgtgcctgaaaataacatgaaccatatgaaagtaaatgccaccagacggtcctggcttcatgaagcttatattttcaatcagaaggcaaggcaagaacaggaagcagctacagaaacagtatagttttggtttcagaaagcctacctagggtctatatctgcatttttcagagtgggaggggagggctaggtcatgtcgaaaaacaaaacaagtttacttaaccttactgaaaattggttcctcatttgtatgtaaaaaattgagctaaattctactgcctagaattgagataataagacagcatccacaatacaactttgtagagcatcttttattgaagactctcattaaaagatattagtttcctacaattaaagtggtgaacaaggaaagcactcagatggttccacctttgtttttttatcagaatacccagcacaggaccttgcatttagcacacaaacactggctgaagaaggaacaattagacaacatgagacagaattcctttcaaaaagtcattcagcctacaaaggccactggagttaaaggaaagactagtatgaacttgctcagtttgagagtttgagacatgaaccctttgacaacagaatatatttatgtgcacataaatttgccaaagtccttttatacacaacatctcctttgagccccacaataatccccattttatagataaagaaactgaggctcagccaggcatggtggctcacacctgtaatcccagcactttgagaggctgaagtgggcggatcgcctgaggtcaggagtttgagaccagcctggccaacaaggcggaaccccatctctactaaaaatacaaaaaaattagccaggcatggtggtgggcacctgtaatcccagctgctcggtaggctgaggcaagagaatcgcttgaacccaggagttggaggttgcagtgagccaagattgcgccactgcactccagcctgggtgacagagtgggactccgtctcaaaaaaaaaaaaaaaaaagataagttgtccacgtagcaaacagctcaaattttttgtttgcttcacccagccacagtggctaaagagtgaaaataattcatggctgcgatcctcacaatctcttccccagggttcctgttagggcaaagtgactcactgatggccactcctaagctcacacctgcttctctaaagaaaaatgccaaaaatctgccctttgattgcttctactgaaattcagaaaaatgaacactcgggccttttaaccacctgcttcagatattttaaaagtggagcttaaattctctttgcaatgtggttgcatgactgagatgtagaggaagtgagcagaagatattttcatttcaaggttgatgacgtccacattttagtgaagttaactaaccgtaactagaaaataaaatttttctgcagaattctctggggaaaactcttgactgctttattgtttcagttcactttttaaacactgtactgtgttgcaggcagggataaagtatttctctcttccagggatttctacattatttacacatcaacttttattaccaccatcacaaaaaccagcaggaactccgtagttcaatttttgcccccgttctgttcacccttcgcaactagcttcccttagtaaaagagttcagcccaagtggctaatggacttggcaaaggtatgtagagttagccctctcaacattgctgacaagaatttaaatcagggggcaatgctagtgcccttggactcagcatttctgccccctgaaagatatcttacagaaatattcccacaaattcataataaaatgaggtactcaaaggctcactgtagcacagttcccaacaaccattaaaacaggtaagttggagcaatatgcaaatacatgggggaaatgcccaaaatatattaagtaaaagagaacaagcagaattacatgtgctataataatattgctagtacacatatggggaaaaatgacagaagaatacacatcaaaatctaacagttgattatctttgtgggtagaattaaagaggactttccctatacagtccatgtgtttttctgtaatgaattttaattaatcttatgttatttctttcttttctttttttaagacaaggtctcatgatcagggctcactgcagccttgacctctggggcttaagggatcctcctgcctcagccgcacccttccccatagctgggacacaggtgtgcgccaccacacccagctaaaaaatacaaaaatatcttcatattttttgtagagacagagtttcaccatgttgcccaggctggtctcaaagtcctggactcaagcaattcacctgtctcagcctcccaaagtgttgggattacaagcataagccactgcgcccagccaatcttatgtcaattctagaatcaaaaaacaaatttgagatatatatttaggtaccttttcccttcgatttgggaacagctaatgttcctcctgcattgctccctctagtaatgtcacacatagagtgccagctgtagaagtttccagtcacagaatacaggattgtatttagaaaggatataaaacaacacttacaatgtcccaaaaagtggtatcccagcccataggctgattaaatacttgaaatgaccaggaaaatcactacctcctgaagcagcccttgatgtgttctagctttgctatgacattcctgaagacattcaggaacgccagctgatcatataccaatatctacaacgtgtcaggttaaacaaatggaatcattatcacatccaagaaaactaacattgttactgattatctaatatgtagctcccattcaaatttccccgattatcctgaaaatgtcttttgtagcttttttttttaagtccaggatccaatctaggattacatgttccatttggttgtcatatctctttagtctcccttaatatagattgtcgtccctcataccttccatttttgttgtctttcatgcgtgacatttttgaagatcataagccagttattttgcagtatgtcccacaatctggatttgtctgattatttatttatggttagattttttttttcttttaatagagacaagagctgggcacagtggctcacactttgggaggctaaaatgggaggaccacttgagcccaggagttcaagactagcctgggcaacatagtgacagtttgtctctacaaaaaaaaaatttaatttagtcaggcatggtggtgcacacctgtggtccccactgctcaggagtctgagatgggaggatcccttgagcctaggaggtagaggttgcagtgagctgtgatcacaccactgcactctagcctaggcaacagagtgaggctctggaaagaaagagagaaaggaaagagagaaaaggaaaggaatggaaaggaaaggaaaggagaagacagagtctccctatgttgcccagggtggtcttgaactcctgggctcaagtaatcttcctgccgtggcctcccaaagtgctaggattccagatgtgagctactatgcccagccccatggttagatttaagttaagcatttctggcaaaaattctacatcagtgatgttgtgtacttcccattgaatcaggttgtgtagttacactaaattatctttttcctcattttgtcactgtggatactaaacaagcaccacccaataaataaaatgtttaaaaggataaataatgttaaaaacagctaccatgagcaccagctataccaagcatagtgtcagacatttaaaacacatgatctcatcatgtgaacctcccaacaaccttacaaagaaacagaggctcaaagagattaagtaatttgctcaaggacacacgcgtatgatacaaaaatatgtgcatgtacgtatgaactccagcacataaatatgtatacgtatacaatttaacatgatctcaaaggttcatggtcttcctgaggacctttcaggcatgaattaagaactgctacgttaggctaatcttgaggaggcctacgtagttctcaaaagttggcttcctataaggaaaaaactaaaaataaattaactgtggtccatattaaattcctccatacttggaaatgcccttatttggagatggatcacatttccaccacagccaagaaaatagggcaatggttccctaaattattacactattctgatgtttcatttctgcaacaaaatgagaaaacccaatgtagagaatttttcataaagctaaatatattttctatgagataaaagtgaggaggcattttcaatttactacagaagaataactattgttcacagtacattcaattttattttttgtaattttactaatctatataattcaaaactctgagacccattgattcagggaactctgtgcaattagaatgatttttttgagaaactgacttgaataaaggaagttcagcccaaaaagaaaccagatctgaaatatttctgaatttccctaaaagtgatcacaaaatatctcaaaagctgaaagtgtcaagaatacttttttttgttttgagacagagtctcactctgtggcccagagtagagtgccatggcacaatctcggctcacagcagcttccgcctcctgggttgaagtgattctcctgcctcagcctcctgagtagctgggactacaggcatgcaccactacacccccgcctaattttgtatttttagtagagacggggtttcaccatgttggccacgctggccttgaactcctgacctcaggtgatccacccacctcagccacccaaagtgtggggattacaggcgtgagccactgtgcctggcctagaatacattttaatgggtctcttaaaagcattttacatttggcatctgtattattactaatagtcctcttccaatgtgttgatatttcctgcttttgaataggcccttagtgacttaggttaattcactcactctaccaacatttagagtccctaatttgtgtgaggcattctgttgggtgcctggaaacacagtctggagcgcttttgcttgccttcatgtctaggatcaaaggtgtggatgcctcccgcacccatcacccctaccccctagcctagtattgccaaagtacctctttgtacgtgattatttacgtttgtctccctcacctgagtgaattcctccgaagtaaacagtatcttattcaatgttgttttcctagcatggtgcatggaaaactgttataacaaataagtaaactgagtatactgttgttttccatgctggggtaagtataaactattggaataaatacattgtacagatgaggaaactaaagctcagaaaaaaaaatgtgatatgtccaacatcatacagctaataaataagcagtgtccagtgtgagaaagcctcgtccagagctctcttctactccatcatgccacatcctacacatggacagcaagagtgaaagatcttagatgtcttccaggaacctcaaactcagcatgtccaaaggtcctcccttcggaaaacaaaaagacctggttcccattcagtgttctctttctctgaaaacgtcatccccagttgctcaagaaaaaaactcaagtcatttcatgactcccttttctccctatccccccatccaatcaatcaacaaatcttatcaattacaattttcaaagttagtgtcggccgggcatggtggctcatgcttgtaatcccagaactttgggaggcagaggcaggtggatcacctgaggtcaggagttcgagaccagcctggccaacatggtgaaaccccatctctactaaaaatacaaaagttgccaggtgcggtggctcacgcctgtagtcccagcactttgggaggctgaggcgggtggaccatttgaggtcaggagtttgagagatcagcctggccagcatggtgagaccctatctctactaaatatataaaaattagctgggagtggtgggtgcctgtaatctcaactacttgggaggctgaggcaggagaatcgcttgaatccagagatggaggctgcagtgagctgtgatcatgccactgcacttcagcctgggcgacagagtgagactctgtctcaaaaaaaaaaaaaaaaatacaaacgttagctgagcatggtggcgggcacctgtaatcccagacaatagggaggctgaggcaggagaactgcttgaacctgggaggcggaggttgcaatgagccgagattgcgccattgtactccagcaagggcaacaagagcaaaactctgtctcaaaaaaaaaaaacaaaaaacttagtgtctctctaaaccctctgtcaccaccctagatctaagcaccatcatccctcatacagacgacaaaaattatttgctacttggtctctacacattcactctgaccaagtctttccttcaatctcctctacttaacagccaggataatattttaatatcatcctacatatgccattcatctagttttttaaagccaggctaggttctcattagccttaggataaagaccaaaatacacctgtagctcaaagaactgcctactctctagcctctgcccacctctccagcctcattcttcattctagtctttctcctcttgctctgtctctaacttcctttcaaatcctcaggttcaccactcttccctttgaactttgaacatgaagttccctctgccagaaacctttgtcccactataagcatctcccactgccatcctgaattactacttccgtttaccctccaagtctcttgaagtgtcacttcctataggaaacctttcctgataaccctagacaaggggaaagtaccatgtcaggcactcctacccaacccttttggaaatggcattcatcacacttgcaattatttattaagtatatcccctattagaatataagctccatgaagtcagggaaagcatttgttttcactgatgtatccacagtgcttagtacatggtagctgctcaatcaatataaattgtcagaattataggttggggccagattatagagggctataacatcagtaaaccaaagagcaaggatcattatccctttgcaaataagtaaaccgaagcagaaagaaatgaatagttatttaaggtcccagagacagcagtgatgaggccaaatctaacactacattcagcccatttctcctccctaggacaataaaagaaactttggtgggtaaggaagtatttcagaagaagaaaattaggaatgagaagatggtgcataaaaggtctaagaggacagcttctgaatctgcctgttacactagttgcctccagatggatagcagttagactttccacacctagaggagcactgctgttacataaacaaatatagccactatcacactcttcccgttaagagaagagaataaaataacaaacttctttcctgcacagaggagaagaaacaaccagggtgggtggggaactgttgtcctccaagtatcttcaaaaaaccaaatgggcagtttggccacctggattgctactcagcaatccacagggaacaggaagaaagaggggggaaagatcagccttcccaccaccagctgcagcaaggataaggaaaaaaaaaatgtattgtataaggcaagccacttgaagactacttattccttgggaattatgagaacatttcatgtagagcatttaaaaaccttgctaatccataggcaggtgccagtgaaaggaaaagtggcatgagcccaactgcagcatttcattgttcacatgctgctggggctaaattatgtctgtcacaggaactacaaaccagaccaggggtcaggctcattgctgctcatcctgccaagcacagactgcaagaaaaagaaaaggcaaagaaattctcttcaaagaggattctgcaaaaatattcacatagtctacatccacccaggagttcctagttgaagtggaggaccagggagtgtgttctaagattgaagagaaagagatgtgatatgctggtgataaaggaggggttttgaaacagaaaggaaaaatgtaaactgcaaatggagagatagagaaataaacagaatttcaagagatgtgggtgggatggggtggggtggggggaagaaatgaaagtacaggagagaagggtagggtgtccagaagagcagagcgtcatcaacagagagacgcagaggcaaaggctaactgttgatcttttcccaaatccaaaagctgctcattggcatcccaataaatcactctactacaaagcccatacaatggactgtcctttgcattcagcatcaagcagcatttaatgaaatatcacacagctacaactttggagacctaaggatctgaatttaaaatgaacaaaattggcttagcagcagaagacagccagtaaagaatttcgcccatgtctgactcagctaggaaaaggtttagcattctagagttaagcaaatactctggcatttctccttcttttgacattccaagagggggtgtggttgaccccaggcccattcatttccaagggtgtagatctctcagccaagactggccccatctgttgtggagccagccagctgtttatctcaaagtaacatatctattgccctaattatccctataactcttacaagagcatcatgtaagtcagaatgctttctctcctgttaaatgtcagttcgtttaaaaaaacaacaataacaaaacaaccaaaatcactcttccatgggcacctttcagtaatggcaaatgaaggttaacagcgcttctaactttccctttctctaatgtgttaaaatgaacccctcttccctaatcgatctcttcaaaccgttatttgtgagtagtgactatgcctcaggaaacagcagctcattatggtaccattgtcagtggcaaagagcctatgcaatgtaatttaaaacacacaagcacaaatctgtcggctccacttccaaacaatcttgaatccagcagtcggagaacggaaaacatttaacaaaaacgctgcttccagcagcctgaaagaaccttcgccagacacgtgaaatgtttctgactggcacggagtgcaccattaaaggacactgtcacctcaaatcagcagaaaaggcgagacaaaccacatagacatacacacataaaataaagccctacaaaacttaagcacgttcatcttaaaaattaataactagtgctcgtccaagcgacattcaaatgttctaaagtagtgcgaccacattaattcactgtctccatttctccccacgcatcaccccttcccactcaaacctcagctctcgggccgtgtgtgacaggactgcagtcccccacctctgccttcctcagattttccaagagcactccccaacatccttcccagcccagccccctctctccgcctcaaaaaggttgagaggagttgcgactagggaattggcaggcacccgtcctctggcgggggaaggttgctggagttgttctttgcagtgacccaaatggcacagagcttttccccttagctgtgcctgcaagcctctccccaatcccccccacctccccaccgctcacagcttcccaaaagaaagccttgagaactaagcgggaggaataacttggtagaagcatttgaataaatcacttcaactcacctggtttgggatttttctccccaccccaggcataaacagaaatggatgtgcgaatgagtcacgcacgcaagggaaggtctgcgatgtcctgagtccaagggctggagtcagtccctgccctggtgctgctgctacacttagctcagctggag

SEQ ID NO: 758 - DNA, 92997 bp, Homo sapiens
caacgcccccatcgagcttgctttgcttacgcaaggcctcagcctttgcctcttccccaaacccaagctacctgaggaggaggagctgagtgagggggagggaccaacagatttgtcccctgtgcaggctgcctgcctgcttgagttacatccacaaatgcctcggaagcagccagctggctgcatctttctcctcacattcctgggtctgtctgggctggttggcacagttaccagaacgtactacattgggattgtggaagaatactggaactatgtaccccaagggaagaatgttattactgggaaaagtttcacagaagacaagtgagtgaacttagggtcctcattgactcccaggtttggcctctttttgactttgtgtggggaaggttgtatttcttgggtacttacaatgggggtgagttgatctagaccaagagaaggtgttttgttttttgcttgaagagccctagtatggatgggtgtgtaatctggaagagatattcatagctccatgtatttgttgagccacctattaatagccttgcctgtgaagggacatatacacaaccaggtgtttgacaatttccaccaggtactactagtaacttctgggggattctgtttgtttgtttgtttttaaatgacaacacttgggatgaagatttgagaaatttcaagaattccttatggttaaaacacagtgttttcttagtttgtatttctggaatgaaacatcataatgggagataagtatgctaagtcatgtttttcaacgtttaaaagagggggaagtcacaggagatttgcctgctattttcagggtttccttgagtctacttagaattagcgctttcactggtaaaaagtttattccagctccaagtcattcttgctgagggcaatatcttatcccagaacctatagcatagctaggtgagatggcgccacggtgttctatgttcctgatttttaatttggggcagaaaataaccctttctccctgccccctccagggcctagtatcttaaccatctaatttgtttcatggatctccctctgaagtcacctcctgactccagaagatgtcatgctattttcaactttgtggttattagaacatcttttcagatgttttggcaacctctgttggatatttgaatgcttgcttcttttctgacaggcagaaccagttgcattctgcatccatgttccatttcctaaagatgagtttagttgataaaattcaggaacagcacagggcctaccagcaagtctttaagagccagggccccttgtctttgaggaaagaccaaagatccagttggcttggaaatacagcttccaagttttctaacaaaacaaaggtggtatagtcatgttttgtttaccaaagatgaagcctgtgccagacaagctgccaaggcagacttttccttaagctttgtacctggaaatgtaatgtctgcagggctatttccaaaggaaactcttgattgctttcaatcccacatctgctgaccattggtggtagtgtctttactgtgatgaatagctatgggattgaaagggtaccaaaaatgccaggagccttctctacaaatagagctctgctattctcagagagggctcagtaggaaacagtcaatgtgagcagctactggggataagaatgttgaaagtgtgtacactgagtgtaatgaatatagcgtttaagctaaatgtgatactggattgcctttccataagattaacacccacagaaattcttcttcctaaaatgcccacgtcactatagctgtgtatgggcatttattctgacccaaaaattctatgagggatttttcaattcattactgcttgcagatattattattctcattttatgaaccaggaaccaaggctctgaggttaaatacttgccggagtttataagtaagtggtagcaccaaactcattgctttggttccacagcccatatttcttttcaccacacaatctgtttcttggtaaaggtgatccttctccagtgaattaaaacaactttgagggaagccaaggatcacagtaataagaactttctagaaagtcctaatttttgccaaaggcatgtttagtctcttttgtcactcttcctagaagcatattgaaagggatcactggtggtcagtgaccaaacaagttatctgggttaattcaaaacctcaaagaatcataaatactcaagtactacaatgctgttttcacaaagtggggtgctggaagaagttggggtctctgttgatcatttcaaccagaagatggtgctttgatgaaagtacaataaaacatataaaaattgctatggtgaaaaagaaaataggcatgatgaaaacagttggtttggcatcagatttgagtgagatggtttcaaaatgcatggtcccatatgatagtgcgtttgttcttagaagcagctggcatgctaaggtgtcatacctagaacgccaaggtccccaaacatttctttctggtatgcgaagggacagagtttgtgtcagacagactgctacctcttggaagggaaatccaggtgagtatgcagtggacgttggcttttatcagtgatcccatcagaatactggtttttatcagtgatcccatcagtgctagtagttgtggtaggtggctcagacaagttcctaaaaaggtagggctgtcgtaggtggctgacattgcttgtggaccacaagatatccatcctgggtgtatgtgaagatgctgtgactgggacataagtggagttcagtgtgtgtactctgtgttgtgccatttccccaggagcaggaaggagccatcgtggatgatgtaatcatgcccctctctcagcctcctggagggtgaataggctgcctttctgaggacagtctgttgttttggatattcacacttgggcaaatgtctgatatttaaaggaccaggagagccaggtgctcagaattccaccatgaatggaaagaacctgaaatagaaatccagagacctaacttctaatgcttgctctgcccaacttgctgtgtaatcttgaacatgtcatataatctctctgaatatcactttccttaatttgtgtaagaagggagttgaaatgtaatccctagagtcacttgagaagtgtaatgccaaagcattagaaataattttgaaactgaatgaaaaatatctttcctgacttgccagttctagaaagatttttgcaatggtgaaagaaaggagagagatgatttgcaaatgttcagtcctagaaattagagttggagaagacctgggactgatcgtgggcatatgtgacaacttttgaagtagtctttatttttctttctccattttttcccctgtcctttaagaattatctccaattcctcacttcatacatgaagctttcccccatgaccctggcttgtactgatctgtttccttcctaaccactcatggagcttggggtctttatcatgaacttggacactgcattttcttccctctgcattgccctctaattgcttgatgtacattagtcatgtctgcaactgcagtaaaacaccctgatgatagataagaagttttggcgtatattcaataatcccccttccctgcacggaactttgtcattgacaatatcctatggaggatccagtacagggcaggcattcaaaatcattgaagtaaaagctaatcaccttatcaactgagttgttctggttgttttatctttgaataaggggaatgggcaaaaatctggggaacaagatggtgggtgccaaagtttcagtaatgtgaaaacatttggaaaccaaagttaggcacatccttatgcacaaggacgagatcgaaaatgaattgaaatcattttgctgagactctatagccctcagatggtgcaaattaacttttatgcttggtacctatgcttgattatagggttcaaaaatataattgagtctataatcactaatgtttcctagaaagtataggatttaggagttagattctatttagaaatactttctccagataaatatacttctcctcctccttggagtaaatggggacactgggctcctttgagttgcctggggatggtgtcagtattttgatctatttataccagtcctgctcaggctcataaagtccttaattaaggtgtgtgtttggtggtaaagcctgatccttaatggaagtagggtggggtcatcttatttaaagccacagttctcaccatagacctcattaggccatcaacacacattcagcctttttcttcccagtgaaatgcagggttttcatggacgctaactcatgggtggaactgcgcttgaacataagtgaggctagccactgctcaaaccccatttttgtagagtctgttagttgacccagccacatcactgcatcagcccagtgtatggcaaggggctttgagtattctaagaagcaggccctaggataggtgtgagagagaactcacacatctatctgaaagaaggaccaactgaggggaagcagggaggagacagaggtttttgtgagctttgaaataaagaaaagaatatcatctggtaagtgcatggtctaaacaaatggtaactttcaaatctcaacttctgtcttatcagcaccaaaaatattttgtttggactgatgccatatgaatctctgggaactgctgttctaccctatatcagtaagtgattgtttctggctgccactagagactggagtataatgtctttaacaaattaggattttgtattcatttgtagaagaatccagaagtgggcagtccaaggctggtgggatagatggtataacaagatatcaggggctttctgtatttctgatccaccatccttagcctatgtgctttaaaccctttgtggtttccctcctcaagcacattcatggtcacaagattgctgttggatctccagccatcgtgtctacattccaggaagaaagagagaaaggcaaaaggtagaagcagaacaatttttgctgcatcagcctttcaaagggttctcattgaaaccctacccaaccaattttacttaaatctcattggatactcatagccacaaagaggacttgaaaaaatataacgtttcagctgtgtacttttctgcctgaataaagatagaatttacctctgacactaagaaagaaggggagcatgaatattgcaaggcagctggcagtccctgctcccctcccctacctcagttctctcctgttttccatgattcacaggcatcctcttagtccccatcttgcttttcccacctccatatgatggacccccaaggcctggttagcaggatctgaaagataactcattgacagtataataagttagctaagtgtcactgagtatttactatgctccaggcattgctttaaaaggttagcacaccatgaagtggggtgaccaatcttctgtctctgggagggagatcaggtggcatcgggaggatttctccagccaagtgtagcccagccttggtcttagggagatgccaaggcagtccagtttgctggtaaagtatggggctctggcatcaactgtcacatttagaattcttgccccactttatgggcaagtaattcaatctctctttgcctcagttttctcatcagtaaaatagggatagtgacagtacttgctttgagggtgtatcagttttctgtggctgctgtaacaagttacaaactaggtggcttcaaacaacagcaatttattctcccccagttttggaggccagatgtctgaactgcatgtgttgtcagggccacaatgcctctggaggttctaagggaggggccattccttgactcttccaggttctggtatctgccagcattccttggctgtggctgcatcactctgatctctgcctccattttcatatcgtcgtcttctctctgtgtgtctagcctatctttgcctcttacttataaggatgcttttgatggtgtttagggcccacccagctaatccaggatgatctccccatctcaagatccttaacttaatcacatctgcaaagacccatttttccaataagtttctgtggatgaggactgcggagttatctttgggacttaggatctgcacatactcagacacagtgcctgccacttgagagcacttgatcagctctcgtggtagctctgccgtctcacggggttctttggagagcaggagccctgggggaaagaccttggctggtcacattttcctcttttctaacaaagctttacgctttaccagaaataatcataactgtcattgattcagcaccactctcccagttgctgtgtgtgtggctctacacctcttctcattgaatccttatgatagctctaccatggtcactgctttacagcagaggaaactggttcagagaggttaagtctcttccccatttcacaaccagcaagtgagagagttgggattcaagctcattttcattccccctcatcatgccatttgttttgaacacaccttgtatatgaagggcttctgtggaaatgaagagtgaaaaggaaggacccaagacataggtggtgccagggacccagagtgaaagaatgtatatagaagcacatccagatggtattaaaaattattaatctaatagggagggtgcagcttcaccaaactgaatgtgcaatctccgtctccacccttcctttttccaagtgacatttgtctcaatctcatctttttttctccttggtgaagaacgttccttctcaagctcaaacaatatttcttgtccttattgtgactcttatgatctcacatgttggatctgaccacactctctgctaacattattttgcagtttatcttcatcttatatttccctgccctctacacagacatgtgggctctggacagtagagttggcagttaacattgtaaaactgtgtttactgtcaaatgcatgttttgcttcccaactagatggtaaaactcttgcatgcagggactgagattaatacatcttggccccagtttctagttttatgtcccagacatagtagatgatcagcaattgctccaaggaagctatcagaaaacatccctctaaaagatgcagaggtcatgggattgctgggtggtttatatccctgcaagctacgaactcctgagaatctaacctggaagtccaactctgtactgtgtaggggattcccaagggcaggtttgttctgataatgattaatctcctctgcttttggaagatatctccatccacaggattggccccaggcactggcaatgtaatgttccaagtccccatcttgtctttaaggcagttgttaatgttaaccttcctggccccactggattcttttgcagcaggaagtagacacctccttagcttgagtcaagatgttagaatgcagattgaaaatgttcttgaggaatagtgattgctcagcccctcgccatggctacgtgataaacaacagatggctcaccaatgcaacattctaacaaatatactccatttaaattggaggttgcttcatggggatggctcccttgaagttacttccttactttgtttcttgggcaaatttgcattttatagaactcaaaggagctggagtttctgttctactattacaaatgcataatatgttctcaatgggtggtttgctgtgtagacactaaaacaaactactttctcttatttctatcccttcccacttctttttttactttcaagctttttttcctattagttaaaaaagtataggatctcactgtattgcccaggctagtcttaaactcctagcctcaagtgatcctcccaccttggcctcccaaaatgctgggattaggcatgagccaccacacccagcctcaacaaatttttatcaaatagttactatagtttttgttttgtgtgaagtatcttcctagggcaccttcatgggtcaaccctgtcctactcttgatgtggagtcagtgcaggggaagaagtcctgggacaaggaggaagctatgggttctcttcactgtctgagcaggaggctcctcctgcagcagaggaagagagggtcttgcaataataattaaatgcccccacccagaagtgacacgtggcatttccactcacagccaatttgccagaacactatggcccatctaacttgcaaaagcagaatcactgtggtcttctttggttaggaggaaagaaaaattagaatacgcaagccctaaaaagctctactacaggaatcatttggtgatcttaggaaaaaatacagataccatggtcttgccagtagaaagtctgattccattgccctgaagtggggcctgagaataaaaatttggcaaatgttccaaatgattctgatgcaagtggtacatgggtggacatttgggaaccactgctttagaaaacccaatccccccttggggtgactattggctgtataggtgataagactgatatgtgtccaggaatatgaaaaacagtcaatgtataactcagtgccaaaatatgaagcataccataagtgctccagtccctacagggactcagcaaacacttcactgcccctcctgatacttattttgcctcttatttagtgcctttgccagacaactcatggtaagacctggtcttgtggaggtgatggagaaaggtcttgggcagaggtggggtcaggacctcttagcagattaaaagcaggagtacatatgtgaagatgtgagcatgtgtgctccacatgcatctgcatgtgtgtatacttttgtgtcttcatgtgtgcagtgggagaacagggtagagaagtagagtccaatgtccatccttccctatagggcctgttggaatgataaggtcctatgaataatagttttgtattatagtttttacccatcaggctgaacccagagagcataccagggattctgaatctaatccttgctgtgccaccttactgggtgacccattgtcagctataaaactgggcaactctgaggcttattagcaagcttggggatgactcagttcttcctctgcctcttcctcttccttctccttttgcacagcctgttcaatcaggagttgtattcagctactctttaacagaatcctgaaaaacagaagtggtttaaatcgattaaagatttattattattgcttacataaaagagagccagaggttggcaatcatctgggtcccaggttccttttggctctcacttgaccattcctagggtgtgaccctcttcctcgttatctcaagatggctgctggagctccagtcatcatgtctacatttcaggcatgaataaagggaagagaagaggagaaaaatggtgtcttccagctacacctggagaagtatcattgagtgacttctgcttacatctgattggctagaattatgtcacatgactattccaagttgcaagcaagtctgagaaatgtaacagcctctattataaaggtccaggggtcaggcatcccaacttttatatcccattctcttgcacagggaaatgtaagtctttgccttatagagtgggagagggctaactcttgctcctgggtagacacatgcaggcttagtggatgcttggatacaagagacccagaatgttcatacacagtcccaagacttcagcctcaatgcctgagaggagagttggcaagccagaggttgagcagggatagtgagcagatgccatgctctctgctccagaggccaatccccttgcagagcagaactcaatccaacaacaccctttgttgtggcagctttgtttttagaaatagaaggcatgcaagagaattttggccccttggaggccaaacagcatgggtcttctttttttttcaataaaacgtgagcttgtttttagtattgaatttgtaggtacagagtaaccgcccctccccctacaacagtataaaagaggatgagtgaaagtaaacttctcctccgtcctccctcccacctgtggcttcagtctcatagtctggaggctacactttgtttccctggtcactttccagatgtattctttgcatatgggtaaatgtgcattgttacacacacacacacacacacacacacacacacacacacaaatgggataatactttacatacggctctgcaatttgctttttttttattagtatcttggtgatcacgccatatcagcacctgtagaccaccttattcttttcttatgggtatgtggcatgaatgccatcatttatttacccagctgccagttgaagaacattttggtctttccaggcttttgctatcaaaatcattctctaattttttaaacaggattcctctcttgatcacattgtttggattggaagctgaacctagtaattgggggacagagaacattgctgcctctgggaggtcttgtcctgtgattcctggggttcttctctagtcaggcccatctctggcttctccatcgggggtctaaacccatgggttccttcttgtcccaggacctcctccctaccacggactccacctcaagggtgggatagggttaaccctgggaaggttaataatcagatgctctgggcagataaatagcacggatctccttcatctataggagaggctgagtactgaggagaggagaaagtggtctggtgatggccattcttacctccctttggctgcaagccaaaagcagtctactctacagttcactgcaccaattctccttggaatagatttttgtggccacctgttagtattcgagcataacctttggggtctcttcactcacctcccaaaccccatctcaaacagctaatcaaagcctcctttccaatgacatacagtgcttaccccacagaagttccacaggttgcaattttctccaacttcaatgtcatttccagtgaattttatccaccctgaaatgcttccagctccccagtgatgttccagtggcctttagatctgagacccagctgctctaccccttaatctggctcagctgaaaaccgtgggggattctccagcctccgaggccaaggcctgcttcatttaaaagaggctttgttgctggtgggtttgacctggcttatgattttattacgtggtctggggcaggctggatacctcagctggctagacagcgggagtgataatcactttttagcttgacttttaaaccttgctgcgctctctttaaattattttctttttaattttgctatgctgtaagcttcagtttacaaattagaaaatgtcaaggtggctgtaaaccccatttgttagcaggtcccaacagtctttgggaggcatacccagcaaactgaagcctataaggttgttatagtaggtagctagtcaggcatgagcagggcaggagaggggtccgcctgaccaggaatgtcaggtaaccaccaggtgatggtcaggcggttgttaactgtctctctaaagtaataattggtcacagtcagtgccagggaaaggcagtctccctatagatagaaaaaacctgaaactggtgatcagcagcttcctgataagatctcaggagttgggcaaatgggctcaagcaagtgcattgaggggcaaaacggcggagtttaactggtatatgaccttccagggacattccactggtaagggaagaatgcctcacgtgagcatgcgtacagctccagtaaacacaccgcacctgctcatctcccaagtgctaggaggccactgcacatatggacaacccatgccaagggaagaatcaggggagaagtgacacaagagcccagaagtatgccaatgtataaaaccccaagtcaaaaggtcaaactgcgcacttgtttttcaagtcgcccgcttggccctcttccaagggtgctttccttccttttgttcctactctaaagctttttaataaactttcattcctgctctaaaacttgcctcagtctctccttttgccttatgccccttagttgaattgaattctttcttctgaggaggcagggattgaggttgctgcaggcccatatgaatttgctgctggtaacaaggtcatatgttgaatttctgagagcagctgggtctcagatctaaacaactcaagtgtgttttctcccagtagtaagatatgatgtcatccaggtgtagagaggacccgaagactctggagcactgtgtggcctggccatttgtgtagggtaagaagagcaactatgtgcttggagtgcccccaccctcatatccacagcggacatctagtgtggatcatggtgttcttctctcattgaactcaaccttgacttcttttctaagcaattaccaccaattagatttggtgcacaagataaaatctattggctgtcctggacctagagggtattcaaatatggtaacctatgcttttcagcaaatagagtttgcaacaccatcccagctttagcttgccaatatggggacaaactcacacttgtttgtttgtttttaagtgccaaagccattaaacaccaactcttccaggcgagttgctggggcttaggaataaaaaggatgtttaaaggggtattgtcttcaatgagctcacaaaccagagatgtgcatatctcactgtaacacgctttggtgagtaccattattagcacatgaacagagcactgtgtatgtagagaggaggaaaagaggaagagtgtgagtctacctcaaagggtgcttggcaggtagagaatgaggaagaccactgaggcccaggaaaaagaatgtgctgaagtcttaaaatgctgaaaggacatggtgtgtaccaagaagagagtgtctgatctggcagaagcatggggacctgggagttggggcaaagagggaggaaatgaggttggagagaaaagctgttgcttcaaagaggactttttctgctttgatttgaacctgtggatccttcttcccagcttgactcagatgtcctttcctccatctgcctaagtgattcttctaccttctaaggtggttcccatcttctgctccatgcgggatggattccaggctgctcaatatgttgatctctagctccatcatcctgaaaagtctgcagggtgggcaaagccaccatttattattaagactgcttaggagctttgaagtaggagctgctttgaagtaggagtgcctgagtcactgtatactaatgtgatcatctctttgaggaaatgaagatgaagccctgaaaatatctctttatctttttgatctatagtgtttttcccaaccttaatgaagctaacaaagattcattatttaatacaaaggctatcagacctggtgtgactccatcaacaaaggaatgtggctgtaaaccctatttgtcagcaggtctgccccttgtcagaaagaagggagagcaatgcagaaaagatgacatttaagtaaagaaagataataaaacttcacaaagaaagtcccagactagacaggcaagcagatgccaccctgggccactgggagtaggagggccagctgaatccgataccaaggaataacatcccccaaatcaggcatgaagttaaacagagccctggtgagcatacagttgtaatgactcagtattcagaggtggaaggtaaggaaggggcttgatccagtgagcagaagcagatgagaaaaatcatgtgggcaggtatgatgaaaaggaatcagatataggatccttccaaaattgtcttccctagacacagatctggtcaaatacatctgtttaagaatcttcagtggctcttagttgaagatacaattacatctaaatgccttagccaagcactcaaatttctccacagtttcactcttatcaaattttctggtcctataaagctgcctgtgatttcctgaactgacctctaattctctcacctggatacctttctcaagctcttccttctatttgagtaaggtattgaggtgtctctccctctgtcctaaattcccataacacgttcttttcctacaattcttagcagtttcctttgtgcaggtaacaatggctttgttccttcctcttgactacaaacgtacttatttagagattgtaccttttttattattgtactcaaaacaacatctagcccagtactttgcatgctataaatccttaatctgtacttgttggaagtcagcagaatggctttcaagcttacccaagactgaaacagaggcgatgcctgtgggatcttctgggagagttcctttttttaaaaaatcttttattatactttaagttctagggttcatgtgcacaacgtgcaggtttgttacacatgtatacatgtgccatgttggtgtgctgcacccattaactcgtcatttacattaggtatatcctgggagagttcttaaaggggtcatgcggggtgataggggcagccagagcctatgacaaaggcaggcagaggcttcctgttggtccccctccagagtggtcatgaaagtctcttttattttattttattttttgagacggagtctcactctgtcacccaggctggagtgcagtggcgcgatctcggctcactgcaagctccgcctcctgggttcacgccattctcctgactcagcctcctgagtagctgggactacaggcgcccgttaccacgcccggctaattttttgtatttttagtagagacggggtttcaccgtgttagccaggatggtctcgatctcctgacctcgtgatccgcccgcctcggcctcccaaagtgctgggattacaggcgtgagccaacgcgcccagcctgaaagtctcttttaaatttaattttatttattactttccttttataccaccactgaaatgcctgaagttcatggaagcccttaagggcgtatttcattagggtgacacagtcatacatgagtagaaactttatatattctggtccaggaaatatgtccacctcagaaggagcactgtccctgggtctgtctctggacagaataggaattcaaatgaggtacagttaaaggctgaaccccaagggtctatgagtttatagctccacctgctgatgtctgaggctggggcttgggactagacaagggtgcctgaccaaggtatctgcctaggattctgacttggagaagggagagaagaatcaaagaggatcgctgtgccctatgctgagaggggtgagggatgggaagagttggtgcaggacactctagaggaatttttgagacttgagtcatctcacaacttttcaggctccaatgccatagaacagagcttctagagtcttctagatccaactggtctacccatcttagaattaccctgacactcactgtggatctggaatgaacaaaactgcatgaattggaggtcaggagattgagaccatcctggctaacatggtgaaaccccatctctactaaacaaaatacaaaaaattagcccggcgtggtggcaggcgcctgtagtcccagctagtctggaggctgaggcaggagaacggtgtgaacccggaaggcggaggttgcagtgagcctagatcgtgccattgcactccagcctgggcaacagagcaagactccgtctcaaaaaaaaaaaaaaaaaaagggaggagccaagatggccgaataggaacagctctggtctacagctcccagcgtgagcgacacagaagacgggtgatttctgcatttccatctgaggtacagggttcatctcactagggagtgccagacagtgggcgcaggccagtgggtgcgcgcaccgtgcacgagccgaagcagggcaaggcattgcctcacctgggaagcgcaaggggtcagggagttccctttccgagtcaaagaaaggggtgacggacgcacctggaaaatcgggtcactcccacccgaatattgcgcttttcagaccggcttaaaaaacggcgcaccacgagattatatcccgcacctggctcagagggtcctacgcccacggagtctcgctgattgctagcacagcagtctgagatcaaactgcaaggcggcagcgaggctgggggaggggcgcccgccattgcccaggcttgcttaggtaaacaaagcagccagaaagcttgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcatgcagctggagatctgagaacgggcagactgcctcctcaagtgggtccctgacccctgacccccaagcagcctaactgggaggcacccccccaacaggggcatactgacacctcacacagcagggtattccaacagacctgcagctgagggtcctgtctgttagaaggaaaaataacaaacagaaaggacatccacaccgaatacccatctgtacatcaccatcatcaaagacgaaaagtagataaaaccacaaagatggggaaaaaacagaacagaaaaactggaaactctaaaacgcagagcgcctctcctcctccaaaggaacgcagttcctcaccagcaacggaacaaagctggatggagaatgattttgccgagctgacagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactatgtgaagaatgcagaagcctcaggagccgatgcgatcgactggaagaaagggtatcagcaatggaagatgaaatgaatgaaatgaagtgagaagggaagtttagagaaaaaagaataaaaagaaatgagcaaagcctccaagaaatatgggactatgtgaaaagaccaaatttacgtccgattggtgtacctgaaagtgatggggagaatggaaccaagttggaaaacactctgcaggatattatccaggagaacttccccaacctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcagatctctcggcagaaaccctacaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcctgccctaaaagagctcctgaaggaagcgctaaacatggaaaggaacaaccggtaccagccgctgcaaaatcatgccaaaatgtaaagacaatcgagactaggaagaaactgcatcaactaacgagcaaaataaccagctaacatcataatgacaggatcaaattcacacataacaatattaactttaaatgtaaatggactaaattctccaattaaaagacacagactggcaagttggataaagagtcaagacccatcagtgtgctgtattcaggaaacccatctcacgtgcagagacatacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatatatgcacccaatacaggagcacccagattcataaagcaagtcctgagtgacctacaaagagacttagactcccacacattaataatgggagactttaacacctcactgtcaacattagacagatcaacgagacagaaagtcaacaaggatacccaggaattgaactcagctctgcaccaagcagatctaattgacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactacaactcaggattaagaatctcactcaaagccgctcaactacatggaaactgaacaacctgctcctgaatgacaactgggtacataacgaaatgaaggcagaaataaagatgttctttgaaaccaacgagaacaaagacacaacataccagaatctctgggacacattcaaagcagtgtgtagagggaaatttagagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaagaattaatgaatccaggagctggttttttgaaaggatcaacaaaattgatagaccactagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagattaaaccaggaagaagttgaatctctgaatagaccaataacaggagctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagggacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatatgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacagacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacaacatgattgtttatctagaaaaccccatcgtctcagcccaaaatctccttaagctgataagcaacttcagcaaactctcaggatacaaaatcaatgtacaaaaatcacaagcattcttatagaccaacaacagacaaacagagagccaaatcatgagtgaactcccattcacaattgcttcaaagagaataaaatacctaggaatccaacttacaagggatgtgaaggacctcttcaaggagaactacaagccactgctcaaggaaataaaagaggatacaaacaaatggaagaacattccatgctcatgggtaggaagaatcaatatcgtgaaaatggccatactgcccaaggtaatttacagattcaatgccgtccccatcaagctaccaatgactttcttcacagaattggaaaaaactactttaaagttcatatggaaccaaaaaagagcccgcatcgccaagtcaatcctaagccaaaagaacaaagctggaggcatcacactacctgccttcaaactatactacaaggctacagtaaccaaaacagcatggtactggtaccaaaacagagatatagatcaatggaacagaacagagccctcagaaataacgccacatacctacaactatctgatctttgacaaacctgagaaaaacaagcaatggggaaaggattccctatttaataaatggtgctgggaaaactggatagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaataggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagtgatctagaactagaaataccatttgacccagccatcccattactgggtatatacccaaaggactataaatcatgctgctataaagacacatgcacacatatgtttattgcggcattattcacaatagcaaagacttggaaccaacccaaatgtccaacaatgatagactggattaagaaaatgtggcacatatacaccatggaatactatgcagccatacaaaatgatgagttcatgtcctttgtagggacatggatgaaattggaaaccatcattctcagtaaactatcgcgagaacaaaaaatcaaacaccgcatattctcactcataggtgggaattgaacaatgagatcacatggacacaggaaggggaatatcacactttggggactgtggtggggtggggggagggggtagggatagcattgggagatatacctaatgctagatgacgagttagtgggtgcagcgcaccagcatggcacatgtatacatatgtaactaacctgcacattgtgcacatgtaccctaaaacttaaagtataataaaaaaaaaaaaaaaaaactgcatgaattgctcattctggcccagagtgggtggattgaatactctgttagacattaattcctttgggaaaggctgggataggtttcctttggaaaggattgggaaagaaaagaaaaacagaaaaaattattagggccacagaaaagtagaacagagaagtgctccatgatacctgacacgtgcttaacacattttttaaataaattatatgaatgattgaattcttggaactgagtaaaagaatagaaagtacaataaaataaaaacagaaaaaatgaaaagaaatagtcttacgatgatgaaaacaagtaggagttgattagaggggaaaaagtcaatagccaaatttaagagattagaggaacaaacaactctcagacagacttcctcctgtggttacctgaagctccagactcatgtaccagtcccaagtacacaagaaagagatccttcacaagtccctggattttctcagatttaaccaacgagacactctgtggctgtccctgaactaatcatggtggcccagggtaggctggctgggggatgaatgatatcaattggccaggtctggatcacaagtcctgccctaacaacagcttattagagaaatttggcgtgcttataggctaggctgaggcacttgctccattagtggggctgggggatggaaccccatccgaagcacagagaatgagagtgggacaggtgtgctctcccactctgggcacactcctcactcctcaaagagtggagtgtgtgtgccgagttgccaaaacttaaaaatgtcttctacatcaactttttctattttttttttcttgagtaactcttcattgttcgagagtatactgaagcattacttccttaaggaaacttcccctgacttatctttgactccagattagatgccccagaacataatgtgtgttctcataactctcccttccagaataggggctccttcaaggcaggggctttgtcttttttcctccatatccctggtactgatggcagggcttggtataattaatatttgttggataactgagagagaataaatgcacggacacttgcaggagtgtgtctcagagtaagatgtggcctcttacccccaaaagggacacagctacattgggatggctgcacccaggagtggtggagcttttgctcaagcagaagccagtatttatggagctggagctaggatgggagctccaagccaagcaaatagaccgagaatggggaagggggcttcacctctccaggagaagattgtcaggcacctcccaagtggtgctattgtttcaggcttccagacaccagggactgagtctgccctacgtctaggtccccaggaaggcatctggtcatctcaagtcttagaattctgtttttctcatgtccaccccttttcttctattgcaccacccacttctggtctcataacagtgtctctgcccctcaactttgctctgccttttcctcaactcctttaaaacttgcacaccactgccatagaagggtccttgaacacatgattattatgtcacccattttgtgaaaaacctcagtgagtctcagtgcttccaagataaattttaaattctccaacccggaattaaacttgtcagtctatctccggaacttacctgcatccttatctctcactcctcacttcctagacctgtgcaccagcctataacctgcacttcccattccatctgcactgcttcctcctcactgtacatcagttgtcccacttagtgtcctcacttttcccttttgttatccaatcctacttctccttaattcttgcaattgtctgacctcttgtaaccacagcaatcttttcattctccaaacctttttttttttttttttgagacaggatcttgctctgtcatccaggctagagtgcagtggtgcgatcttggctcaccagagccttaacttcccaggctcaagtgatcctcccaccttagcctcccaaagtgggattacaggcatgagccactatgcctggctattttttttaagacggaatcttgatctgtcacccaggctggcatgatcatggctcactgcagccttgatttcccaggcttgagtgatcctcctgcctcagcatatcaggtagctaggactacaggcggcccaccaccatgctcggcttttttgtttgtttgtttgcagaaacagggtctcactatgttgcccaggctggtctcaaactcctaggctcaagagatctgcctgccttggcctcccattgctgggattacaggtgtggaccactatgcctggcctccctgaactattacgttcctagaaatgttgagcctgtatctgttgtatcaatcattcacttgacacttaattatctaagcccattatttgattacaaacttttgtacaccatctagtcacaggctgagaatgcagtaaatgtgcaatgagtgttagttaaatgaaaaagcaaaggggaacatgttgagtggaaaggggcaaatttgtagtgtggctttagagttctttggatttgttttagtttgattgtgaatactgcttgtgccctttggcttgccacttcattgctgaatctcatttccacattagtaaattgaggataatcttccgagccctacagaggttgcagcttatagtgaacaccaaatgagaggtcatacatgcaatactttataaactcctagtggtaagctattaggtcttctcttttcatttcaattaaaaatgtttttcttcttacttttagacttgcaaccttatttctcgaaagagggcccaacaggataggcagtatttacaaaaaggctgtttacagacgcttcacggatggaacctactccatagagatccccaaacctccctggcttggattcctgggccccatcttgagggccgaagtgggtgatgtgattgtcattcatttaaagaactttgcttctcgaccttactctctgcatccacatggcgttttctacaacaaagattcagaaggtaaatatcaatcctttattactggggtcttgtctctatttcataagtaaggtaactgtcagagttaaagagattttaggagcacattgattacatggatatatttatcttctctctgtctgcttctccatccatctccatctatctattctgtctctctcttccctttcttgctttttttttttttttttttttgagaggtagtctcactctgttgcccaggctggaatgcagtggcatgatatcagctcactgcaacctccgtctccctggttcaggatattctcctgcctcagcctctctagtgctgggattacagatgtgcaccatcacgcccagctaattttttgtatttttagtagagaaaatatggtttcaccacgttggccaagctggtctcaacctcctgacctcaaatgatccgcccgcctcagcctctcaaagtgctgggattacaggcgtgagccaccatgcccggctccccttcatgctttttctttcccttatttcctacctctcctctttcttgctcttctttatgttgacacagaactcctcagtacctgctccaccacgcaccaggaacacactagctttcttccttgtcacttagttgtgcctgatttgcacactagataaagggcaacatgctcctatctccggtagcagccttggctgtgggtacatttttatcaacagaagctgatccccactccttgcttcaggcggctgtttttggtgctgcctttgtgaagcagccctgtcttccttcttgtgtgtatgttaggagtttcattagggcagtttctggattcctccctaattgaaaaatattaaacaactttcttagacttttgagacagaagtatttctccaacatcaaaaatattttttttgaatcctgtatttcattcttgctcatgacctggtggaataggttgaaaggtgctgtacctgctaggtgactgcttctaggaaatgtgccagcacagtgccattaactctgatgcaactcacattatcatcaaggaggagtttctgggcattaacaaatatcccaaggcagcctaacttgtgaggcagctgctccagccatgtctctataagcagcgagaggagagaactctgatggtgaacacacaactgggattgccctttgttctgggctcttttcctccacctggagtgcagccaagatttggtagttcttagttgttgaggatgagcacaaaaattgtgccaggtaaactttaaggtgtaactatgaatgcattttctttaatatagtttttttaacttttattttaagttcagggatataagtgcaggttcgttacataggtaaacttgtgtcatggggatttgttgtaaagattatttcatcacccaggaattaagcctagtccccattagttatttttcctgatcctctccctcctccaaccctccaccctctgctaggccccagtgtgtgttgttcccctctatgtttccatgtgttctcataatttagctcccacttataagtgagaatatgcgatatttggttttctcttcctgtgttagtttgctaaggataatggcctccagctttatccatgtccctgcaaaggacatcatctcattcttcttatggctgcatagtattccaaggtgtatatgcatgtcattttctttatccagtttatcactgatgggagttcaggttgactccatgtgtcttatttatgctgcacgtagcaagtaaagatgtaccaagatagttgtgcctgccttttcaaatatggagaaaataggggcatttttaagtgtaatttttgtcttcaatcctccatctgtttctggaaagcataccttaatagagttaatggtgtcctgaaaaatcatttaggccagtgattctaaagctttatagggctacaaattcttttttcaaaaaaattgtggtaaaacatatgaacataaaatttaccattttaaccattttcaagtgttcaattcggtggcattaattacatccacaaggttgtacaatcatcaccattatctatttccacaaccttttcatcatcccaaaccgaaactatatagccattaatcaatacctctccattcctcccttttgctgccccactggtaacttctattctattttctatgtctatgaatgtgccttttgtgtctggcttatttcacttagcataatattttcaatgcttatgtatattttagtatgcatcataatgtaattccttttaaggctgaatactattcaattgcatgtatataccacactttgtttatccgttcatctgttgatgaatgctttggttgtttccacatcttggctattgtgaataatactgctataaacattggtgcaccacagatctttctgagcatctgtgagagccatgagcccttgcaccagaaaaatatgtatgtgcataatttttttttgagatggggtctcgctctgtcactcaggctggagtgcagtagtacagtcatggttcattgcagccttgaactcctgtgctcaagtgatcctcctgcctcaccctcccaagtagctgggaccacaggcatctgccactacacctggctaatttttaaaattttttcatagagataggatcttgctgtgttgtcctggctggcctcaaactcctggcctcaagcagtcctccttccttggcctctcaaagtgcagggataacagtaatgagccactgtgcccagcctgtggacaaaattttgaacccacttttaagaggttctcagagtccctgaaaacattcataggtccttaaattaagaacatttcaaatgttgtttacccaggaaaccttctctctatcctgtctgcaggactgtcccatttcagaagtgtgttggtttatctcataacacttaatactggctggacatggtggctcatgcctataatcccagcactttgggaggccgaggtgggtggatcacctgaggtcgggcatttgagaccagcctggccaacaggcgaaaccccatctctactaaaaatacaaaaaattagccaggagttgtggcacatgcctataaccccagctacttgggaggctgaggcaggatagtcgcttgaacctgggaggtggaggctgcagtgagccgagatcatgccattgcactccagcctgggcaacagagcaagactccatctcaaaagaaacaaaaaaaaacaaaacaaaaacaaaaacaaaccacacttaatactggtatagtagacatacaaatggccaacaggtatattaaaaaaatgctcaacatcactaatcattggggaaatgcaaatcagaactacaatgagatctcatcttaccccagctaaaatggctattatcaaaaagacaaaaagtaccccctccaaacccaaaaaacaaaaacaaccagatactggcaaagacacaaagaaaagagaatacttatacactcttggtggcaatgtaaattagtacagccactacggaaaacagtatggagattcttcaaaaaatgaaaactagaactcccatatgacccagcagtcccactactgggcatttatccaaaggaataaacctttcattgagcacccaccaggtgccagacactgactcccaggtgccagacattgactctgggtcctgagaataaaagatgaatgaatcataggatgtagtaaaaaaaaaaaaaaaatcaatgaccataagtataaggagttaatttcagtgctcttaattctgctccattgatctatatacttatccttggaccaatgccacagtgtcttgattactgtgaaattctagtaagttttgaaatggagtcacataaatccttcaactttgttattcttttcaaggctttttggctatttaggttctttccctccatatatatatttgatcagcttattaatttttaccaaaaaacatcagctaggattttgatagcagtcgctttgcgttaatttggttgataaattgtaggaaaattccatgtgcatttaaaaacaaatggccatcttaccaacattgagtctttcaatccatgaacatggaatttaggtctttaatttctctcagtaatgttttagtttttagtatacaagatttgcatttcttttgttaaatttattccaaagtattttattttttctgttgatgttatgaatggaatagttttcttaatttcatttttggattgtttggtgctagtgcatagaaagaattaatttttgtatgttgaagttatattctacttccttgctaaacttgtttgttagtagatgtttagtggatttcttggaattttctacatacggacttaagccattgtgaatgaagagagttttaattcttccttaccagtctgtatacctttacgttttttcttttgacttattacacagctataacctttaggaaaatatgtaatattagtagtgagaccagatattcttacctttttcccaatcttaggaagaaagcattttgtcttcctccgttaggcatgaggctagctgtacatttttttctagatggctttttatcagattgagaaagtttctttcttttttttaattttgaatttttgtgggaacatagtagatgtatatgtttatgggttgcatgagatattttgatacaagcatgcaatgcataataataacatcatagtacatggagtatccatcacctcaagcatttatcctttgtgtttcagacaatccaattatactcttttcgttattctaaaatgcacaattaaattatttttgactattgtcaccctgttgtgctagcaaataataggtcttattaattctttctaactatttttttgtatccattaatcatccccacttcctcccacctttccactacccttcctggcttctggtatccatccttctattctgtatgagttcaattgttttaatttttagttcccacaaacaagtgagaacatgtgaagtttgtctttctgtgcctggcttatttcacttaacataatgacctccggttcaatccacattgttgcaaattctttcttgtggctgaatagtactccattgtgtatatgtaccacatctttatccatttggctgcttattgacacagtttgcttccaaaccttggctactgtgaatagtgctgcaataaacatgggagtacagatatctgatttcctttttggggggtacattaaaatggggtatgtacccataccagtgggatttctggatcacatgatagctctgtttttagttttctgtggaaatttcaaactgctctccctagtggttgtactaatttacattcccaccaacaatgtacaagggttccattttctccacatcctcactagcattttttattgcctgtctgttgaataaaagtcattttaactgggttgggagaatatcatgttgtagttttgatttatatttctctgatgaccaataatgttaagcaccttttcatacacctgtttaccatttgtatgtcttcttttgagaaatagctattcaggtcttttgcccattttttaatctggtaattagattttttcctatagtgttccttatatattctggttattaatcccagataggtagtttgcaaatattttctcccattctatggattgtctcttcactttgttgattgtttcctttgctgtgtagaagtgttttaacttaatgtgatcccatttgtccacttgtgccttggttgcctggcttgtggggtattactcaagaaatctttgcccagactaatgtcctggagagtttgcccagtattttcttgtagcagttttatagtttaaggtcttaaagtttttaatccattttgatttgatttgatttttgtctatggtgagagataggagtctagttttattcttctgcatatgggtatccagttttcccagtaccatttattgaagagactgtcttttccccagtgtgtgttcttggcacctttgtcaaaagttagttcactgtagatgtatggatttatttccaggttctctattctgttccatttgtctgtgtgtctgtttttatgccagtaccatgccatttgggttactatagctctgtagtataatttgaagtcaggtaatgtgattcctccagttttgtcctttttacttaggatggctttggctattctggtttttttgtggttccatataattttaggaatgttttttcaatctctgtgaagactgtcattggtattttgatagggattgctttgggcagtatgaacattttaacaatattgattcttccaatccatgaacatgaaatgtttttccatttttttgtcctcttcaatttctttcatcagtgttttatagttttcattataaagatccttcatttccttagttacgttaacttctaggtatttaattttatttgtagctactgtaaatgggattactttcttgatttctttttcagattattcactgttggcatatcgaaatgctactgattttgtatgttgattttgtatcctgcaactttactaaatttgtaagttataatagtttttggtggagccgttaggtttttccaaatgtaagattatatcatctgcaaataaggataatctgactttttcctttccagtttggatgtccttatttcttcctcttgtctgattgttttagctgggactggaggaaattcctttgtattcctagtttgttgagagtttttcactaagtaagtactggatttttttcaatacttttctgtatccattgagatggtcatgtggcttttctatatctattgagatatattgatatatattgcattaactaatttttggatgttaagccaacctggcaatcatgggataaatcccatttggccatggcatagaatcctttttatatgctgatggatgcaatttgctaatattttgttaagaatttttgtgtctaagtcatgaaggatattggtctgtagttttcttgtgatgtttgtatctgattttgttgtcaaggtaatacttgcctcatagaaggaattggaaagtctccactcttctgttttctgaaagattttgtaaaggattggcatggattttttttttagtatttgttagaatttttatataaaaccactggacctgaatttactttcagggaggatctttagttactaattcaatttcttgttataggtatattccaattttttatttttatattttagtcagttttggtaacttgtgtcttcctagaaattcgtgtgtttcatctcagttgtctattattttggcagaaagttgcctataatatttccttataatccttttaatttctgtatggtcagtgatgttgcctctttcattcctgactttggcaattagtgttctctttctctcttggccagtctaaatgaagttgtctcaattttgttgatcttttctaagtaccaacttttggtttcatctattttgtattttttttctgttttctctttcactgatttctgttccaatctttatttcttctttctacttgctttgggtttgtttttctcttccttttctagtttcttaagatgaaagcttaggttattgatttgagagttttttttaacttctgagatagatgacttaaaatctaaatttcctttttaagcatggctttacctgtatctcataaattttgatatttttgtcttcattttaattcagttcaaaatattttacaatttcccttgtgatttcttctttgacctgtgggttacttagaagtgtatcattttatttccaaatatttagatgatttcaaagatttctttctgtagatatttaatttaattccattgtgattgaaaaatatgctttgtatgatagtaatccttttcaatgtattgaaacttattttatgcctagtatgtgctccattctggagaatcatccatgtgctctgtaaagagggtatattctacagttattgggtgcaatgttccagagacatcatttaggtataattggttcatagtattgttcaagtctcctatatccttgctgattttctgtttaggtgttctatcagttattgagagttgagtattgaaatcttcaacaattattgttgagttgtctatttgttctttttttggggaaggtctgagtgtcatttattaacaacagtttatacagatctattttcaaagcacaggcacagagccctggagaagagcagtctctgaacaaggaagccaggaacacaggatgtacacatctttggcaggcatgtttagccccagaaggattcaatacttcaagttggaattccattggatatttgagagggaccaaaattgagggtagaaagaagtcttcaacaggactcagatctcagtctagggctcctcttgcactatctaagtccatccgggtattaggaccctggggggcaacaatcaggcctacccatttcaacagaagcagattcttcaatctacactcagttagttcacacttgtttccactggtcacacagttaaagagaatcagccttatagtaagagacagaccactttctctctgaccctctccagcacctctcttcagcttcatctgtgcaggaactgctgggaaaattgaggcctaccttttcaattcagctgcatgtgcttttaccctcaaatcttcaatcaacgataggatggaggctacatgtgtactcaggctgacaactgttcttcccagtccatcacacacattgccctaccttagttctgccaattgcagtacctaggctggagctacagtagacctcaaattgggacctaaagccagtctgcataggcacttgggaatttttcgtaggggagtagataaaaaagtctttgaatatgcgaagaaagaaagagcttcatttgataattagacatctgaagtgattttacttttattttcttcactttaagccaatcatgaaatttcacagtgatttctcaggtaggagcagaaggaagacactgttactcattggggctgtggcccagttggcttgaggaagtacaggcagggtgggtccttactggggcagctggaggggcacagactgctctgccggaaggtaggtgatgatatgagagcataagaactggtatgtaatatcatctgcagcttccagcttgtgtagctcaatctggccatcacctgtggtggccagtgaattggcactcagctcagctgccttggagactcccttggcagagatgatggccacctttttctgctgctcagattttccaccatgaatctggccctctctgattcctgttgagccacctgtttcactcccaccacttctgtgaactccttcccaaaggtcagatgtgtcaaggacacatcatccaagatgagctcaaaggtggctacttagtctgcaaggtcgttgctaacctgcctggagaccagctctctctgggtgatcagttctccatcatcaaagtaagccatcagtaacatgaggatcttttcacatcatccaggatgagctcaaaggtggctgcttgctccgtaaggtcgttgttaaccggcttggagaccagctctctctgggtgatcagttctccagtatcaaagtaagcaatcggtaacatgaggatctcttagtgatgtacagcagcacacgctcatcatagtcctttccaatgctggtgaagatgtgaggaagctggctagtgacaggctggaagacaatgcactctgtgatcttgacattctgtaaatcttcactaccagtgatgactggtgtgttatgtgatcaagagtagcagtcaacgataattggtttctgtacccataggatgagaaaatgagttcctttccatactgcaatgtcctgtactccatggaatctgccaaagatttagctctgtgctcagcatccacataatataaggcagagcctaccgtgcctcctgtaacagctaaggccaggccaaacttgccagtggactctaacactttggcagccatgtttccttctgctggaccctttcgcagccagcttccattctctgttctttaaattaagtcagtttttccttcctgtattttgatgcatttttgttagatatgaatacatttataatgttatattttcctgatatattgacccttttatcgcgacaaaatatctttgtctctaatagcatttcttgtcttaaaatctattttgtctgttattgatatagcctcttacttttgctatttgaattattttactttcaacttatttgtgtctttcaatgtaagacacaatacaaacagcatataatagaattttgctttttttcccccagtttgacaatctctacattttgattgtggtgttagaccattcacagttaatgtaattatttattagtttgatttatatttgtcattttgctaattattttctatatgtcttctgtattttttgttcctctggtcctcttttactgccttcttttgtgttaaacaaatatttcttagaataatgttttaatttctgtttattttttagcctatatatcattgagttattttcttattggtttgcctcgggattgtaatatgcaccctagtttattacatttaccaactaaattctggtaaaatgtagaagctttgctccataaagctccattctctccccctcctttgtgctattattgattatctatctatctatctatctatctatctatctatctatctatctatctataatgcccttctctaaataaacccagcaatacgttgttatatacttggtgctttatattactttatgacttttaaaaaataaaataaaggaaaatatatttatagaaccttttatattaagtcatatatttcccatttctggtgcttttcatttcttcctgtgaattcaagttactctttggtgtcatttccatttattatgaagtttgattgtcctttagtattccttgtaaggcagttctgctagtaacaaactcactcagtctttatttatctagaacatcttgcctttagttttgagggatcgttttgctggatatagcattcttggctaatatttcctccctggcactttaggtatatcatctcattgtcttctgggttcgaatgttcagataagaagtcaaccattaatcatattgatgctcccttgtacgtgataggtcatttttgtctatctgatttcaatattatctttttgtcttcctttcctctttccacagtttagcaatgatgtatctatttgtggacctctttgtatttatcaaattttggctcattaggcttctttgatgtgtaggttaatgtttttcatcaaatttgggaaatttttggccattatttcttcaaatatttatcccacactttctttttgttgttctcccctctttctgcagacaactgttatacacatgttagtaaatacattgtcccactggtctctgaggttctgtccattttcttctatttcccccacctctctttttcagataggataatttctattgatctagctttaagttcactgatactttcttttgctttcttgaatatattgttgagctcctctagtattttatttaatttattgtacttttcaatgccaaaattccaattggattctttttaatatttctatttgcttattaagattctctatttgttgagttgtttttcccacttttcttcagccctttacacataattccttttagttgtttgaacatatttattatagctgctttgaagtctttctctgctaaattcaacctataaggacatatagagagatagtttccactggctgcctttttttctctattaatcacacttgcctgtttctttgtgtttctcatatttttgttgttcttgaaaactggatatttttaagaatataatgtagcatatctggattctcattccttcatcaactctaggttattttttttgcttgcttctttgtttagtaacctgtgggctaaatctgtggattatctttcctatagtgtgtggccactgagatgtctgctttttttattatttatttttatttttaagcctggcttctgagaggtcattcctatgtctgcttagctcagtggtcagcaaatgatttgaagaagttgtgcctaagcatcttgagccaataaatcttatattctctgctagtggatctgtgagtggttagaaaaccagtgctgtagaatcctactcctcttagctgatgttcagcagtttcaagcataaacattgctatatgtttttattcaatttctagataccaaaatggtttgttattttttttaaatcaattttgtctaactttatagttgcttttttgggaagagaatttgctgacttctttgctctcctttaataaggttttgtctttgctacagctgtaagcttaaaagtcttgaagtctctgcttaattcaacttagtgtttgctgtgagccagacacaatactgggttgcaaagaagagtaaatatacagttgttgcttccaaaatatcatccaggggaggggtagagaatggaacttagaagtgggttgagcgggtggggctaacattaattgagcagctattttatgctaatgcctgagccagacctcttatatacattccttcatttaatgatagaatgaactagtgctttcttgacctacatctgaaatatgcttaagtattaggactatttaaaaataaattttattgttttttaaattttatttttattttatttgttttatttctatagagatggggtctcgctatgttgcctagactagactcaaactcctggcctctagcaatcctcacatcttggcatctcaaagtgctcatattacaagtgtgagtcactgcctcacctggcctggtttttgctttaatataaaaaagtataaagaagaggaaaattgcacacaatctgattctttacatattcactaaattagttcaaaatagaaaattaaagtgccaaatgaacatggttagaagttcttaagagtaaagaggtataagaagaaaagttaaagccctgctcacttgtctttcactccaaaggcaataatcttaaacaatttctatgaatttttcacagacttttttctatacatatattagcatgtatgtatgtgtatatccttgctcatttgtataaaagggattatgctataatgctttctgtttttcactttttactttgtcttggagattttctcatattagtacatatagtgagacttgcatttaacaattgtgcaatatcccaccatatgaacatatcagttcagtgctgataattatttaggttgcttccagttcatgtaatttgaaaaatagtttcaagtatgtttgtacaatacattattacaaataaaattgctggttgtatatactttctttgaataggaattggcaagctgtcttctgaaaaactgcaaattttactctctgccatttgtttatgaatgagcttaattctcccatgaccccatcaatcctcaaaattctcaaatctgatgggtaaaaaaattgtgtaagttttaaaagctcacacagcctagaacatatataagcaaataaatagtgttttatactttcatattgttaatgacaccattgatcaaaagccttaataaattcttttgaaaatgactttcagaacaacttaataaattacctatctccaagtcacgtcttcctttatatttatactttatttttgattcccagtgatattcttcaacttgagtggtggcacaaaggctctgttaggggattctctctcctcatttcagtaatagccttcaataactcctaataataataaaaacaaggcccattaagtaaattgtgaacataagaatttctagaacaattgttatttgtagtgatttgtatcatataatcaattcaaaataagtgatctcaatcgaaacttcgagacaagtccactgcttacccactctcactcaactcctgaacctctgtatataaatctctccatatagaaaagaatcttccaagccatgcattttattcagagggctttggacaaaggcagtgtaaggtaataccactcagtcatattttattatatatatatatatatatatatatatatatatatatatatatatatatatatatatacacgcactggggtagatcttgaagatacgatcatgagcaaaaagaagcctggtatttgctttaatgcagcttacagtctaacatgagaaagagacattagtgaagcaatcatacatacacacatatgcacacatgatatatatatgtgtgtgtatatgtatacacatatacatactatatatgtgtgtaaatatatatatggtgtgtgtgtatatatacacttacatatacacacatataattaaaaacttaggcacatgttataaatgaataagatagtttactgaaaggctactatataccaggcactgtgataagtgctttatagatatcatatcctacaagtctcaacaactcttaagaggtaggcatttatgattatcaccacctaacagataagaagctaagagtcatagaagagaaggaaattgcccaagctgcatacctaacaagtgatggaggtaagattcctttccaggcagtctaatttcagtggctgtgagcttaaccagtggctctactgcccttctctcagtgtgaatgcattttagataactgacccagtccagggagttcaggattgcctgagccagaccatgctggaccttctaatctatattaaacacatttgaccttcatcccaacactgatgggaagcaatgaaatgattttaaacagggaacaatagaattatatttaagatttgaaaagatcactcttgtggtagcttggaaaatggattagaaaggctagaggaagggaagccaactaggaggttactacaaagtccaggtgagagatgatggtagttcagactagggatgtgatgttggagatcaacataaataaatggatgcatttgagaagaagcggagataggaccctgtggtattttggaaatggaaagagaggaaaaggaagaaaaatgcttcctttgtttctggcttgtggctgaatattggtagtgccttttactgggagtagtggcagtggctgaggaccaagcttggtagaggagagctaatgatccctggaaaaggttgcatttgcaatcttcttgagatttacaagtagggatgtcaagcagacagttgaatatcagtgtaaagtgcagaggtaaggtcctggctggagataaacatgggggtcactggtgtgtggctgatgggtggcactgtggggatgagtgctatcagctgaggagaaagcacaaggcatggaaggaagaagccagcgttatactttgaggatttctgacaaaaaaatggcagatacaagagaatgaactggaaaagtggactgaaaaagagtggtcaaagagtatgatgtgatgtcctatgagtcaaggagggagggagctgacaatagtatcaaatgctgctgagataacatagtttttttaaatgtcatttggatttaatggatgaggggcagctctctggattttttcctatgtcctgttcctctatcacgttagataagtatcaagtgagaaagcggcaaatacattaatttaactttgagtacaaatgattctgtcaaaatactattgagtattatattctcacctcgtattgagagaaaatgtaagaaattgttttaaaaagaatgtttttgcatcttttggaaagcattcttgaaaacattgaagacataattcattacattactgaataatttatatataataattttcttgaaaatactctctcagaatctagtactagcaaaaagttcctttctcttaatgaactagtaagtttccctttactggacaatgaaagagtataagctaattatattgacctaatatatattaactctatatctaacaatataacctaaatataatcaggaaattcagagctacagttaatatgaatgggctgtaactaattatgtagcatataggtttatttgtaaagtggctcatattctttttagaataaaagtaattaaaagtatgtaaaggaaagttaagtgaataaataagtagaaaatagtttgtacattatattgccagtaactttgatgggaagtcaggtataaatagattcaaatttgactcaagaacatgctaggagtgttaccttaacttaataaaaaatgaatattaatacttttcatatgggattgctttgaaaagtaactgtgataatgtatacaaagtatccactatagttggcacataataagggcttaactgttgttgctttctcatgacatctttctccaaacatcaaaccacgctttcatggtagaatttgttaaatggtaacattagattttttagttttatctttgctttggtttgtcttggccacactggctcttgctgtgttatttgaatttgtattcctaatgcctagcacattggtagcatgtgttcaatattgaattcacattcttgaatgactgtgtaaatgaatgaatggcaaatggatgtggaatgtgtgcacttccatctccttctctgtcccttaccatccagctttttttttttttcagtaccagtctagctcctcccgtcctttaaggccccttaaatctcacctctgttgtagagcttctgataactataatgtgcacagactggtctctgtccttttagccaggtggtttttatcctatttttagcagtcggctttccttaattgaaaaatcatgtgccatcttggtttatgaaacagagagtaaggggctgttctgcccctgcccactctgtggtggaccctctaccttgtatagcacaggcatcctctggggtatgccatatattttgacccaaaatgacattcaacacattcactttgctttattctccagttgtcccatgtgtttaatacgtattctagtctgcccaacagaactatatgatccccagaggcaggaagaatgtcttacacttccttcctatctctcatgagacctacacaggtggtgaatctgaaataagtccccaagaagtgtttattcattatttcttcttaggcttctccttcccttcttgagtcgatgtcaactgaggggaattgaaatcttcctggttgatatggtagcctcatcagaaagagtccttattatgaacatttattaagttcctagttctgttcaaaacactctgtatacattgcctcatttagttcttatatccctgtaggatagatatcaacatttcagttttactgatagagaacagagacattgagaatttaagtaacttgcctcaagtcccatagcaaataaattttaattcagttatgtttgattccaaagctctggccctctctactatagcatgtgatctctctgttttaactatgttttacctttttttttaattttattttttggaaggagccctatacccagatggaacatctggaaggaacaaaaatgatgacatggttcctcctgggaaaaactacacctacgtctggccggtgagagaagaatatgcacctactccagccgatgccaactgcctgacctgggtgtaccattcgcacatcgacgccccaaaggacatctgctctgggctaattgggcccctgctggtctgcaaggaaggtaaggagctttgtttccaggtaactagggagttgaaatgtgaataagattcaggtcttattttgcctacctcctttgctccacacagaatgtgcctcttccaaatttctttagaaattctgacatggaagatcaatctgacaccatagcagagggcaataattcagatttttgtctaagaatcatcacagcattctgagactttattgttattttaaaaaatgatatttcataacacaatgtatagaaaagtgagaaatttagtcaaatgaccagtaatgccttctgcttcattatttcacccaaataatcatttgctattttatcccttattagttgacttagcatgtctgtagtttgtcaataaaatggactccctttagagacagccagtcttccaagtatgtgattatgaagatttctgttttatgacttttctcttctatggctctgtcatctccattaaagccttttgctgattttatatggtgggttatccttgtaggtataggtcttcaccaaacttcacacttgcctgacactattggaaggaagcaaagctcatcttgatttagttctttctctctactcttttgaatgtgcctgacaggtatcctgaatagatattcagggacacggaatgatgtggatcgagagtttgttataatgtttactcttgtggatgagaatcaaagctggtacctcaatgaaaatatcaaacatttctgcaccaaccctgattcagttgacaagaaagatgctgttttccagaggagtaacaaaatgcatggtgagtacctcccatgttcccaaacgtataccaggccttttatactataaggtactacaagggataaaaaatacacagaaatgttgatctgagtttggcatgatttataactcagggatgaccatggttagaaagtgatacaatacatgacacatgtttgaacctgaaacaatctgagggggacagagcagtggatgcatgctaaattgggcatgcagtgtggacaaagccacagggctttgggaaaatggagggatcgatgttatattgtaattggaaaagaatcggtgcctgaggtgagcccagagcatgggtgggcttagactgactggaaggagaaaggagaatgaaatcatcgttctataataatcctgtgttttgcaacattttgcttcatccagtaaccattttctgagccgctgataaattttaagaactgagttatgcatggggtttaaataagcacttgtgaattcattatatttcccaggcattctttacatcaacaaaatttactgagcatgcactatacatcagactccatatttgttcaaaatagtgaacttctatagttacttcattagttgagatggggcacttactcatgcctgttttgcaaagcagtagcttaatgtagcattttaggattttcttagagagttctagtgaacataaaggaaatagtcaacctacatatcccaccttattcattgacatatcttctccttctattgcttctctgtctctcagaattgttctaaccaaggtatcctcaatatagtcataaaatcataagaggaatagaaggagctgaagatcatctaacgtctccattttacagaagagaaactgaggtcaagagactatcaatgacttgcctaaggtcaaagtgataattaatgccagagagtttcctgagagaagtcccatagcaaataaatgtaaatttggctgtgtttgattcctaggcacatcaaggcatgattgtcagtacattgattatttccattgtattgcatgccttcttttttccttctagtggtattttggcaaccttatgtgtagtgattcttggaaaatattttaggaggaaaggaagtaagggagagaaggaaaggggaaggcagggaggcagagaaaacaatgaaggatggagtcaatgaagacataaattcaaatcattgctgtgaccagttgtaatgcatatcctttacaaaatgggagtgatgatctcaaatattgcagaaaactactaattgtgattacttaagactcacctgcccaaataattcctcttactctgtatttattcttttgaagtgaaaatgtccaacaaaatgaaatgaattacataagcaaacatagattacatgtatcataaaaagaagcctgtccaggcacaatggctcatgcctataatcccagcactttgagaagcaggtgtgggaggattgcttgaggccagaagttcaaaaccagcctgggcaacataggtagatccgttatctacaaaaaattcaaacaaacaacaaaaaaaatcagctgggcatagtggcacatgcctgtggtcccacctacttgtgatgctgaggtcagaggattgcattagcccgggagtttgaggctgcagtgaactaagtgccactgcaccccagcctgggtgacagagcaagaccctgtctcaaaaaacaaaaacaaaaaaccctagcctgtatgctgaagtagatgtgtgtttgcaaacaatccttcaagactggaaaagggtggggtattgtggcacacgcctgtaatcccagcactttgggaggccaaggtgggaggatcacttgaggccaggagttcaagaccagcctggccaacatggcaaaacctgtctctactaaaaatacaaaaattagctggtcatggtggtgggcacctgtaatctcagctactggggaggctgaggcacaagaatcttttgaacccaggagacagaggttgcagtgagctgagattgtgccactgcacttcagcctgggtgtgacagagcgagactccatctcaaaagaaaaaaaagagagagagactggaaaaagagacctaatcaagtaaaggaaaaaatttaattaaaaaaatctagactatggaagataattaatatgtacaagttttattgatcaatttatttaaatttactaaaataatttagaattaattgtgctgcctaagtcatcaggcatttcagcaacaattgcttttaactcagttcgaacttaagaagggatattgtgactttttaaagccctgaatcaagttcttttctgaacttggtcaactcccagctgccatttagatggttttaaagtattcggtcctggatttacgccataaacttaataagattctgctccagcaacatgtagtaaaaactgtttttctcttggctttttaaagtaaacaaacaaacaaacaaaacagttctcataaattccttttaatcaattccttttctttccatcttactacatgcttttgtcacttcattaagtagatactatgtgccagtttttctgctaggtcctgataactgttaagatgaacaagacagggtttctagttccaaggagcacagaatctggtgaagacagcagatatgccagtgaaggattatgacagaaggtgactgagcctcctgtaaatatgagcagcactctgttttctcctgacctcatattgcgttcccacagcagctccgaggctgttctcagtgtatgctgatcttcacttttattgagtgttttctctggaaaaaggccaataaaaacatttcatttctcttttggacaatatatatttctaagagccaggtttttctgcaccaaaaccttacaaccaatggtctgcactggttttccagccatgcttaagcccgtattaccaacatttctggtcccagtcgcctctgcaggggagtctcttccactagcgtgtttctgtttccagccctcaatggatacctcttcggaaacttcccggagcctgatatgtgtgttggagaatctgtgtcctggcacctatttggaatggggaatgaaatagacatccattctatctatttctatggtaacaccttcatcagcagagggcatcggactgatgtcgtcaacctgttcccagccaccttccttacaacagaaatgatagccgagaatcctgggaagtggatgataacctgccaggtcagcgaccacctacaaggtaaaaaggataaagaccagagttgatatgtttagaatggtacaatcaaaccacacagtcactagtgctcatccagtacctactgttagatagagccttgtatgtactatatttaattaggtaataaatatacaggaaaatataacgctcatctctttgatattctatcaacagatatttattgaccacttctgtatgaaaaaagtggggaagtgattaaaaattgatgagaccttcgaggaacctgtagtatagttgttagacatagttagacattcacaaaatgaatacgatttaaggcagaatgagataaatgctctttgggtgttgcagtcactactctggagcaatcagaggggcttcctgaggagctggctcctaacatgagccttgaaatatgagtaggaactgaatagatgaagaaggaaagaaagacttttgaggaagcagcatgaactgggaaaaacacatgttctttttgagcaactgtaagtagagtaataaggttttagcactggaaaggactttctggataataaggaccaatcccccctcgaattatttaatttcgttttgaacatctcttgtgagtagttatagcagctcatctcatctctggactgctctattggaatgttcttcctcaaattgagacaaaatccattgacctatagcttccttcatgtcctatgataggtgcatgataaacatttgttggcttaaatgcctgttgaatgacctggtcctggtttcttcagacatcatacactatgtcctttcttagctggaccataatgttccttacagagaagtgatgacagaagagcctgggaggctcatcaggccccttagcaaagctaaggaggtggggctgtgtgatccttagctcttttggcacactagtgacataatcggtgcagttatttaagaagataaatgtatgcatgcaagaaggacttgatggaggaattctgaccactggatgctagttaagaagcatttgacagtgttagaggtctaacacctaaacgtctgccctaagatgatgaaaccaagacagaaaaaatatgttaatggaatagacacagaagaaataatgtctgatatttggatactaacttcccatagtcactaataggtgcaaagatccagctgctcagggctgcttttgtaacacattcttgttcctgtccaccttccacagtgagtcatagcattagtcaactgcagtatcccaattacattcaactgaaaaattaatcagttaatatgtactagatgctcttctgggaaaacaaagattaacaagagaaggtttctattctcaaagagtcttatgctgttaaatctgggaagaaactgtagatttaaaatcaagatattagctgccatttgagactagtaagatcgctaaattagcccgatagttgtggacataagctagtatttatacgttccctgaaatacagtatttctaaattgtccatgccttcagaaaaaagttattgtaaaaaaattagaaaatacatataattggaggttttttaacaaatagagacagggtcttgctatgttgcccaggctggtctcaaactcctgggcccaagcaatcctcccaccttagcctttcaaagtgctgggattataggcatgagccactggatctggcccctataaattggttttaaaatcagtagttccataatagaaatattttatattcacattttggtgaatatcttccctattttctatttcttaatatgtaaatatatatgtattttaaaaaatgaaatcagtctattaatgctgcactgtagctaatttttctcatttacaaatatatcagaaacacattttcatgtcggtgaatatagagcttacttcatcatggttaatacttccagtgtccattataaggagattacatcttgcttaatcaatactctattgcttaatgcttatgtttcccaccaatttttttgctattataaacagcactgatgactattatttatagatgtttgcacttttgtctgaacattttcttagaaaaactcctagatttagaatttctgggtcaaagagtatgatttttttaaaaaagctatggacatacattgccacattctcttttggaaattgttattcttctacacgaagtgtatgagtatggctctttccccattcatctaccaacactgagaattattagtctttctaatctttactaatctgatcaatgaacaatagtatcatttgaaaactgttaaggtttgagtactatttgagtactgttaaggttgaacctctttttcatttgtttattggccaatattatttattttgtgaataaactatttctgttccttgctcattttctattggagatttacttgttttcatctttatctgtaaaagtgatttacgtattaatcttttgtcatatgtgtcacaaatatccctcctgttgccatttatcctttttaaaaaaactttctttatggtccaattttctgtacagaagcctaaatgttcaagagccaaatctatcagtcttttcctatatgattccttttgtgatcatttatgcctcagctcgtggttttcctctgttctgcagctggtatgctggggcaatacaatgttgataactgcaaaagtgatattttctaccccaagatgaagggtcaacagaggcgctactttatagcagctgaaaaaattctttgggattatgctcctcaaggctataacaaattcagtggtcttcctctaaacgcctctggcaggtaagcaccctttgttggtgtttctaagcctctcgtcagagaagcatgtgttaggctttctctgtgatctaatttgtattccaaccactgctctgatgagcttatactgcatagatggcataatgtagctgcttaaggtgttcttaatactgcaaaagcactgctgagaactggtagaatattttttgttttgtgacttgacggctgaatcaaaacactagatcattcactcattgatcaaacatttcttgagtaggcactatgtgcaaactatagtgcaaagtgccattagaaatactaagctgacaaagaatagagtaaggcctttacacatatggagcagacagtcttgaagagggaatgacaggagatggagatgacctggcctaagagggttaccctttttggttcaaggatatcctgatttaagttgtgtcccctttatgtcctacaaatattcttttcctttctattcagtaaaatgccatttttctttcaaagccttactctaatgtcacctctgaagtgaaacctttgactcttgatataaatgaattatgttctctctgcgctcccatagaatatactatttaaaaaattaatctagcaatttattaggtggatctggactcctgtgacttgttagtatataatcatatgcaaagttgtctgtgaagatactaaaaaatgtacagtgtgatatcaagaatccttttttatatttaagggaatgttttaaaaattctctttgtgatcaataaaacatcatttgtttctttaattgtacattttattcattcattcattcattcattcatactttcactcattattctaccaaacggatgcacttgaaccctgtctaaagaatttgtgtgaaccatatgtgaaagactctgatatcaacattctctattgactagtatttctccataaacagaataatgagaattagcattcaaaattgtcttaggagccttctagaattctgaagtgccttctgaaataggaaagattaaactatattcaatcaatgtttaatgtgatatatgaaagcacaaagtgcaagatgacatgagggatgcaaggatatctaaagcaataaaatgcagaggaagaagctgggttcacaagagtagagaagtaactgcaagttacaaataaaagtgaggtgagttgtcctggtagtgagttatctggatgctcagagagagctaagctggccagggaacacattatagaggaagtgagacttaagcaaaatcttaaggagtgatagaatttatttaactgaatagggaagagaggaattttagatggaggggttgatgcaaagcacctgtggcatgggaggaatgaacagatgagactgcagtaacaatttgcatagaagaatgggcactggcatggagaaatagagaattggggtaaacgggatatcaattgcagaggtcctttaatctttttgaacattatttgattggcaattggaagcaattgaagattttggagcaggtaaatagcaataacaattgccattttggagattaatgtattaagtgaaaaaataagcacagtcttggccattgaaagtaatttgtaatcacggtcttggccattatgaccattatggcttacttttgcaccaatctaatagttgtgtgtctatgctgagaagaaaagtgaatgagccagtatcagatagaggatgcagttcagaggttcatataatgggctccacccagtgtgattagggcatgaactggggtcgtggtagtgggaagaaaggaaaagaaaagatgcacaaggaggatagaaaaggaagagtgccaaaaaattttacaaagtaaggatgaatgagttaagggaatgaagcagaaaaagaaaatctacgtggctgcaagagtgatggcaccattgatggaaataagatagtatagagacagtattagtcagaatttatattatcatattcacgacttggaaattttgcatttcatgcatatggtttatatggtagccctccaataattacactatttgattaactagacactccattccttaataatgccagaaatcaaagagcttactagatgcagagaatattcatattaatatcagcaagagagagagggatgcttattctgcagagaaaccagttagctctttgttactttgtagaacaccattctggaactctactattggtaaataaggagtttacttgtgactggttcagtgctggacctcttgggaagaaagtacaatggctgagagaaatgagcttgagtatcacccagcctctgaagacttttagggctggttaactattcctgggaactctgtcaaggcctgtgctgtcttttctggggacatgggtgggcgagtggactaaaagtgatagaatgaagttctataattaaagtatttggtggatatgttgagaagtgtcctcaatcacattcctatgtcttttcagtgactctgatctctacttcacacaaggggacaacagaataggaggaaaatactggaaggttcggtatactgaatttgttgatgcaacttttactaaaagaaagagactctctgctgaagaagcccatcttggaattcttggtacagtaaaaccatcccccatgcattgaacccagggagatgttttagctgggcatgtacatctgcacagaatgactcttctgctttacttctttctgtctcttttcattctcttctctctcttcttctggatattttttcaggcccagtcatcaaggcagaggtgggtgataccctgttagtgacctttgccaacaaagccgacaaggtctatagcattttaccccatggtgtgatctatgacaaggcatctgatgcagccccaaacctagatggtaagtctcactctgggcttagggaggaaacaggacgggtgagcaaagcacttagaaataaacagtcctggttcaaatcctggtcctttccattacctgccctgagagcttgggcaatcacttaaactttctgaacctgattctctcctgtcaaatgcagataacaatactcacctcacagggctttggaaagggatggagagaatttaggacaaggtctggcccatggtaggttcttaggaaatgttcatttctttctttttttctcagcaatatagtaaatctcaaaagtaagctactttcacagtcacttctttttctctaagatggagagcttttcagttgcaggttgcataggattctgcaggtgaaggctgaagggaaaatttgatttctaatggtttgttgacatcgaaatcttacacatggtctttgctctgtatcaaatcaacaaatatatttataaaaaacagtaatgtgtgcttatcatctgatatggcctctccccatcacagagtacatggcataggttctctaaatgtaagaaaggtagctgttgcccagtggctgtgggaactctaatccattcatgatactgctcttgggaaacttctagttccttggtactcatccctattactgcagcagacaccctggcttcctgggatactcttcacactcgagtgtgatgccaggcccagttgagaacaggttttgtggtgatagtgaggggacagaagagaaaggaatggaagagaattccctctccctggacccatcctcaccctctcttgctgcggtaacaattcctaaaaccatcctctcctctttggtcaaaataccaaaatggctgcgtgcagtgggtcatgcctgtaagcccagcaatttggaaggctgaggcaagaggatctcttgagggaattcaagattacagttataatcatgccactgtactacagcctgggtgacatagcaagaccttgtctcttaaaaaaataaaagaaaaaaatgctcagaatgactgtgtgtgtgtgtgcagaaagaacactagaactgacaaaatgtttgttaactcagcaaacatactgggcacctttttgcagagcactggataaaatgcagaatgagcctctggccttgtctagtaggaaagaatcaatgtgttttttggcagtacggtgtaagggttaagtgcacagtctttggaatcagacaaaaactgagtttgaatcccagatttgctatatatcaatgtcataaccttgggcattcactaaactcctctatcttgtagttatttggatgatttccaagttcagtctcctatatttcaaactctttaaagataggtttcttgcttaattcttttgggtatcttctgcaagaccaagtgtaatatattctacatagaaagcattccaatgatattttatgaattttcacttaactgttgaatgggccactatcagtcttttaatatttgctaaggctggcatttgagcaagaaattgtatgggatttatgaagaagataatcctttgatttaaacttttatctcataagccagcagattgtggcagtggcctcttctggtaggatacataagagaaaaccactctcctggtacaaaattcttcatcatcagagggaggcacccagggctggaagacccagtctgaccaatgtaatgttcttgcctgttgttttgaataattgttttgtttatatcctcaggatttgtgaaaccaggggcgcatgttaaaccaggtgaaaccttcacatacaagtggacagtgcctgagagcgtaagcccaactgctggtgatcctccctgtctgacctatctttacttctcagcagttgatccaattaaggacaccagctctggcctggtagggcctttgctagtctgtaaaaagggcgtcctcaatgctgatgggacacaggtaggccattgagtgtcaccagttcttctcagggttgtatgtgggagagatccgcaagagccagagacgagacaggaatagtcagttacaaaaagcaatttgtctttcttcctcttgaagtagatttctacataatggagattttatttgattttctggtgaaaatgtaagatctaaatttatagttacaaatgcccactcaggaacctagaatctctgcttgttgtggttaggatttggcaggcctctttttctgtgtgctgcttttattacagaatctttagagatccacatggaatgctaattggaattattcttcttggacaaggtttctcaaatcaaaattacttggggaccatttaaacatccattattcagatactacagactaattaaatcagaatctccagatgattccaatgtgcagccaacgttgagaaccactgtgacccacaactgtaaaatgaaagttaatcactatggctgaaggaaaaagaaagcatttagataacttcttgcaagtcccaacttagagatttgaattgttcaactgattagtgtagcgaagcatagcctttcaagctatgtctacatgatattaaacatattaatgaaaagagaaaaacagtcatttaagcatctattttaccaatcagaaatagcaaggacatttatttaaatggtatattttataatttttggcattgtgtggctccacttctggactcaaaggaatttccagatttaaaaaacacaaaatatcttgatcctatttggattttcctttctctacatgaaggaacaatcccggaaatgtctattgcatgtgttataagactgaatgtttatgctgtgcctcaacaagcacacaaggcaaagcggaatgattattcatattttaaagctgaagaaactaaggctcagagacattgagtagaattccaggaaatacacctagtaagtagtgaaagttggcagtaaaacacaggaccttgaacatccaactttgtccttttccaatgcatcctcttgcttcctcgcagctaaatacctaagccaaggagatgtagtgccagaaaatgtttgaaaggtagtgctaattttgcccccgctgtgtccgtttaatggtacctttgaggtttgctagaagcacctcatagtctgtgggaattgttgcctaagccaaatactattcatggtcagtccacttacacaaaattcatgaaaaaaaaaaagtaccctgaaacatcctatacctataacttggctgagagagaaaaccatttggccagatggaaaggtatgttcaattcaagagttacttatgaaatacctgctatgtgccaggccctctataagcaaaatggtcagtcttcttctaggcaggtggagagatgaaaatgggaataagtgtttgcgtctctttccagtaaattgtcataaattctcccagtggtgaatggtcaggtacagaatgtcatttactaacacccctagtcctccacactaaccattcagtcaaactccctactcccattctgtttctctctttgaatccacctctctatagatctcacacttttttggaaataatctgacttatgaaaaagtagaaaaaatttacaaagaatcttcatgtacccttcacccagattcatcaacatttgatctcatttgctttattattatctctctttgtttttatgggttatttttctgaactgtttgagagtaggttgtagacataatgtctttcagtgtgtgtttcctaaaaacaaggaccctctctgacataaacaaagtaaaattatctgagtcagaaaattaacgttgacattatcaaatctacatacattttaaaattttgccgattgtctcattgatgttctttatagcaaaagaaaaacatgtttttcctggtcctgggtctgatctaggatcatgcattgcattgagctgtctcctctttcccccatgattaatttctttaaattttttttatttttaatttttgtgggtacatagaacttgtatatatttatggagtacacgagatgttttggtacaggcatgcaatgcataataaccacatcatggagaatggggtattcatcccctcaagcatttatcctttgtgttacaaataatccatttatattcttttagttattttcaaatgtacaattaaggtgactatagtcaccctccccatgattaattttatcacagggcaccaggcatgatttttctaaagtgcaaatgagatcaagtcactttcctgttcaacacttccagtggtttcctgtcacacttaaaacaaaaatcaacactatttagacatgccccagcctcttgttcccacaagtgggcaccacgctccctcatgcccacttatgctccatccacattctgttcctctctcaggccaagcttgtctttggctttgggcctctgtaccaggctccttatgcctggaatgtcatcccctgacctttgcgtggctagttcttcttgtcactcctcagagaagccttctctgatcaccaggctaaggtcactttcttttatatcacctgattttactatcacttaccaccataagacagtttccttgtttatttatttgcttatgtgtatagtatgtttcctcctacaagaagataagtgcaatggagcaaggaccttgcctatcttatcttcctttcccagaacaatgcatggcacattgttgacatgcaacaaatatttctggttggataaatgcaatacagggtaagtactcttatccccaaggttaagaagtttagttagcagaaaatgccatattacacacatcttaaacattgtgtggcctgcaaacaaacactgaaaattccagtgcaacctcatttagaaaactcattttccttatccacatttcaatactcagagttgtgtaatgggttatggtttagacctctcacctttcttccctgctgctgtgggagcctactatgtactaacatatactgttcacaaaatagctgtgtgctgcagacaccagccactactcagatgttccatatatatatatatatatatatatatatatggagaaagagacacacagagagatatttattatgaggaattggctcatatgattatggagactgatagatctcagcacctgcaggctgagtcaacaggcagaagacccaggagagccaatggggtggctccagttagaaagctgacaggctcgagaaccaggaagagccaacattttagtttaagcatgaaggcaaaaagaagccaatgtcctagttcaaggacagtcaggtgggagaaattccctcttatttagaggaaggtgagccttttggttctttctattcaggccttcaaccaattggatggggtacactcatgtcgggaagtacaatcagttttattcagtctactgattcaattgttaatctcatccaaaaacatcctttcagaaacatccaggataatgtgtgagcaaaaatctgggcacactgtggcccagttaagttattcataaattcaccatcactcagggttctgtcaccttccttctaatgttttcttgggctaacttcccaccctcattaaacccagttaccctccaaatacctgtcaagcaatgaggttcttcaatgcaactcctttcaattgttcattcttctactatggatgattgcagtctcacctaataataacagcactgagtgcttaatatttgtcagttgttgcgttgagtgctttagctaagtcatctcatttaatcttcacaaaaaacatgatgtggggactcctattaccctcacgttgcaagtgagggaattagggcttagagaggataaatcacttgctccaggcttcacagtgggtgaacagaagaatagcattagaacctaggtttttctgttcacatagcccatgatcttttaaaatatattttgatcctttatgttcttccaatttttaatattttattctgaaaaatttcaagtcttcattgttttcttctgtagctcaagcttttataccactgccttctaaagcatcatgtaattaaggaaataactatatataaggaatagtaggcgcaaggagtactcacctcgttgatgaggagttaggaaagcatcacagaagtgggcagctaagcagaaccatgaggttgcttagtggtttgcaagagaaaagagtggcagactatcaaagctgagggaatacatgcatgaaggacagagggatgcagaacacagcaagtgcagagggtgacaaggagcttggccttgcttcaaagtgccaggaggaaagagtcaagagatgaggctgaacaggtaggcaggaaccggaataccattagatgagactgtattgtccaacataaggagagagatatggtcagatgacattgctgagggtccctccagagcatgcagcaggatgaaggtggcttgggtggggagcatgttagagacaggaaagcattgagggatagaaaggatggtcacctccattcttcacagaattagaaacaacaactttaaaattcatatggaaccaaaaaggagcccatatagccaaggcaatcctaagcaaaaggaacaaagctagaagcatcatactacccgacttcaaactatacaacaaggctacagtaaccaaaacagcattgtactgatacaaagtcagacacatagagcaattgagcaaaatagagaactcagaaataagacagcacatctacaaccatctgatctttgacaaacctgacaaaaacaaacagtggggaaaggattccctatttaataagtgatgctgggagaactggctagccatatgcagaaaattgaaactggacccccttccttacaccttatacaaaaattaactcaagatggattaaagacttatgtgtaaaacccaaaactataaaaaccctagaagaaaatctaggcaataccattcaggccataggcacaggcaaagatttcatgatgaaaatgtcaaaagcaattgcaacaaaagcaaagtgtgacaaatgggttctaattaaactaaagagcttctgcacagcaaaataaaccatcatcagagtgaacagacaacctggagagttggaggacatctttgcaatctatccatctgatgaaggtctaatatccagaatctacaaggaacttaaacaaatttaaaagaagaaaaactcattaaaaagtgggcaaaagacgtgaacagacacttctcaaaagaagacatctatgcagccaataaacctatgaaaagaagctcaacttaactgatcattagagaaatgcaaatgaaaaccacaatgagataccatctcacgctattcagaatggcaattattaaaaagtcgagaaatggcagatgctggcaaggctgtggagaaataggaacacttttacactgttggtgggaatgtaaattagttcaaccattgtggaagacagtatggtgattcctcaaagacctagaaccagaaataccatttgacccagcagttccattactgggcatataccaaaaggaatataaatcattctatcacaaagatacatgcatgtatgtgttcattgcagcactactcacaacagcaaagacatggaatcaactgaaaagcccatgtcttttgacaggctggataaacaaattgtggtacacgtacaccatggaatatcatgcagccataaaaacgaatgagatcatgtcctttgcagggacatggatggcacttgaagccattatcttcggcaaactaaagcaggaacaggaaaccaaacaatgcatgttctcacttataagtgggagctgaacaatgagaacacatggacacagggaggggaacaacacacactgcggcttgtggtggtaggggtggagggaggaagagcatcaagataaatagctaatgcatgctgtgcttaatacctaggtgacaggttgataggtgtagcaaaccaccatggcacatgtttacctatgtaacaaatctgcgcagactgcacctgtatcccaaaattttaaattaaattgaaaagaaaacatagtcatctctctggtcagttctaaaggaaagcatactgcagcgatctgtgatgctgtgtgatcagataggctcaaatagactgattaggaatacatgctgtgggaagtcatatccattgtcccctcactatccactcaagttaacataatttagctaagtctcgtcagttatatgaattcattatttcactcaaaaatgtatacttgatgcctgcttttccaggcatttttcttggtgatgcaggtacagagaggaatccaaagtgttcctatcctcatgaaactcacattgcagtaggaaaaagttaaaaaaaataacttcataaataaaatagtttcaggtggagataagtgctgtgaagaataaaatagggtaaagtgagtgagtttctgggcagaagatggagataagtttagaaggatggttagggaagaccactctgaggaaatgacatgcagaaaagtgaattgaggaagggagttcttcaattcatgttccacaacacatggaaagaccctgaggcaggaatgaggttggtgtgttcgtggaagggcaaaaggccagggtgtctggagcaagctaggaggtgagtacagggaaatgaagtcagagagagaagctgggccagggctggcaggtcagggtaaggagaaaaagtccttgaggaccagcctggcaacagaggccaaaagagtagaaagccttctaagcaggggctgatttccttggaggacggatgtaacaagaaagacaaattttctgagtggggaataaattcatcagagcaacattcagtatctttatttaaaaatgacctgcgaactcttgggctgatgttgatctgccctgacttattaatattttgtgtgaactttgaaggaaagcaattctgtgaattcctccaagctgtaccttttatgtattcatttctttcttctctgtagaaaggaatagacaaggagttttacctactgttcacagtctttgatgagaatctgagcagatattttgatgaaaacattcagaagtttatctggcatcccttcagcattgacaaagaagataaagagtttgtgaaatccaaccgaatgcatggtatgacaaatgacattcccgcctgtaaatgaaaggctgacttgcattagaagtgaaaatgattggtgtgtttgaattatattaattttggtttcttggatattgttcttggtcatgagtaagttatttcatgccttcagctttagatggtatggtgaaacctccctatctctcagagatgtgaaatttaatacttctagagcactttatcagccttagatgaaggaacacaaattttaaactagcggccaggcacagtggctaacacctgtaatcccagcactttgggaggctgaggtgggcagatcacgaggtcaggagaccagcctggccaatatggtgaaaccccgtctctactaaaaatacaaaacttagctgggcatggtggtgcgtgcctatattcccagctactcaggaggctgaggcaggagaattgcttgaacccggaggtggaggttgcagtgagccaagttcgtgccactgcacagcctgggcgacagagtgagactccgtctaaaaaaaaaaaaaaaaatttaaactagccaagttcacagtatatcataaatgtagaaaattactgacaaactactctcccttgggttcacaataacattaagtctgaaaaccaaagtgacaataggagataatcattacatagcaaagtgtctataattaagtagtatgaatgatttaattaagtagtatgagtgactggtgaatgttaatttgtgaaacactagctgttcctatcccagatcttcatttgagaggaattacttaattctctctccctgtctctttgtatcaagtgttacaatagcaaaccacctgctaattgcttgtgagtaacacaggatgtcattactcttaggcatattacctaaggtagcagagtaatgagagtccaaactcaatgcctgcaagagtgtgcagtcaataaaagtgcccgaagcaagtaacgtaagacaacaggtgctaacctgcttgttttaggacccagcataaaatctatttattgccttttaaagcattatggaagaataacaaaatagcccttaacctcccttccttgcatggaagtaaaaaatagtccaaggttacaagtgccccatggcaaccaggtcacagaccctatggtcccagatgctcatttccaacagagtcccctcttgtgccaatggaaagcatggagtagtacatttcagtgtcatcttctacaaaaggttttgctgtaactgaatatgaatattgtttccaaacttcttagtagacaatataaaggggaaattaaggtggaaataaggaaatatagcagtttcttggtggagaaactaaattgtaaaagaaatttatcatcaaagaggttggtcttcatttaaaaagataataaacaactgaatgaactacatcaaatccagccccaccctattttggcaatgtgaaactactttcatatttagaaatacaatatatagtccaggcactgtggctcatgcctgtaatcccagcactttgggaggtcaaggtgggaggatcacttgcatccaggagttcaagaccagcctgggcaacttagtgagaccccatctctacagaaaatacaaaattagccaggtatggtggtgtgcacctgtagtcccagctgctactcaggaggctgaggtaggaggtaggaggatctcttcagcccgggaggttgaggctgaagtaagcataatggctccactgcactccagcctgggcaacagggtaagaccctctctctgtttaaataaataaataaataaataaataaataaataaataaatatataaatacaggatatatcattgttaaaacaaagttcaaggcaaataatgcatcttaattcaaatgtcacattaattataaactaagttctagcttcagtcttgcttgcagggagtggaaggaagacagcaacaaagccaaaaagaaagggcctgacatggtgcacaatgctttgtgttgtgtttattatatagtctgtattcaaaatatgtttattgaaagaaagaatggatgagtgactgttgtagaaagagaggctttaaacaagcattccaaggcaagagaagattctctaccagccagccaaggactgaatttattagcaccttgatttatactcagatttcattaacatttgatggacaagatttagatcatttatttgcaaagacattatcaaagatttttttttcataaaatgtggtgtccttctcagaagtgccagaatttcttggaatttctaccaataatcccagatctgagtacaattaccaagcaccactggttttgcagacacagaaatattaggatagtacaaaagtaattgcggtttttgcaattactttcaatggcaaaaactgcaatcacttttgcaccaacctaacaaaaagtaattttatttgacaatgggattataacagaaggtcactcatgtgcatgataatagttccttcctgctataggcttagtagagagcaggaggggggtagaaatatttatttctccaagaaacatcaagcatgagacacaattatgtgcatttaccagtcagacattgcgttatatcatggctttcatccccatggggtgagaatgcggtttctaaattcttgtcaaggcactttttcagatagccactatcaatggattggggttgatgtcaaagataaaaacaatttgccactctggaagcacagagggtcttcatatctaactaatcattatttattaataaagtccctccagtaattgtactggggtaaggaagtacgagttatcataaagcaaatttatttactcaaagactaacctcatataagcttaagtaccccctaaaaaacaatccttctccactaactgcatatgcacatatactgtcaattgatttaaaaatctttcaaataatgctgaatccatgtaatcagtaaaagcatgtctgataacttctagaatcaaatgcaaagcccactggcaaatgagggtcttgtagaattcaatgaattaataactgaggaagagacatttaacaagggagatcataggaaaataaccacaaaagaaaaagattttcatatcgagagccttagagaagagtatggggaaattatttcataaacaatctgatttatcccttagtcattcttagaattagtgtccttgcatatgtgttgttaaagataacatttaaataatttccttatattttcattattcattgttaattttggtctccattttaagtggattcaccatgtggcttttccctggtactgtttattctctgaaaacaaggatcttttgtaaacagtttacatatttgaagctcccctgccccatacacactgataatttttcaccgtctttcttcttccatttagctgttaacggctacatgtatggcaaccagccaggcttaaacatgtgtaaaagggatagagtttcctggcatctgattggattgggcactgacactgacatgcatggaattgtttttcaagggaacaccatccacctacgagggactcaccgagactccctggccctgtttccccacatggccacaacagcattcatgcagccagaccatgcaggtaaacttgctgggtccatctcaggtgaccagatttctaccttcaggctcatcctcttagagttctcccacagaagaaattggtagactttgtgcacttcaagtggtgtagaaatagatatagtcttgattagaatcagagaatcctgacttattagtccaaacacatagtataagggacaaaggggaaatatctaaaatagcatccacaaaacagaagtgggagccttctaaagtctttggtgcataaatcctaggagaatgtttttgattcacagtccataaaaattcagccctgataaagtggatatgttttgctctcattgagcatgaacataatttcagttgcttctctgaagcatctaccaggcatggacatcccagtggatgcttccagattacagatgtagccataactgcagcctggtctctcttctgtaggtactgataacagccttttgattgggggaattctctgttttcattctgttgggcacccttggtttcccaacagggcaagctgcattggatctggaatttatggagacccctgtataatgccagtacctggaacttcttctcttagagattccaagctaatgagataattggggcgttttcataaaagatctagagcaacacgtggtagcacatgctaatcactgcatgaaaagtgaggagaacaagccctatagacattgaacatgtttttccaaaccaattttttcatcagtcttaacaagaaaccaatatgctacctaagatgagtacttgctgtttactaatggatgttctacttctttgctttccactggaactgcagtttagatgtctctgtgtcatcaattaagaacttgaggcttgggcttcaaaatctttgcctaaggactgcctgagactaggagctccatagtcttttctatgtgaacttttcctagtgtccagtctctgtacattagtatagttgatcaattatgaattactcaaatcaagagatgccttggacacaacttttttttttaatacgctcttcaagaccaaagagaggaggggattgggaaatagccaaatcattttaattcatagaaataggcactcaaagttagagctgcccagaataattttagaaatggagctacttattctagtgctttgatcattactccatgtgtcctatacatttctaaagagcttcacaacagtgttttccagtttatgtttggtgataagcataaatctgtgactgcttaaaagcttagtcatttcaccaattcctgtcccttacctataagtcaagaaggagggtgctcaagagtgggtagagtagactatatgctgcaactcaaacatttccatgttcttctattattattatcattattattagttttgttttcttcttcatgctaccttgtctaagatcctctttgttcttagaggagacaattcctcaactattgaagtgccatgatcaatacataaaaaataggcttcctggaaaaaacaaatgtaggggacagtctttccaagtctgtcttcaaaggtatcttctctgtggtttcatataaagacccttcctcatgtgtcctcatcagtgcctgggtgtgcttggtacccattgaatcaacccattgaatttttgctcatctaaaaggagtaactaggcgatgtttagacaacagagttacatgtatagcaagatagaggatacctctgtacattgtagaaggttaatgaaaggtacactcatccctcacctctaaaaacagaggctactagagaaaggggagaaagatttattgatccaatattttcattgagagttaatatcttcaataattttatctgtcttatgtgattttatggtgagttaagaaatatctatctgatgccaatgcatctagaaaattcaatctaaaaattacataatttttgacagacaggattgtcagtattatgtagaaaaatctaattgattgtttttctgttttctgtttccttttcatttagcataatgtagacctatcattggaaatgagaaacttctttgctcaagggcttaatgaagtaatacatttggctttaataataataacacttacatatttattgcactttagaatttatgaaatcctttagggcaaaatactcatcagaaatatggcttaatttgaaccttgtctaggataatcatcttacaggtaattagttctttttaaactgggctggactaagacagtcattggtgattttccaggacagactgtcttctaataggtgtgaattatatgggagacccagaaaagtcatttcttggtagcaatattgtaagtttctttttttataacaaatgaattttggacagtatctttctctccacagaagtaaatatattcaaagtaatctataccccctggggtctgattttaaactactagacaactggtattttaaaaatccacctaactggttattttgtaataaaatatgcaggtttgctaaaaacagaccatcaccaacaaaaataccgagcaccacactcaatgccgagccatttctcttgcaggtatttttagggtgttttgtgccaccatgccccacctctcgagaggcatgggtcagatctatgaggtcagcagctgtgacaacagggacccttctgagcagcggtacgggatgataagaactttttacatcgccgctgaagaagtagaatgggattatgcccctaacaaaaactgggagttcgaaaagcagcacgtggacgcaagaggggaaaggtaccacaggcgccgccgctagggctcctcggtgggatcgcgcatgctccgtaggtctttagtaagtgtggctccctgcaaattcccaggttgtgtctccacagttccggccgacagagacttttacttatgtgcacagattagggaagctgcccacctcggcctccggaaggcagcgtgcggtgtctcgcaggccctcggcgggctctgctgggtggtcatgggatgcagggcgtgcctgggagtgcgtgtgcagggtgaaaaggctgagggaaagaggcagatcacatggttatagtggggctgggaagacaaaaagggccagagaaggcagagagggtgtatgatgtggggtgagaggatgggctgctgtggatgcaggacctcaggaaaggttgaggctgagccactggcagagcgctgctctaagtgggggaccaccaaggagggacaggaggccattgccttgtaagagactccgggatcggggtaggaagaacaggtttctctactaggccctgtgcccagaaagtctgcaagactggccctcccttaacagtgctgttggccagtgatgcatgcccaagactcagcagctctcaggccgccagcagccttgtaagcattgctcctccagggcgctaagcccagagtccaggaaccaagatccctagggtgcactgggatggagttaaacaagggagaaggcaggcgcagaccacagacctcctcccccagggctaatcccctccctccacagcaacccactgcctggtattactgttctgatatgcagatgaggaaacttggacgcaaagagttaaggcgcccaactagacattggcagagttagaactgaacatagatcttttgaaagacaaataaatccacgttctctccggcacactacattgtccctcctggcccagttcctctttgttctttattgccacctaccctcgccccctgccaccatactcccctcccctcacctcatagacatcctccgtggctgcgagacaaacacgacatgctactgttcctatcttaacacaagtatttcttttcttatttattggcctttgttttgaggggctgtacttatggaaaagagattataatggttctaccttctggatacttttttttttaagatttcccttaagaacaggagaattttaaatccattcaattactcactaacctatttgttaggccaaacacctgtattctgcaaaactagtgctgccaatacaagctgaagactggtgctggtacagtggaaaatgaaatgaattccaatctggccctttctaaaatgattatttcattaaaaggctaccataactaaagaaataattgtataataactttgtcatgtgtacaatcttagcccatgaatgtataaaaatatagcctttatgatgttcatacaactaatatgaactcctactttaagtctccatcccacggggctagcaggaaggtctagcttcagtcttctgagactccctcccaagtgacataaggagataaaatgtgctggtggggaagggggtgcaatgccataattacaccttcccctgtcactctgattcttgcccatacatagatgaaagcaaagtgagataaggacaagttcacatgttcaaagtttaacaaatgctgtagataacaattcagtatggaattgaaatggcagttctcttagggcacatctgaggcatgtctgtagataagagcccagtgacacataccccttctgcaccctagtttctatgtgtctgccctttgtcccatggccatggtaggagcccatctggtttttgaaccatttgtgggtacaggctatccctgagacatttattatcctggtcagcacaggccctctgccccaccttgggacctagaagtctttctttggggcttcctaaaacatgctgggaaggtctcagcatcccagaaagccaacaaatgggaccatcggtacaatgtccaggggaagtttatgcagtgggaggaaatttgaaaacagaaattaagttgctatgaaaaaataaagttgtattcctagtactcctgagcttgtagactgataggtgtgtgatttagtcatcctgagattctccacaataaaccactgcctattgagcagctactgtggaccaggcattctgctagggattttacaaaccttatctgacataacccttacaacacacctgacctactccaccagtttttgctcagcatctcttgcaccattctcacaagatgatgaaaaagcaagtgcttatatagtgctgaacatgggcctgacatgtgctttacagatactgactcacatgaccctcatatcaattccatgaggtagaggaattattatcagcctggtttgcagtggagaaagctgggaaacggtggaatgtggctacaggttctgcactggtcactaccacatgtaactgggtctcctgaaaaatgaaagtagaagaaaagttctcttcccttggaaatcatacagtctagggtggaagtatacatgcatttattaaatacctactatatgctagacattgtgcaatgtgctggtgaaacagtatggaggatagacaaggtcctttcccacacagaattcctggtccatggtaagactttagaacaagtatgttctatgagaggggaagggtagagtgcaacaggagatatggcagaagcacacagccctgtcttgaggaaaggtagggagaaggttggtagtcggcgggggcttctgggaggaagtagtctttgagttgggacatgaagagtagtccacttgaagaggaaggaagcatgttcgtggcagagggaacaacctgtgtaaaggcctggaggtgagggagagcacatcatgttcaagagagtgaatgtttagaatgaccagaacatagagcctaggggctagtgatgggaaatgaggctcaggaggtggcaaaagcagacagtgaggcttgagagccaaattgaggagtttggcagtgggaaatcataaaaaggcttaacatcaacgttgttaaatgtatagcttaggatccctctgcctgcagtgtgtgaatagagggcaaagaggagtacaggtggcagggaaaatgattaggaacaattccacccaacctaggtaagtattacaagtggctgagataagaatgaaagctccctcaatggaaggggtgggtctcactgtattttagagataaaattaaaagattttaaaaatctgtcttttgtgatgatctgccttggtaatagatgaaatgtactatacatgtaaggtacgtatacagtctatcctcgttatttgtagattctgcttttgcaaatttgcctacttgctaaaatttatttttaaccccaaaatcaattcctgtgacatttttgtggtcatttgcaggtacatgtagagtggcaaaaaatttacgttgcttgatgcacacattttcagctgaggtcaaacaaggagtctctctgccttcttgtttcagctctcatactgtaaacaaatgtccttgttttcagattatttagtgccatcgtttttgcacttgtgtgctttatgttggtgctttcactgtttaaaatgcccccttaaacagagttttgaagcagtgtcctcagtgtaagaagcctctgatgtgccttatacatgtgagaggggctttgttcctgcatgagttacagtgctgttggctgttgagctcagtgttaatgagctcaacagtgttaatgctgttgagctcagcaatatatattaaataaagtgtgtttaaaaagaaacagacataaaacaaggttatatattgatctgttgatgaaaatattgtgaccagaggtttgcaggaacctaaccctatattttccctaggaacaatggttcagtctttattagtccagttatcacaatgactttctagaacataactagggtgaataacaagtatcaactgtatctatctatatttgtatatggatgtatacacaatacatgactatggtccttcttgagatccttcaaagtggaaaagcattaccatgtacagaaagatgcatatgaaatctggagaaactcagggtggtagagggtggacgtgtatgtgtgtgtgtgtgtgtgtgtgtgtgtgtgatgacacacacatgaagatgcaagtgtgtaaggttagatggtcccagaagagaggcgcaacctcaaaggatacttaggagtctctgaggttggccctactcagtgcttagcagaagattacaaccgtgatttccaagggtgggccatggactggtgctgggctgcccatatcagaactgaaggagctttaaagtgcagatgcctggcctcactcccagaaagtatggtgcaaaaggcctgctccccagggagcacttgatcacagccaggtttggggagcacttctccagaatacccctgaatcacttagaagcgctcaaagcttttctgctttctgacaactttaatttctgatgcttctgatttgcagacatggagatatatttatgaaccgcactgaaaattggattggctctcagtacaagaaggtggtttacagggaatatacggatggagaatttgtggagatcaaagcccgaccaccacgagaggagcacttagaactcctgggtatggcacagatttcaggcgtgcactgtcagccccaagcatgtgcatgcacacatactcatgtgttctgttacacttgtggctaagaaaggatagaagaaacagagtagcttgactgcattcctccaagtgtaatatcttcctgctctaccattatcagggagtgtgctgagtgctcaactcatacaaaaactagtcataataggactaccagataatacacaaataggaatccatgacatcagggcagtctaactggtgtatgataccctaaagcttctttccaacccctatactgagccaggaaattttcttttaaatcctccagcagatatatatatatatatatatatatatatatatatatatatataaaactttaagttctagggtacatgtgcaccacctgcaggtttgttacatatgtatacatgtgccatgttggtgtgctgcacccattaactcatcatttacattaggtatatctcctaatgctatccctcacccctgcccctaccccacgacaggccctggtgtgtgatgttccccttcctgtgtccaaatgttctcattgttcaatttccatctatgagtgagaacatgtggtgtttggttttttgtccttgcgatagtttgctgagaatgatggtttccagcttcatctatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacatacatgtgcatgtgtctttatagcagcatgatttataaccctttgggtatatatccagtaatgggatagctgggtcaaatggtatttctagttctagatccttgaggaattgccacactgtcttccacaatggtttaactagtttacagtcccaccaacagtgtaaaagtgttcctatttctccacatcctctccagcacctgttgtttcctgactttttaatgatcgccattgtaactggtatgagatggtatctcactgtggttttgatttgcatttctctgatggccagtgatgatgagcattttttcatgtgtctgttggctgcataaatgtcttcttttgagaagcatctgttcatatccttcacccacttgttgatagggttgtttttttcttgtaaatttgtttgagttctttgtagattctggatattagccctttgccagatgattagattgcaaaaatattctaccattctgtagattacctgttcactctgatggtagtttcttttgctgtgcaggagctctttagtttaattagatacgatttgtcaattttggcttttgttgccattgcttttggtgttttagacatgaagtccttgcccatacctatgtcctgagtagtattgcctaggttttcttctagggtttttatggttttaggtctaacatttaagtctttaatcaatcttgaattaatttttgtataaggtgtaaggaagggatccagtttcagctttctacatatggctagccagttttcccagcaccatttattaaatagggaatctttcctcatttcttgtttttgtcaggtttgtcaaagatcagatggttgtagatgtgtggtattatttctgagggctctgttctgttccattggtctatatctttgttttggtaccagtaccatgctgttttggctactacagccttgtagtacagtttgaagtcaggtagcatgatgcctccagcttagttcttttggcttaggattgacttggcaatgtgggctcttttttggttccatatgaactttaaagtagttttttccaattctgtgaagaaagtcattggtagcttgatggggatggcattgaatctataaattaccttgggcaatggcagtatggccattgggaaatggcagtatggccattttcatgatattgattcttcctatccatgagcatggaatattcttctgtttgtttgtgtcctcttttattttgttgagcagtggtttgtagttctccttgaagaggtccttcacatcccttgtaagttggattcctaggtattttattgtctttgaagcaattgtgaatgggagttcatgatttagctctctgtttgtctgttattggtgtataagaatgcttgtgatttttgcacattgattttgtatcctgagactttgctgaagttgcttatcagcttaaggagattttgggctgagacaatggggttttctaaatatacaaccatgtcatctgcaaacagggacaatttgacttcctctattcctaattgaataccctttatttctttctcctgcctaattgacctggccagaacttccaacactatgttgaacagaagtggtgagagagggcatccctgtcttgtgccagttttcaaagggaatgcttccagtttttgcccattcagtatgatattggctgtcggtttgtcatagatagctcttattattttgagatacatcccatgaatacctaatttattgagagtttttagcatgaagcgctgttgaattttttctaaggtctgttctgcagctattgagataatcacgtggtttttgtctttggttctgtttatgtgatggattacgtttattgatttgcattatgttgaaccagtcttgcatcccagggatgaagcccacttgatcatggtggataaactttttgatgtgctgctggattcgtttgccagtattttattgaggatttttgcatcaatgttcattagggatattggtctaaaagtctcttttttggttgtgtctgccaggctttggtatcaggatgatgctggcctcataaaatgagttagggaggattccctctttttctattgattggaatagtttcagaaggaatggtaccagctcctccttgtacctctggtagaattcggctgtaaatatgtctggtcctggactttttttgtttggtaggctattaattattgcctcaatttcagaacacgttattggtctattcagtaattcaacttcttcctggtttagtcttgggagggtgtatgtgtcgaggaatttatccatttcttctagattttctagtttatttgcatagaggtgtttatagtattctctgatggtagtttgtatttctgtgggatcagtgatgatatcccctttatcattttttattgcgcctatttgattcttctctctcttcttctttgatagtcttgctggcagtctgtcaattttgttgatcttttcaaaaaaccagctcctggattcattgattttttgaagggttttttgtgtctctctctccttcagttctgctctgatcttagttatttcttgccttctgctagcttttgaatgtgtttgctcttgcttatcttgttattttaattgtgctgttagtgtgtcaattttagatctttcctgctttctcttgtgggcatttagtgctataaatttccctctacacactgctttaaatgtgtcccagagattctggtatgttgtgtctttgttctcattggtttcaaagaacatcgatttctgccttcattttgttatgtacccagtagtcattcaggagcaggttgttcagtttccatgcagttgagtgattttgagtgagttccttaatcctgagttctagtttgattgcactgtggtctgagagacagtttgttataatttctgttcttttacatttgctcagtagtgctttacttccaactatgtggtcagttttggaataagtgcgatgtggtgctgagaagaatgtttattctgctgatttggggtagagagttctgtaggtgtctatcagctctgcttggtgcagagctgagttcaattcctggatatccttgttaactttctgtctcattgatctgtctaatgttgacagtggggtgttaaagtctcccattattattgtgtgggagtctaaatctctttgtaggtctctaaggacttgctttatgaatctgggtgctcctgtattgggtgtatatatatttaggttagttagctcttcttgttgaattgatccctttaccagtatgtaatggccttctttgtctcttctgacctttgttggtttaaagtctgttttatcagagactaggattgcaacccctgcctttttgttttccatttgcttagtagatcttccttcatccctttattctgagcctgtgtgtgtctctgcacgtgagatgggcctcctgaatacagcacactgatgggtcttgactctttatccaatttgccagtctttgtcttttaattggaacatttcacccatttacatttaaggttaatattgttatgtgtgaatttgatcctgtcattatgatgttagctggttatttcactcattagttgatgcagtttcttcctagcatcgatgatctttacaatttggcatgtttttgcagtggctggtactgattgttcctttccatgtttagtgcttccttcaggagctcttgtaatgcaggcctggtggtgacaaaatctctcagcatttgcttgtctgtaaaggattttatttctccacttatgaagcttagtttggctggatatgaaattctgagttgaaaattcttttctttaagtatgttgaatattggcccccactctcttctggcttgtagagtttctgctgagagatccgctgttagtctgatgggcttccctttgtgggtaacccgacctttctctctggctgcccataacattttttccttcatttcagctttggtgaatctgacaattatgtgtcttgtagttgctcttctcgaggagtatctttgtggcattctctgtatttcctgaatctgaatgttggcctgccttgctaggttggggaagttctcctggataatatcctgcagagtgttttccaacttgattccattctcctcgtcactttcaggtacaccagtcagacgcagatttggtcttttcacatagtcctatatttcttggaggctttgttcgtttctttttactcttttttctctaaacttctcttctcacttcatttcattcatttgatcttcaatcactgataccctttcttccagttgatcgaatcggctactgaagcttgtgcattcattatgtagttctcgtgccatggttttcagctctatcaggtcatttaaggacttctctacactggttattctagttagccattcatctaatcttttttcaaggtttttagcttctttgcgatgggttcgaacatcctcctttagcttggagaagtctgatcgtctgaagccttcttctctcaactcgtcaaagtcattctccatccagctttgttctgttgctggctaggagctgcgttcctttggtgggggagaggcactctgatttttagaattttcagcttttctgctctgttttttccccatctttgtggttttatctacctttggtctttgatgatggtgatgtacagatggggttttggtgtggatttgctctctgtttgttagttttccttctaacagtcagggccctcagctgcaggtctgttggagtttgctggaggtccactctggaccctgtttgcctggatatcagcagcggaggctgcagaacagcgaatatttctgaacagcaaatgttgctgcctgatccttcttctggaagcttcatctcagaggggtgcctggccgtgtgaggtgtcagtctgcccctactggagggtgactcccagttaggctacttgggtgtcagggacccacttgaggaggcagtctgaccattctcagatctcaaactctgtgctgggagaaccactactctcttcaaagctgtcagacagggacatttacgtctgcagaggtttctgctgccttttgttcggctatgccttgcccccaggggtggagtctacagaggcaggcaggcctcctcgagctgcggtgggctccacccagttcgagcttcccagccgctttgtttacctactcaagccttagcaatggtgggcgcccctcccccagcctcactgccaccttgcagtttgatctcagactgctgtgctagcaatgagtgaggctccttgggtgtgggtccatctgagccaggcaccggctataatctcctggtgtgccgtttgctaagaccattggaaaagcgcagtattagggtaggagtgacccgattttccaggtgccatctgtcacagcttcccttggtcggaaagggaattccctgaccccttgtgcttcccaggtaaggcgatgcctctccctgcttcggctcacgctcggtgggctgcacccactgtcctgcccccactgtctgacaagccgcagtgagatgaacccggtacctcagttggaaatgcagaaatcacctgtcttctgcgtcgctcacactgggagctgtagactggagctgttcctattcatccatcttggaactaccccctaagaatattttaagaaattgagagaaaattgaaaataataaccgtccaacaaattttagatttatatatacctttctcagaaaagcaattaaaaccatggcttgaatcagcaaggaattgatatgtgtggccagaccaccaactgtcagtgtatctccctgtgaatgtagaatgcaccagatacccaagagagagccatagggatcaggcacttctgaaatgggagtctactgaccatgaagcagtgcacaagtcatgctgccacaggccctctgagccaggtgtgggctcatctccattggcacccagcctggttgcttccaacagaaatgcacacaccagaggggctgaagagtgcttgtctccttgggtaaacaaatattgagaaacagagttagatgtgcatttgtgaagtcactatattaatcataaattaatacataaatgattttatttccctctactctttcagattccttttacacacattatttcattggatcttcattattattgtcatccatttaccagataatgaataatttcagacttatcaaaggttatacacagggggattacaactgaaagtcaccatatcatgtggatatggcttttcctggagatgatttctcagtagtaaaaaagcatttaccaagtacttatggtgtatcagtgcactgaagtaaacacttttagatacattatcttattcaacccttactataatcccacataaaagttattactaaactgatgttacagatgaggaaactgaaactcagacagattacatcacttacccaaggcccctctaataaatgaaggaagcagaatttaaacccattgctaaagactacatgatatttaatactacacaatgttgctctctaaagtggagtagagttatatatgcctttctcggaaaaacaactaaagccaaactattttatttgactaactactgcctatatttaaattacactaatgttgaaagagcaataataatgcacacaggcctgtgttttgcctttaggcccaatgattcatgctgaggtgggcaacaccgtcctgatcatatttaagaacaaagccagtaggccctactccatctcagcccagggtgtggaggagatggatagtggaaagcaattccaagtgcccatgacaaaaccaggtaagttgtgtcagaggtctgctccatcttgaagaagaacattggcgtcaactcttttctggtctcagaggtgtcttaaagagctcatcttaatgtcaatgtgtttcagccatcatctagtcactctggtatgagatcatcattcatccaatgaccaaatgtttaggaatttctagggttccattagaaacctccattagggaccccattgtcaacatcccccaccagagtagtacatttgttgtaattgatgaacctacattgatacatcattatcccctaaagcccataatttacattagggttcagtattggtgtgtatactctaagggttttgacaaatgcacaacaacatgtatccaccattttagtcctataaagaatagtttcactgccctaaaaattctccgtgctctggtgtttattttttcctcttccttaacccctggcaaccactgatctttttactgtctccatagctgttcttacagtagctcccccttatcacggttttgctttccttagttttagttacctgaatcaatcttggtctgaaaatattaagaaattttgagataacttcaattagagacaataaaaagatattttgagagtgagagtctacattcacatagcttttattatagtgtactgttataattgtcatattttattattagtaattattgtcaatctcttactgtgcctaatttataaattaattataggtatgtctgtataggaaaacacatagtatatataggtatggcactgtctgtggtttcaagcatcccctgggggtcttggaatgtatctctcctggacaaagggggactactgtagtaaacataaaaattaacacattaactgccttcaaaatgaagcattatcctgtgtatttaatgacattatttcatttaatcctcacaacaattagaaaactatgatgaccaacccactttacagataaggatactaaaggttagtgacattaggtagctggtcaaatgtgggataaataggaagtcatagggttgagatttggaactaggtctctctgattctggttctcaccagatctcacctgcccacttgagaagcttttaaaaaacactggcaccagagtcctagaccctagactctctgatttcactgtctggggtgaggcctgagcagcaagggcttacaaagctccctggtgactcccataagaggccaaagcagaggtccttgatgacaaagatgtgctcaaggacagctcttgggaaggagataaaacatttaaggaggaaaaacagtgaggtataaaatgtttttatttcctgaatacacaccagttgacaatagaaaaatgcaaactagagggaaggctggagcctgaaatgacaaatctgccatttcattttgaaatagtagaaatcaagatgggagtttaataagaacatttgtaatgaatgagtaattctctccagcaataaacattaatgaaaatatataaagacctgcttatatttcttcagataaatcatctgaaacacagataattctaataaattttttccatttcatttattacaggagaagtaaaaacttatagatggaatatccctaaaagatccggtccagggccttctgatcccaattgtattccatgggtttactattcaacagtaaactttgtgaaggtaaggtggagaaagcaaccaaaaggcttaaaataatttggatgaaagttgactacttgggtcatcacaatttgggttggtatatgtgaaagcgtataatgatttagagcaagggtctcatactatggcccatttacgaaatctagacatgctggacgtttacattgtcaatggttgacttgagtagctgcaacagagactatatggcccacaaagtcaaaaatatttactatctggtgattttttttttcccaaaaaaaaaaaaaaaaaaaaaaagtttggtgacccttgacttaaagtatggggaataaaaacaaaatcccaatgtttcaattaccaaatttagaacttaaaaagataaaaggtttgaagcaaaagaggatatgtaaatatacaacaataaaataaatataacttagagtacaatttatgtatggttttggatgtgtgaaatctgtttattttaaatgcattattatcagggctactagggctcaggagaagaaagttcactctaaacatagtaactgaaactacaaaattgtttgaatgattaatgatctaactttgaaataaaaggcaaagattcaacattgaatttgagccaggtatgtgtatgtaaaacaaccacagtctttaattacatgccataaaccaaagtccaatctaaagtcgttatttgatgtaaaatgtaagcattgcctattaaagaaaaaaagggagggattatcataaccttcctcttaggtattagatggcttgtattaatgtctttgagttatactggacagttctagagttcaggagatagaaatacaaggcacttgaataaataaacttacatatgagaattatgggaaaatccaaatttatttatgcatcacaacaaatacttattgagcacttgtgatgtgcaaatgaccccaccaaatactatgagagatgcagatactcttgtcttaaagaaacttataactttgtgggaaaataatatgtccacacttgtaactgtaatagagctctgaatctggtgaattctataggagtggcaggctaactaaagtactatagaaggttttggagggagagtctaggaagaaagagcattatgagcacagctgaaaatagggaagtagagggagtgtttgggacatgttgagagtcccatttggctatcatatggggtccagtagtaaatcaaggggtagcctaagtcagaaaatttcattaggggagcacatggagggctcacagacctgcaagggtttgtatttaattctgtaggccacggaaaatcactgaagacttctagatacgggagtataaagattactgtgatggtggtcaacaggatgggctggaggtggggtgaatcagagctgagagaagaatcaatttctagtccagggtgaggtattatgaccctacactagaatggtggcaggtggaatgaaatattattaaattacttaatggctcttttaactcagtttattttttcttccaggatacgtatagtggtttgatgggtcctctgattacatgccgaaaaggagtcttgaatgaaaagggaagaagaagtgacgttgattatgaatttgctctcttgtttttggtatttaatgagaatgaatcctggtatctggatgacaatattaagaagtatctcaacaaagatccacgagattttaagcgcactgatgattttgaggaaagcaacagaatgcatggtatatccaaagtttaaaaagaagcctatgttgagataagctcataggaattcctgtaaatgtaggaggctcccagcatccttctctgagcctttcctccttcccaggggcacctggactgaagaaagtcctctaatgctttccttcagactgaaccagcctagccactgattggctggcagcaaagtcattgaggctttgtactaacttgtagggacatgtatttctgaatcctgggatctctaagctctaagactgtaaagtaattctttaaaaacaaatcatcatttattgtcatatttttataagaatatgccataacttctatttgtttaaatttaagggccaggtttaattgtctctgggatatgaaacactaccatcaaatttctgttttaatgtatctgtgttacttctacataatttaaggtagtttgttggtgggagtaatgtgttcacattgacacatccacagtttctcaccaacagctatttttgaccaaaagtgcacaaaaaggccttgcccaaggtcacaaagctacttgttaatatagattagaatatagtagcctgattccccattcagctactctttcccctaccagttttgctttcttctcctaaagatgtcttagtatgctctccatttttaatgaatgcaggtcatttggttgcaccacaatgcacagaatcaaaagtcagtagacagtggaggagtgggagtcaccatcatgtaaactcagtttgctttggtcattgttaggtcatgagctcagcccgtgtgaagctctcttttatttttggagattcagccaggcttaaactattctcaacaagtgaaatattaagaaaataccttctaagtcactcaatttttatttacataaacttgtttatgccttgatttgttctctgtagagtggtataaatctgactacctctccaatgagactgtatttcccttcataaagagattatgctgaataaacaaacaaaacactgccaccaagatacggctttaaaactgctatttctctgttctcgctctctttgtagaaggatttctcagttatctgaattttgggtctagaatggtaggacactgctaggggtgagtgagattgttgcatgtttactagacagatgaaaatatcagtgacctaaagatcttctggaaacatttaaaaaatcagcttatcttttaactaaccaaaggttattttcttatcaccttttaaagccattaatggaaagatttttgggaatctccatggcctcataatgaacgaagatacaatgacaaactggtatttgttagggataggaagtgaagtggacatacataccatccattatcatgctgagagctttcttttcaaagtaagtataaggaaagtgctttgggaaagacgtttttgaactaacaaattcaatgtatttccagtggaaaataagagttacttggcaataatgcttgtgaggataggtgagaatggaacagaataatgtgattgtaccgtttccctggtggatatttcttttctttttttttttttttttgagacggagtcttgctctgttgcccagggcggagtgcagtggcacaatctcagctcactgcaagctccacctcccgggttcatgtcattctcctgcctcagcctcccgagtagctgggactacaggtgtgtcccaccacgcctggctaattttttttgtattttttagtagagacggggtttcaccatgttagccaggatggtctcaatctcctgacctcgtgatctgcccgcctcggcctcccacagtgctgagattacaggcgtgagccaccacgccaggcctggctatttcttaatatgtatatgtatattattgtgcttataaaaatctctccaagcctcaggtgagagttttctcattagtgatctggggataactctgaccaccctggaatatgctgttaatattgtatatgaaaccacggacactgacagcattcgtcccttttcctcacccttccttttttctttccctttccttctccccacccttttctttttctgtgtgattagctaacagaatagctctatccagtaaaggagctattttgagctctggcctaagccctgaaactttatcttgacttttgccctagtgagctgggctggaccatgtgtgactttctaccctctagcatcaagctgtaccatatgggtggtgctcactgtacagcagagccatctggggaactatgtaaaaacccaactgccaggcccgacccagacctgctgaatcagaatctccatggaaaggtccaaatagtctgtcatccgaagttctcagtgctttctacaaggaagtggaatagaaaagaacaatcatatccaatgtgtggagaaaactggaattgatcttttctagttagacacgaataaacggtaactttaataaaacatttaatatcctttctcctttgtatatttcaacgttgtttacgacaccaagtattagcctgctatgattagagtttcacatattaaatggctatgctgcttttcagaatttggcttttttaaactcacattttaaaaattatattaaaaatttataaaatttaatacacaaaattataaaaatttacatatacactttaaaaataagatataatttacattgaatacaattcaccatatttagtgtacagttctcttttgataagcacatacagtagtgtaacgaacaacaatcacaatatagaatacttttatttcccccacaaattttaccattgcaccctctagtgtcaactacttccccatacttaacacttgtcaaccactgtctctatagttttgccttttttgaaaggttatgtggaaatcataggttgtagcatcttgaatctggcttgtttgatttaacataggcattcaaattgtatccatcttgttatgtgtatcagtggtttgtttcttgtgactgttgagtagtattccattgtaaggatataatgcagtttgtttatctattctcctgttgaggaacatttgagttattttcaagtttgtttattacaaatcaagtcattacaaacatttgtgcacatgtttttgtgtgaacatatgttttcattttccttgagaaaatacctagaagtaggattgctaagccatgtgataagtgtatgtttgatttcataagaaaccaccaaactgttttccaaaaaggcagtatcattttgcatttccaaggaaatatacgagaactccatatgttgcacatccacatatgcagttggtatttttagtttttatttcatttttttcccttaggcattccctccttggggaggggatatagtggtatctcattgtttttcatttacattttcccagtggctaatgatattgagcatcttttcatgtgtttgtttaccatctgtcatctgtaaatctttggtgaagtgtccaaattgtaagcccatttaaaaaaattgggttacttgtttccttattgtagagtttgagggctttatatattctggatacaaatcctttttcagtgatgtgactcacaaatatttgcttccagtttgtggcttatcttttcattctcttaacagctttcaaatagaagttcttaatttttgatgaagtaaaatgaagtacaatttttcttttttctcttttatagatcatacttttggtgtcatgtataaaaaattttggccttactgaaggtcccaaaaaaggtctctgttttcttttagaagtggtatagttttagatttagggctctgatacattttaattttcatatgtggttcaagatatgaaataaggttcatttttttttcatatatatgtccaaatgttccatcaccactcattgaaaagatcatctttttttcccacagaattgactctttacttttgtgaaaatcatattgaccacatatatgtgggtctatgtctgggcggtctcttctgttacactggtttatactctgccctttcttgaatgccacaatgttttgattactttagtattatagtaagtctcaaaatcagatggtgattgttttagctattctagatgtttgccttcccagataaattttagaaataatttgttgattttgatttttaaaatcctgttgggattttgattggtattgcactgaagctatacaatgggttggacagaactgacataacaatattgaggcttccaatccatgaacatggtatatctatcgtttagctcttctttgatttctttcatcagcattttgtagttttcaatatagagatcttgcatatactttgttttatttatttataactaagtatataaaaggctttggtaatagtgtaaatgatagtgtttttattttgatttatagttgtttattgccaatatttagaaatataattgatatttgcatgttgaccttgcatcctgcatctttgctaaactcactttagttccaatagttttcctatagattttagggggattttctatgcagacaatcatgttgtctgtgaatagacatggcttcatttattttcaatctgtatgtcttttatttcttttgtcttactgcaatggctaggacctgtagtgcaattttgaatatgagtggtgaaagtggacatcctcagtttgttcttaatcttacaaggggagcatttagtcattcacctttgaatataaagttagctgcagcttttttgtggatcccattatgaggttgaggaaatttccttctaaatttgctcagagttttgatcatcaacaaatgttaaattctatcaaatggtttttctgcatctattgagatgatcagatgctttttcttctttaatctgttgctgaattacatttattgattgtggagtttttaaacactttttcattcccaggataaaccttacttggtcatgatgtattattcctttttgtggaattgatttgctagtattttgttatggatgatggtatctatgttcatgaggagtattgattgtagctttttttcctcacaaagcatttgtttagttttggtatcacagtaatgctggcctcataaaatgagttggaactgttctttcctcttctattttccagaacagtttgtttacaattggtattatttctccattaaatgtttggtagaatttgccaataaagccatctggagtttaatttgttggaatatcttgaagcaattacagtttctttaatagatatagtgctatccaggttatcaatgtattcttgagtaatcttcaggagtttgtgtcttttaagggatttgttcataccatctaagttgtacaatttttggataagaggtgtttgtccagtatttcctttttaatatttgtaagattttagtgatgtcctcactttcattctcagtatttttaatgtgtccttttcccttttcccttggttagtctgtccagagatttgtattagttatctattgctgcataacaaattactctaaacttagagtaattcttggatcaggaatttgggattagtttaactagttggttgattcagaatctttcatgaggaggcaatcaagatgtcgactggagctgcagttttcaaaggtttgactggagctggaggatccacttccaaacttactgatatggttgttaactagagggttcagctcctgatcatgtggataagacatgaaaactggcttcctccagtgagtaatccaagagaagagggtgacagagtatctaacacagaagtaatgataacctaatcttggaattggaatgccagcacttcttccacatgctattgatttcgcataccaacccttatacaatgtaggtaggaaccacaaaggttatgaataccaggaggtggggatcattgtgggccatcatggaagctggctactacagaatttattgattttattgatctgttcaaagaatcagttttagatttctttgacttatctctattgtacttctattcttgattcctgctctttcttatgtccttccttttgcttactgtgggttttatttgtttttgctcttctttctgttcttgctgttctgagcaaagaaggctactagctgttgttttttaaaacgtttttgcagatagataaatcttaccgagaagatgtgtatgatctctttcctgggacattccaaaccattgaactgtttgcagatcacccagggacatggctgctacactgtcatgtgtctgaccacatccatgctggcatggagacaacctacacggtccttcgtaacataggtacggttgtctgtcagtgatgccagatgatggcaccgagcttcctgtagacccccaaaacaggaggcatgacaaaaacccagatatagccctcaacaagctcagagtcaagtaagagagacatatatgtaaatatgtaactataatcaagtatgctatgtgccgtagcagaatgcagagtacagggcttaatagcagcagtaggagtgaatgggtaacagttggaggatatgagccaaagtttcacagaggccatgatgctccagatagactcagtgggtgagcagaagtgggaaagacagctggggcaggaaagcatgtacatgggaatgaagtagcacagtaagaatccagaaatgattggcagatactgatgggataagtcctcgctggtgaaatgaaatgactagtgtcatgaaaagaatccccttctgttgttaataaaacaatgaacttgttttctttgtgcagacaacaggattccttactccaccacatctcctggagtggcatctcacccagccacggtgccatctaacggtaatgataccctctccccatgtaaatgagtcaacatttcacccctcaaaaatgtcaggggcctgacaagtttatctttttcacagaacgacctggcaaagagcagctctatttctttggcaagaatctgggtccaacaggagccaaggcagccttggtcatccttttcatcattggactcctccttctaatcaccacggtgattctctccctcagactctgctctgcaatgaagcagacagattaccagcaagtccagtcctgtgctctccccacggatgctctgtgaaccatctggtctccctcaacaggaaagggtgatgtcccacagctggccagatggcagccaacagggaaactggaccaaggcatcactcaccaaggaaggttgacactgtatcctggatcagccttctgatcctctcaaacatcatccaaagcaatttgcttttatttatttatttttaaatgggctgcgaataatcctcaggtataaaacacagaaaaaggagaatgggcatggctgagaatgtcaactcttagtctattctttggttggattcactgaataggagacactctgaaagatatctttatattccatcttttataattcttgaacagtgctttcttagctaaccaccaaagtttctaggtgaacagcttctagaaaaagttagagtgcctcagacatttaactggaagggcactactttttcaacattgttgcataacatgcatcccttggttctgtggaaaatatctttcttaggagttcttggcaatgtctaagtcagtgtctgctgatagaattagaccaaataaattttttggaggctttaaccagctctcctggccttttcctctttgatataaatagcctgtgcagtgcttgttttaaaaagcaaagttatacgttttttaaaaaattgctgctgtttttattcaaacctgtagaaatacttgaatgtttacaactcacttcatgttacatgtttttacaatatgtttctgtggcaatgtttgtactttcaaaaatcaagtagagaaattgtatttctactgcagactgtgggagggctgaaatctgtaaaagaacatgttaggctctccctttatgaatcagggactccctgagagtttagagcaagctttctatcagggagggaagctttgcaggaggcaagtctgggcttgaatttggagtctgatttttcattcagttagagggaatctttacaagtcctcatcttctatgaaattataacattctcattgtatgagaaacatcaggaggaatttatcaatgtaggtgactagataggagaagggacctctaaatatcctagattctatggcttttaaagacatacctcttcatggaaggagaaaaaaggaaaaggaaaggtgagaaaaagataatcttggtggcagattctcttaaaccattaaaccagctttgaaaattaataaataatttccaaggttcaaatgcaaaaaaattattgaacaactaaactcaacccattatgaggcaatctacactgtccatacctatgcttagacagtaggtgtaagattgataaaagtaacattgtttattacaagactgagaaattgcttttagctctgggcgagatgccctgagattccaatgccaatgctagatgagtgatactggtatgcctgccttagcagtgggtaatttgaatgtcaaagtgagtgacaaggacctaagaaatattctggtggagggacctttcacactgtctcatcttcatcttcatgaggggaaatgggtaattggatagaagctatagtcttaacataaaaggggatgcaaatgctaatagttctgttcatagtttgcttgaatgtcatatcaaacagcatacacaaaagattttgaatttcaatctgctaaccattgacaatgtgatttcatagtacatgttctacagttttcatacatgtgtaggctgcataatttcataattatggtaaatgccttatttattacccaccttagtaagacaagttgttcagttgtttttttttcttttcagtttatttttttaatgaaaacaaaaccacaaagtagtttgattgcatcatttatcattttaataaagtgtcacataaggtggctatttgcatggttattttcacttaaaattatctatcactgaactaggggaggtggttaaagtggaattaatttttagatatttaggggctatgactatgccaatgacacttgttagaggaaatgaaacaaaatagtgtatctccacaaataatatgacttctcaaacattgtttcctcaaacataactacactccttgttctcagcctcactcttgagaaaatcaactctgccttcacttacacacatatttcttcctattacaatacacgtgtccctgctcctagcaggacagtctcttcatttgactttgggtctcattgcttcttgctttctcaagacttcattcccttgggtatccatttttcctcctgcatctttctatgaaaccatcagcaatgtccgccattaaaaacagaaagcaatgtgctgtcttatttaactctataaccccct

SEQ ID NO: 759 - DNA, 53044 bp, Homo sapiens
gggcggcgcggaggggcagggccagagggaagcgctttgttccgcgcgtggttcccgcgcctgggggtgcgcgggagaggcgcgaatccgagtgccgcgcgcggcccggggacttgcacgggcgtgcggggtggaaccgcaggaagcggagctctcgggttcccgccccgccccgccccgccggcggcggaggcagcgagcgcgagagcccagcggagtcgctgggagcctgaggcaccgagacacaaaggcaggcgggatgcgggagcaggcaaagggaaagcgaaagccgcgcgcccggccggtgactgggtgaaggcgccgcgcagctttcccgacgccggctgtacccggacctcctggtcgagcctggcgcgccgcagccatggccatcgctcaactggccacggagtacgtgttctcggatttcttgctgaaggagcccacggagcccaagttcaaggggctgcgactggagctggctgtggacaagatggtcacgtgcattgcggtggggctgcccctgctgctcatctcgctggccttcgcgcaggagatctcgattggtaagcctcgcccaggacggaggggagtggccgccccggtctggcccggtgagctgcgattttacggctcacaggcccgagtctgggtacgcccagctgtgatggtcgtgagcgtcaggaagggcagtggccccagttttatggtccaaagcgttctttgcccaggtgtttcattggtaccctggtctactctgctcgcatccctactcctcagttcttttgttcctcatgcccctctgatcggactgtggcttatagtttatgttccacccttagaactggcaccttgccaccagatttgccaagaatagctgtgtccccgtttttcacccctgtctcctacatatttgtccagccgcctaaaattttacaccagagaagttcctgagtggctacatggaggatgtgaagaccggtgctccatgagaagtgtgttctttcagtgtcttacatataattggtatttgctgagatcttagctctctagggttgtgaatgataggaaatatctgcacttggcaggcattagagggatcctcaacttggacggtcttacaaatgtgagatgaacaagtccccttcctgtaaattatcatttgagcttcataacagttgtgtgagattggaaagtctggtggtttgggcaggatcacgtggctacgtgccttaccttcctcatcagctgttctgactctccacacaggagagagtgtttatgaaccaacaggaaggtagcgcaggagggttaaatacagttctgtggcaggggaagagagaggacccagtgcggctggactttgggaaaacttttgtcagagggtgggtgggatttggacaagaaggagtaagacctttgttaaggttttgagatggcagagaatgttatatgttcctggaaagagagacacagtgactctcctagccaaggcaggaggataagtcagagttcctggagtctgagagtgaatatgggcctgggtcagcctggaacagaagagtgtaggctgatggtttcagaactgtgaagttattgtttgagcagaggacagactggttgaatgatggtggcatttagggtctgggaagaaggtgagaggatggggcctggagggctgggtgccagagagcaaggcatcggctgaggtcttgtgcacagagggtgtgaagagtggaagaaaatgggtgggtgattgctgtgcgatcaaggagtaaataagcagcacttgagtacctagtatttaataggccatgaacggcagtactggtcaaacgtgctgcggaggttgtatgtctgggtgagtggagtgtggtgttggtggtgatgggaattgtgaagttgagggaatagttgattaggaaagaatgactatgagtgtgattttgcaatctgcagcactaagttgttcagcttggcaggaagttgccaaattcattgtggaaaatagtttttagttttcctgctctttgcgcaggcatagtcatcgggatgttctttaagtttccatttgacagtggattgaggcttccagctgaaagcaaaaccaccaagtagcatgagtcctggagataatctctccctttggtcaattcctccttcagtactggctgtgtgctgaactcggtgctgacctccaaggacccgggagtaaaagaggcatgatccctgtcttggaggtgcaagtcttgggtacctggttgggacagaaaggcaggaggaaggagttagtcaccctctgtgaccaatctccacctctagcacatgtactagagggactcctaaggcacctgtacctgtaatgccttagatacgtctaaattggtgggctgtctgagaggtatttttggggtattgggagtggttttaactagcaagagtttgagctcatgctgtgtgcatagcactgttgtgtgctgagggagatgggaaaggattttgagaccttgttcttgccctgccctctccctgccctgtggcagtttactatgcagttgggcactagaaggtatctgttagcaggtaagtcattcagctgtgtgtaattcagcacccagccaggtgttgagctatgagctccaggctggtgaaggttggcaggcacttgggtgaggagctgtcaagcagactcccatgttttctgaagtgttttcaggagttccaggggaggacagacatgtgggatgaagctaacaggaccagggaagacctattagattaggtatacatttagataaaaccagaagaagggcttttgagaagaggggagaggtacatagattaatacatggagttggtacagtgggagggatcatgtcatgcagcatttaattttgtgtagttagtagtatgcactcagccaaaaacaaaccaaaaaaaagaacagcaataaagggagaatgaagtaattgaaatggagctggcactttgcccaccatattggccagtgaactcaggccccgggaagacactgagataaggcctgcagacttaaaacatggcttcatccttcctctgttgataattactgcttccctctctggtgcttggaatactcttttgttgaacttaacacagagctttataacctgtctatgcatgttttgcatggagattgaaactactctataaacatttgttgtgaattaaaggtgatagcttttggcatcatcagaccttgctaattgattgttatgtgcatgatgctgtaccttggcaatggggtgtcagacacacgtaggacataagaatctttcctctggaagcacggtctagtagagaagttgaacgcataaccctcctaatgcaggattcatggaacctgggcagtgtcagaagtgtgtactaaagcctgatgctgtggaaaggcagaaggaggggtttcttctgactcatgaacagtgagagtttcagggcagagttggcccctgaggcaggattccaagtgtgtggagcagtgttggctgaagctgagacgtgtgagacaacatgtggctgctggagctttagtggcaccgtcacatggagaggtgggagccaaagtaagggtccaggggctccacatgaaagaaggcatagcaaatcccattgttttcctgtttgtgttgggggggtggtgtgtgtgtgtataaaattagaaacgagaaaatcagctgtaattacatgtttttcctttttccacctgtatgataaactagtatatataagaattcatctcttttgatataaaatcccctcaagcgtaaaataaattatattttccagttactttccaaaaattaaattttctgtcaactgttgtttgataaaatagggttcaagttgaaactttgtggcgatttttcctttaaataaatgattttttactttaaagaaaatctattaaatcaagaaatgtgcatggattgtgctttagatttaagagcaggttctctgtgggggtgggagtgttgtaggttagagagagggaatgtcctcatatgataaaatacttggcttcatattaaaggcttccgtttggtctttggccttttctcttagtagttcagcccactgggctcctctcagaaaagagggactgagcctgcctgggccacagagacccatgggcatagcagcaggctgatctttatcaagccctgctgggtgccagcatggtggctgcaggtgaagcgtccactcctcagaggttctggccccttccctcccacagcagttcacgcaggtcctgcatggtaggcactggtgtggggctacctgggctggtggggactgtgttggggacagagagcagaagggactctgccttgctcattcaccagatcttggtctggctgcccacaatcacaggttgagggtcactgcagaagtgatgtggtctggaggggcatggcaaggctggtgccatggtcaaggtggaggcaactttggtagtctttgcggcagccactcattggtccagatgtgccctgtgatagtgagaattacaagcagaaaccctcctgagggagtggcaaggagactcttctgagttgtgcctgggagcattttgaaggcttttggacagtgagatactaaggattgaatgtaagaactaaaatgtgcacctgtctggttaggcctgatacttctagtcagcctttctaaaatactgcaggtgtgcctcctctgagattcagctgggtagggggaaaataagtgacacacagcaaaagacagtttaattgtgagtttgggctagaaaggctgtgtggtgggagccagagaagggagaatcagtggtttcaccagccctcatttttccttcctcttgtcttctaccatgtcttgccctcaacaagtgctccataggaatttagtgaaggaagtgccagagcacactagggaactctcccagagtggctgtgctgagggaatggacggagtgttctggataagggtcccagttgcttggaagtgcgccctctgagtgccatttaatgatacaagtgctgtcctgggtcaggcctgtcctggccacctcccagacacctgcctctgatgatagcagtaaaggatgcacatcgtcatgataggtaagttgtcccacttgatttataagctcaggttatattgcgtgtgcctcagattcttttttatgttatttttgtgatgaggaagaatctgtgttcagagtgcagaatggtgtactgtggaagaaggatgagtgtgatctgtgtggcttgggtaccctatgggtgtcaccttgtgcaagctgctgggagacagtgccttgaggcccttcatttctaacacatctactctcagatgcctctagaagtgctgcacatttcattgatggggggagaggtttaggaaatggctgggcgacagctttgtgtagaatataagcatgattgcatgacgtgaccttcaagctctgaaattctagaagtatttctctaaagttatgaattcccttagtgtgctgcagttatggactgaatgtttgtgtctcccaaccgcaaaattcatatgtcgaagtcctgatccccaatgtgatgctaattggagatccctttgggaggtaattaggtttggatgagattatgagagtgggaccttcatgatgggatgcccttagaaaaagaagaaatccctctttctctcccccctccctcttcctctcccccctccctcttcctccttctctccctctttccctctctctcccactaccccccttcctctcttcttccctcttcctctctccacaagtgcggccacaaggaaaggtgtgtgagcacgctgggagaagggggccatctgcaaactaggaaaagagctctcaccagacaccgaatctgctggtaccttgatcttgaacttcccaggctgtgagaaaataactgttgtttaagccacccagtctgtgggattttcttacagcagcctggttgaagacaaaactatcaacagaccagactctgaatgggattcatgtttaaggggtcttttgacagggcctcctgtgccctgcgcttagggctgtacaaggcctgaggcgtcaggggctgctttgattccctggtgcctcatgtggcacatatcccctgggaaggagagcccgtgtctcctgccaggatgtttctggctggctggaccaggtggggagctggggcagccagtagtctactagggaaagggtgtctggtcagccggggaccctgcctccctcacccactgacctcttagtgggcagccaccgttctgggtagagaaggacttagtctttctgagttagcactgctcttttgctatcattacagggcaggcattgggccagccccagtgagtcaaaggatagatataactgcagctgcttccaatatagtttgcttggagttcccctttcatttcctgcaactgagtcagcggctgggtggcttaagttatctgctctgttgtggctgaatttagacctgtctttgggaatatcttcaggctgctttttagcatgtaccagctggcaaagcagatcgattcttttcagggttgtctatcagagtgggccaatatttagggtctcatggcataggtcctataatagaacatcttcaactcacactaaaccaaagagccaagagagactcctaacccctccagaaggatgcatgctgtccagagagtctactgttggatacatgttttactttgttaatatttttcttgtacaagtagtagctaaatacatcatcatggtaaaggattcataaatctctttcactatgtgctgaaggtaggtggacactttgtgcagccttattgctgtactttgtctgcattagcataacgtgtacaccttattttattttttaaaacaaatcgagtcataccatagtggcttgctttttctcacttagtatgtttggagagctttccgtgccagtacataggtgtcacctcactgttttataatagaacagtattccatagcttagaatatacttacaattcatctaagcagtcccctaatgatggacatttactttctttcaaaatttctactcacacataaagcttgtttgcatgaaaatcttcgtaaatatttctctcctcccagcattaaaaggaaaggagactagtcgcagcagtatcagtttccagaaggatgacatcattttccgaatagttttgcattcctgcgttcctatttgaaataagtggaagaaaaaaaaaaaccactgccctgtacactatccagctctgactccctcaaaatgtgactgcattagaagtttggaagaagcattttgatgtgctcttggttttaagaaagaaagggcctccttcagggggtagaattgcaactttaagtagaacttcatgatacatgttctcctaacactgtaagtttccttcctaacatttaccataacttgaagttaggtaattacttgcatacttatctgttgaatactgtaagttcatttagggcagggaccatgtgtccttaaaacttgatacatatcggccgggcgcggtgactcatgcttgtaatcccagcactttgggaggccgacgtgggcggatcacgaggtcaggagatcgagaccacggtgaaaccctgtctctactaaaaatacaaaaaattagccaggtgtggtggcgggcgcctgtagtcccagctactcaggaggctgaggcaggagaatggcgtgaacccgggaggcggagcttgcagtgagccgagatcgcgccactgcactccagcctgggcgacagagcgagactccgtctcaaaaaaaaagaaaaaaacttgatacatagaagtattaggcagctctcacattgctatgaagaaataccagagactgggttatttttaaagaaaagtttatgtggctcatggttttgtgggctgtacaggaaacctagtggcttctgcttggcttctggggaggcctcgggaaacacagtcatggcggaaggcaaacagggagcaggcacgtcttatatggcaggagcaggagcaagagagaatggggggaggtgctacacatttctagtggctcacacctgtaatcccagcactttgggaggccaaggcgagcggatcatgaggtcaagagatcgagaccatcctggccaacgtgatgaaactccgtctctacttaaaatacaaaaattagctgggtgtggtggcgcatgcctgtagtcccagctacttgggaggctgagacaggagaatcgcttgaacgcgggaggcagaggttgcagtgagctgagatcatgccactgtactccagcctggcgacagagcgagactccttctcaaaatatatagacagatagataaaacctgaaaataggccttaggaccttcatggactctaggtttggattagcaacatccctttaaaaaaccatgcaaacaccttttttctgcagctggttgctttcttggattgcttccttgtcaaacccctaactgaggcagcgagagcttggtccaaagtggagaaagggaggcaatttgggggcatttgccctggctaagctaggaactctgggcgaggcaggccccgctgcatgctgtggggtttctgggggcagcagggagacattagttacttggggagaagggggcctaaagagaatctaccatctgcttggtaccaggcacacctagttctgtggggggtgaaaggggtggtggggaggggacgctgttgttttttaataaattctctataaagctcacactcctttttaaaatataaatatttatatatgtatattatatcattataaagataaaacttactgtagaaaatatggaaaatacagaagagaaaatagcagtacatctataatactaccagggataactactattcttgaaaaaccaaacactaagtcaaggccatgttaccatgttcctaaattgttgtacatgattttttttgttggcagtgacatggaatgttgtgcacgtgtcaaaatttaactgtttcacaagttttgtaatataaatagcattgtgaagaacactcctgtacataataaaccacctctctaaagatctcagtatttcaagtgattgtataattctaattacaaggtcaaagtatacatagacatttttaagatttgactggtgtggttgggttgccctctggatagacccccaatggatacttctccccgcagctgaaggagtggctttccccacagctggcaaaagttagtggattatcgtccacagcttaataggtgaacaaaggtgtgccattgttttaagtcgcatttattcagttacggcattgaatgttttttcgtatgtattttttccatttatataattctgtgaattgtctgttcttatcttttgcttatttttccaaggggatgttggtttctcaatgggttttattaactatttctatgtttcaaatattttctagctagcctttattgtattttcttttccggttgtccgtttcctttgaattctgtttatgttaagcatttttgttttttaatttttaatttttgttggtatgtaaaggtatatattcatggggtatgtgagatattttgacacaggcatacaatgtgtaataatcacatcaggagaaattgggtatccatctcctcaagtatttatccttcgttacaaacaatccagttgtactctttcagttatcttaaaatgtaaaattaaattattattgactacagtcactctattgtgccatcaaatactggatcttattcattctatttttatgcccattaaccatccccatttcccctgacagccatccctcagtaacctttacagtataagttttgataagcagaagttattttaagtcatcaaaactacccatcttttaattatttcttcagttgcattatgattagactgtcatagcccatccttaggtctatcagttttttaaaatgatctttaatgattttatttgaacatttacctctacagtctgttttgttcttttggtgctataagtcaagactctagctgataatccccccattgtcatttattgaggaacccgttcgttattcattgatccttgatgatttcccaatcatatagtcaactcaagtaagtgagcctatttttgggctgtttatattgttccactggtctattaattttcatgaaaataccagaccatccattttgtcactgctttcatactggcttgtttttagatgtgagtagatacctaggtaaattaaagttataaaatattagaatcatgacagggaaactgaagctcagcaatctaagtgagtgacttgcttggcaccaattgtcacatcgccttagcagattaatttctcataatatatcagatatttaaaaggctcttgaattataggaagagcatcattatcagcaggatccttactggaaacttgtcaggctatctcactattggaccttttaaaatattgtagttatgaggaacactattttgatatataataaatatttatttggtctttggtttcccagcactctgctgatgaggtcactgatggcagtggtctcctggatagccttgtgagccaggcttgttgccaagggaaccaactatgtgattagagggttgagactctcagccccaacccctgacctcacgggaggggagagggcctgaagcctgagttgatcactagtggctcatgatctaatcaaccatgcctgcatagaaacccagggagagggttccgagggcatccacgttacatccacgctgggagggttgtgcatcccaactccatggggacagaagctccttcactcaggacccttctgaacctcgctctgtgtatctctttacctgtctgttcatttgtatcctttaaaagatcctttttcgtaaattgccaatagtaagtaaagggtttgccttagtttgtaagtcactctagcaaatgaatgaaccataggaaggggttgtaggaatcctcaatttatagctggttggtcagaagttctattactgctgttcttgtaattgtgggaagctgtaataaataatggatgggctaaatagagtagaaatgctttgaaaaagattacaacttccagatcggttcagaaagtggtgaatatttcagtatgaaggataaataggctatacatggacttggtgcttcagctaatgagacaggcccattcatgggtaccccatggctgtcctggggtgctcactgcatcagccccaggaggtcccctcaccttactgctggtgtggcagtggagggagttttccaggttaattttaatttgccaaatgtctatatatgtcgaagttcagacagtaagaggaaacattaaagccctgcccttttttatggacacacctcaatctcagtttcttccccagaggtaactactgttcctgtttagtgcatattcttttacagtgctcatttttttgcagtttgctcatttatctttaatatgtcccagagatatcttcatgttagtgcatgcagatctgcctcatctttttaaatgtgccacaattttccatcatgtgactatacctcaattcatttaaccgtctgtttatgggctagtatgttcattccactttttcctactacaaacagtggtttaatgaacatccttgcatgtgcttctttgtgcagaatgtgtttctctagagccgtggttctcaaacattttggtcttaggacccctttacacccttaaaatttcttgagaattccaaagagattttgttgtctattggtatttatcatattagaaattaaaactgacagacttaaaaatatttattaattgatttaaagtaaacccattacatgttcaggtataacatatttttatgaaaaataattataaaacaaaaacttagtaataagaatagcattattttctatttttgaaaatctacttaatatttcatttcatagtagatgactggattctggattctcattcattatgttgtaatatcccacatcagtagcccccaaaactgcactgcatacactcatgagagaacgagagtagaaaggtaagtaacaacgtagtatcgtgaacatagttttaatgtcgtgaacctcctgaaaaggtctcaggtttcagggtttccagaccacattttgagaaccgttgttctagtggggtttgaaatcagagggacaaaagttgtgcacattttaaatttaaaagacactttcaactgccttccagaataccagtttacactcccatcaccaatataggccaaccccgccctacttctttaccaatgtttaatactttcagagttttaaatttgccaatcttaatggttaaaatgccatctcattgttttagcttgtagttccctatttacactgggatttcatgagacacacatttctgggctcactgtgacacttggcggtgtctggtgactgccccctccctccccagtgcccacctttttctttggcctgggatgtttgatcctagagagactgacaggtctccgcttgttttccttggcttatgaaataccccttccttctgaaatccatcttaactattttttaattaatttttttaagctaaaatgtttttttcaaaaaaccctagttgtttcacttctgagccctctgtttcctgtttacatttagtcaactagcaaatattatttattaggaaatgtgaataatgattaaggcatgagttataaagccagacttcctgggttccaattctggcatggcacacattgactgtgagaccttggacaagttacagaatttctcagtgcctagcctccttgtcagtaaatggggcagtaatagaattctcacctgtgtcacagggtgagaattaaataaattagcgctcgaagcactggaacggtgtctggtacgtaggaagcactcagcgcaggttagctgctaaacatcccctaatcctgttttggccctttgacaggtgacgacctggggctgctggggttggggaatgtgtctggggcacacagagtggggctagagtgcattgctctttccagagcctgggttctcaggcactgctgtgtgctctctgccccttcctgtcgtgtgtctgcgggacacaggactgcgtggggcaagctcacagcccagctcagaagctgctggtttgtgctgggtctccggctctgctgccctaggattatcttccctaccccttggattcctgctggggagggtgcctagtctgttaagcgccaccaccaacctcaccctcagttcagcactgcagcctcagctggtcattaggaacatgggtgtatggattatagtaccactggggacttgaaaacacaaaacacagctcctcaccctcacctaccaagccctccttgcctttactcataaatttaagtctggacttcccagtctgtcaccccaggatgtcctttatctgaccccagcttgactgtgtgctccagacacagtggtctgcttcctgtcttaaatgggctgtcagctttaaggactcagtgttttcttgcgctgttttccaagcctaggttcccttctctcctcctttgagtacgaacatttgtcatggttcagtcattacccttatgtgatttgttttcatctacaataattggtggtttatatccttggctgcctccactggactgtaagcccttggagggctgagaccaagtcttctttatctttgaatcccttgcattgcatatggtaccatgtacataatagcccagtgaatgctttttgggttaagcgccacacagttgagctgagtgccttagggagaatacctgtgctctgttgccccgtgtagaaacgggaagaatggagccctggggagggcgtgctcctggtataaaggccatgtggcattaaatacccagctctgatgaaaaagtgtggatgtcccttttcttttttgaggttccttgaaaaagtgtttgccactctagcatctgcatctgtcatgagtttttgtctatttagaatgcccttgtttgcaaagagatctcatgaccagttgtctacataatagtaacagtcattgtaagtccttttcatgttgccagagtcactaatctttgtttcagtactgaatttaaacactcaaggccttgtcctacacaaaagggtttctttgtcgcaagaactacaaaatccagcttttaaaaggcatctttgagggagagatgatgcagaaggacttaatgaagttggatctagtttcaggctgtggcccctttaaatctaagatcccagttatccaaggaggcctgctttcatgatgtgtttgctctagtattgtagaggataagacagatgggtaaacaaataaatatgaaattcatgataagtgcatggaagaaagtaatagaggatgcgacaagggagccctccattcttctatctccagtgcttaccatgttgcctgacaaagaaataaaaatactagttcccatttactgaattcttaactgtgtgctggtactatagcagacattttatttaatcctcctgggaattctgtgaggttttactaataagaaaacctcagagaggttaagtaagttgctgggaagtaaaagagaaaaccgaatgtctattgaatctaatagaatcttttttaaagcaacattcaggaataaagactccagagaacctctatttatagaacacttacctaacttttcccctttaagctaaaagtccctcctccatatctttttttttttttctttttgagacagtgtctctctatattgcccagactggagtgtagtgatgggaacacggctcactgcagccttgacctctggggctcaagtgatcctcctgcctcagactcccatgtaggtgggaccacaggcgcacgccaccgtgcctagctaatttttaaattttttgtagagacggggtctcactttattgcccagactgttctcaaactcatggcctcaagcagtcctcccaaagcgctgggattataggggtgacccatggtgcccagtccccctcacccatatctaactggatttctgcttgtttcatgcacattaggcctttgtgtcagtgaagaccagctgaagagtaattttgttctaacccttcttctacttgaagaagtctattaaagctgccccttggccttaaatagtctgttcctttaacatttttctgaagtcaatccctcttcttctccctcccccattttttttccatcattcatttcttacaatgcaaaaaccaagaccaagcacatttcctctagtgaatgtgtgaccagtctggggttgctgcaaggattcacttcccagctctcacatgtcacattcctgttgtgacatttttgatgatgtcgtttttttgatctggccctttccttccatgggtccagcttctgtctccaccaggtgaactccacctggtgcccagtcccctccaccctgtcagcagtctttctgactccacacagagtagccttaggcgctctgggtggggttctcacactccagccattgactgcaggtggctagtcttgtcagctctgtggtttttaatgaacttgggcctagagctcgggaccaggtttctggggagattggtgctggccctttcttgctgctgcttgtgttacgggctggcctggcattccacagtgcccatccttctccactccacccagcctccatggcctgtctgcaccttctctcctccctggccattcatcctcagggtgtcataggtgttggggaaagagtatgaccacacactcagggctgaattgcaacttgaccaagtattagctgtcttactttacttaacctctctgagcctttatttctcctctgtaaaatgggtataatgatagctagctcacaggtttcttttactaggttgaatgagagaatctaattcctgtcttatagtagtattcagtaaataccgtctccccctgattctgtgatggaaaggagctcatatgtctgatcagtacataggggaaatgatatcaacataatatcatatcagtgtaactaatcacattggttatatgtgattttttccaacatgtgaatgatttgtgccatcaagtaacaacatgtggatgaagcaagccaaagaggactatagcgtgtacgtgatgccccgctttccccttggctttgtttgaccatgtgttccatcttagaaatgctgttatacagtactctctgctctttgtgcatttagtccttatatgtgtaacttggcagcctcaacctttctttatacaccccttaattgtgcaagcatgtttttatcaggattctagtgctgttggtttaaaaaaaaattgcatagatttttgagtgatctgccccaaacctatatgctccagaagcactgttattttcgtggctttgcagaacacgtttgtgaacatatcaatagttgtatagcagagatatttggttttcttttcttccttccatctagctttttgcattcatggtcatttcatggaaccacaatctttggcctgtaccaggctgggacctagaagtgatagaagagattccttgcagacatgtgctgtgactgtatcttcataccatctcctgagttattgcaatagattcctgtctggtctctgcttctgttcttgaccccagatagttgttgacatagtgtccagactaaaccgtttaaaacaaaaatcagaaactacctttgctttaagaattctgaaattattttgtgtacagtttgggattgagtaaatgaataactatagatactgttgggagccaggattctcactgtgaaagaagaaagaacaaacatgggatgggggaagatgaagaagaacccagtggtagtggattagaagtaaaagtttccatctcagtttacaattttttataaaagatttcttttctagtttctgctgaagggcctaggaacaatggcatcttagtaacaaggagcacatcgagcacccaaataatggttttaaaatttctttacccaccaaaaggaacccagagctctttgcagaaatggccagttgcagagtggaaacagaaagtagacgacaagcccagaacattttgtaccaggatccatgggactgctcaggaactgaggggaacatgtcgaaggacacaggagctagtttgataggaaccatttgaacatcagagtgaataacagtaatggattataaaatattgaataacaaaggattacgtgagtccatattgatactaaaaaatcaagagaaagctcttcttaatccattgcaactaatacatgtagaaggagcaaatcaagttggaaaaaaaatacttattttgcaaccacatttaaagtatttgattcaccactgggtgaaagtgtgttctgggacacaatattgaccctgtctgcgaggatccctccacagaccacttatcattgcacagggggaaaggcacttttacggcagaagagacctagcaggcagcaccttgactaagtgcccaccatagctgatgtcacccagttatgggggaaaggtcatccaatgctcccagggtgctgtcctgaggacccacagcccttcctcgggattcctgccagcaatgcagaatctggattggagtttggagaaacaatcagacagacccaaaatgaagagcattgcattaaacaggtggtgctcgccacacacattagggtcgcaaatgacagagaaagacagagaaagttccaggataaggtgactacagagataggacaactaatgcaatgtgtagggcaggactggatcctgcttggatgaaaacagttgctataaaggctcgtttgggagatctgactatagataattgcttgtatctggtattttaagaactttagtaattgcactagattatttaaagagaatgtccttgttttagaagacacacacttttgagagtaaagggtcatgatctctgcaactaactcccaagcggttcagaaaagtaaaggatatattatatatgcatagagagagagggtgtatggcagagtgttaacactggttgaatctaagtgctgggtatatcagatttcattgtaatagtcttgtaatcttttggtaggtctgaaaaaattttcaaaataaaatatttaattttaaatagatgaggtaaatagagcaaaatgtcagtattgctttaaactcttaggtgtctgttacattattttctgtatgtttgaaaatctgtatttatcatctgtaatctgatgacaaaagtaaaatatatatatttaaatacatccagtactttcatcttaatataacattgagttcttctgatgccttttttccctggtacccaggtcatgaactttttttccacccaacagtggtgacatttacattggaattatatgggttttttctgtggtttagaccttgtgggtgtgtgagggactggacttggtaacacagggaggaaacccctcaaactgctacttagttttcttgtctgtctattcttgtgggtgtcatcctgtcttcgtggttgcttgtggctgtcatctccagcccagcctccttctcgtttctgttgctgcacttagcgggctgcgttgttcataccgtcattcccaattaaatgagataagcctcgcaggttcccttctgaggcccagcaatgtggtcatttgctctctttggctgtggggttgagtggtcacatcatggaccacgcgtttggcaggtacagactattaattcttccctccatctggtgagggcagtgctgtcttgacagtgccgtgtctgatctgttggactcacaggggcaaaccattcattctaaaatgccccagagttatttgttgatctattcaacagggttggggagggaagcatctggggcttcttgtaattcatttaaaaggaaacatttgatgatgctcagctttagttaaggggcaggtgttagccctgatgtgttctctttaaaagccaggcttagctgtgggaaagaaagacctggtgaaccaatgtggtttaaaggaaaaaaaaaagaagtatttcaattccattttttagtttgggctgcggagggtacttatattttctcactggtttaaaacatgcatgtgcctcagagtcagttcccacagaagaaaagtgaaggcagtaatggacaatttgggacatccagaatatatttaatttcatgtgtttgaagctaaagatgggtttggattgaagtctgctggaaaggtgaaaggagaggaatttggcttgtttttagtaagagaagttattctgagattcttgtaacattattgtattttatgatagttgagaactataagtattgggcaagaatacccttcggggcaaacgtcatttggtcttagtatgttggggtcagaggtactttaaacaaattcagacctgtttcatccttctgagtgcttgttggtgttctgggtttgttttcagagctgaccactgtccatctcttctctataccacacattcagggtcctctttgtatgattgttctcactgagaatttataatagttttcagatcttttggcaaccttaaaatatagccagacctttcaagtctggtgctttatgggttgtaatataatctacttggatcccatatatatggggtatgtgtgtctataatttacattaaggtgaattaaaccaattttttgttgtgtaacttaaaatcatttcgcagacttttaaaatcatgtgtatatgctaatgattgtacttgatataatcatcatcatattctctgttttccctttgagcctccagaacaaccccaggattttctctcctggctccttccttctcatccctccattgctgacctgattttctttaataatttatgcctttcacctcctctttcttgtgtttaaaaggtagagagagctgagttgatatcccagcttcacaacccactagccacaagatcactgtgcctcacacctcactttcctcacctttaaaataggggtgaaagtacacagcaagggttagttcccttctcctgcctaggagcaggatctaaccctgtgttattaatgcatgagaatgaaagaaagcatgttaaaggagaggaacaaaaaaatggggggcgtagatcatagcaaaagtaagccaaagccctcctgctgaagtggaacaagaatggagagccatcccactgtggtgtctttgagaaacctctggcttgctcaccccagccccagtcctatttttctttaggctatgttactttctaatcatttataggtacaggtcaaggctacaccaagggccacctgtgctgctgctcaggcagaaggtgtgaccagcaccctatgctccaggtcaaggcacctggaggagggtggatggggagatgtctgtggcatggattgccacagacattatttaatggatgttgtggctacttcctctgggccttgtgagcacacgttttctcctggtgatctgttattatatttggccagacgtacataaatgtaaagcccacagctgcctctgcactctcagccaagtggaagtagtattctttgttgttcttggcataaacctgaaactcctttctttctttcctgtacagtaataaaaggcagtgcatgtcttgcaaaatctgttccctagaaattatagcacacacttgttaagctgacacacagtggagcagagcatggggctgtggctggggatctcatgggactctgttttctcacctatcaagttggacagtgatatctttgggggatactttaacattaattgagatagtatttatgatagtactttgaaactttcaaagcaccagacagatgttacttggtacacaatcgtgcatgaagttcagagacagaatatgtcttgcctgtaaaaccttgatgtagtactagaggagataagacatatatgtctatgtgacatggttcaaagtggttttctgcacatctctgatttaaagatgtgcagaaaagcactgtgggaagtcagtgggggaggaagctttgtgaagagggtgatgcctaagcagagctttgaaagatgagccattgaggaagatggtgtgtatggggcattgacttaacaagcaggttctggcaagagggcctccgggcagaggggatcatgtaaggcatagatctgagtgcatatcaggcctatacaagccacagccttcattgagttggattggagcattgatttggatttgtaacccaggcagtagggaaccactgaaaaatgttgagccccaggagtggcaagatagaactgagctctaggatgaataacttggcaacagtttaaacaggtggagaagggagagactggaagacttcctgactcagactacttggaaaactcacgaagatctaacgtgtttacctcccaatattatcttgaagagtaaatgagatagaggatgtggaaatacatttgaaaaaatgaatccggatggtccctgtcccaagcttcctggcccccggccccctggcagcagctgatcaccctgaccccttgcctttaggtgccttcaggcagcctgggtgaaggtgtgggctcagagcccagctgtgccggtcccctgtaccctcctgctttgcccccctcttcactcctgctcttcactccctatttgttgcctgcccctccctgcctggctcttgacatccttgacttggtttcccatttctggcctgggaatacccaatacctggggattgatgtgtttctttttctagaaatgcccttgacccttcccaggaagctgtccccttcctggccacttggaggaaccacctacttagaccacacccattccaacaaagccctggtccccaggagctcctccagggtggccttgcaggggtgactggcttagagaggagtgctgagagaaactgggagttggatacagatttaaatgaatgctgctaccattcactagcttgggtaggggattactgaactacttggagctttggtttactccaggggaaaaggaaaataatgatgtgtctctccatttggttgtgaggcttaaatgaggtaatgatttaaagggctggttggtgtctagtgaatatgagttggccactgccttttcttctgactttccattccagatgaagaccatttcttaagagcttcacatgtttctgccctcctctctctattttccttcttcctcttttgcaaaagctttagtataaaaagtgtagttatttctgctccaggagtttctactgctgccttgagggggaggtcctcgagatcccaagatagagcttgaagcactctttcctatagaaagaatgttaataaatgttggatacttgcacaatgaggactttgcctaaggaacattctgggccaggcaggctttcatgaaatcataacagcattattcattttcatgagtgagtacttggacagatattcccaagcaagcagcttatcagcatccttgccagaaaccatctgattgtaacctgaggactatctgtccccttaggtatttactgttgccctcataagccttggtaggtggttggcttaggaagcatttcacactgatgcgggaaccgtgtgagcttagtgccaagtcctgtgctgtcccgactactcatctttttataaaatctaagaacttaagtttaatgggataagacagtcagaagggaccttgaaatatcttacctgtcccccactcatatttaagccattcttgaatggcaagaactaccccattatagaacacttgctgatgtttgtgacttttcatgatgatttcctgtaaagcctcttgctgacaagtcctttcttgatggctgtgggtgcacaggcccctgatggggaagaaatgctcagggctttgccgcataccactcctaccacaagaatatactctcctgaaaacatctccatcacttctctcttgtaccataagcataaaggccactccctccccaggcaaagatgagtgtcgaggccttttatgtgccagggattagggaaatccagctccgtaacttcccactgtccctatcattgctccatagggtgggaagggagaatggtaggcacatcccagtctttaaggcaatatgagaatctacttgttgcttcatctagaaaaatgtaacactaattcagcaacttctgggaaccagacaccctcgcaagtgctgcagcaagttttgttttttgttttttgtgtgtttttttaatttttgtattcaccacaacaaatctgtaatgtggatacactattaatgtcattcctattttagagatcccaggctttgggaaattaatgacttatcagctgtgactcaccctgctgagagtggcagagtcaaatttaaatatgactcatgtcagagcccagtcactgagcacactcccaggctgtgatggatgtggaagagagtgtgcctgtcatggagccttagctctgacccctatgcctgtgacacacacacctttgaatgtgccaggtggggacaggggatcagggctgggccaggcaaggcctagcgccagcccctgtgctactggtgggaaggggaggacacagccctgcctgagccttacgatcctattggtcagtttccctccatggcctgtgtgtgtcaggagcacaaagagtcttccagatggtaggttttacagatgtgacggtagcatctgcagagagatgtaatcttcagtttgcagaggagaaaaccaagtcccagagtcccttcccagaagagcgagtgaacggtagagccccaccaggacccaggtcttcccattccccatctaccgcccatctgctgttgggaggtttgcagtcgtgagcgtttcccttccaaatgtaaaccagttgggctgcagtttcagcctgtttcttctttagtgttacaggaggtaggaaaccactgatttcccatccagtgttctattaccaatgttcccttcagctttctcttcctcaggctaatagttctttgcttctttgttctaaaagaacttgtttttttagtccaattttccgcattcaggtgcctcactgaccctcccacataacctttcctttttctcaatccttactccaaactaaaccaggtctctccacgcttgcctcttgaattctgggctctggttcttttcctgcttcctttttctttgtatggtagttctacttcttttaagaatttttccccaactgaggccaagctgctatcatgaccagtgttggccaaaaccactctgtgatcttttgttttaatatgaacttgggtgtttgtttttagttctgtcctaatgtctccacctcctgtcctggtgctccctaacttagacaaaactaaaaacatgtgagatggggacaagagtccaggtaagctgtgttttcattggaaactatctgttttgcttcttaggtacacagataagctgtttctctccaagttctttctcctggcgtcaggctgcctttgtggattcatattgctgggcggctgttcagcagaagaactcactgcagagcgagtctggaaacctcccactgtggctgcataaggtaaagggagacatttccaaatagaacctgtttgctttatagataaggaaactaaagcccagggaggctatgccaaagaccacacagatattgtagccaaccagtgctgtatctcagattgtaaaactgtagcaccttatagtcaaaaagaacctcagagatgacttggtgtaggcaccatcatttagcacaatggggcaatgggaagtgttctttgagttttagctctataacagcaggcaccttttgtgtcttgacacctttatatcataatgcccagcaggatgtctggcccgtagtaggttcttagtacattttgagtgtctgaatgagcatagctagacagtggcagagctaggattcatgcatagcttctcagctagcaccttttctaccacacacagggtctcttgcagaaagtaaggactgacctagagttcagttgcttctagctgatacgttactggaacatcaaaaagcctagtgatgaggccctctgggggtgttggctgtagcactgtttttggaatggatccctttgctttttgatagatccagatactgcagggaaggggagatactacacaagagacaccaatgtctgggttccactccacttcccatagagaagaggtacattctgtagtcagggaagtggtggtttgtgcatgcaggtggcaggggatgcagtgaggaacttaggcagcagttgataagtttgtgcagaagaatgttctctgagttatgaagtgactgcattaggtcttctctgtgcttctgaaagtaggactttgtttcagcctgtcattaatttcaaccactgtttcttttgtccattgtgaaaacaattagaatgtgtatcttctggtattcttttctgctgaagaaaatatagaattttagctttcgaaaacccaaaagccaaagtttgactctcttctgctttgacctgcttccagacacaccatcagcatccttcttcgtaaaaggaatgatttaagggagctatgactcaggcatgtttgtttatagttgacccttgaacaatgtgggggtcggggcactggtcccctgcacagtcaaaaatttgtgtgtaacatttgacttccccaaaacttaactactgatagcctactgttgactggaagccttaccaataacataaacagtcaattaacacatattttatatgctatatgtattatatactgtattcttacaataagctagagaacagaaaatgttattaagaatattataaggaaaagaaaatatatttactattcagtttgtgcaaacgtaattgtgggttttgccattaaaagtaattgcaaggtgggtgaggtgggcggatcacctgaagtcaggagtttgagaccagcctggccaacatggtaaaaccccgtctctactaaaaatacaaaaattaaccaggcgtggctgggtgcggtggctcatgcctgtaatcccagcactttgggaggccgaggcaagcggatcacttgaggtcaggagttcgagaccagcctggccaacatggtgaaaccccatctccactaaaaatacaaaaattagctgggtgtggtacgggtgcctgtaatcccagctactcgggaggctaaggcaggagaatcgcttgagcccaggaggtggaagttgcagtgagctgacatcgtgccattgcactccagcctggggaacaagagtggaactccatctcaaaaaaaaaaaaaaaaagccaggcatgctggtgcatgcctgtagtctcagttactcgggaggctgaggcaggagaatcacttgaatgcgggaggtagaggttgaagagagcagagatcacaccactgcactccagcatgggcaacagagtgagactccaaaaaataataataataaaataaatatataaaagtaatggcaaaacgcgcaattacttttgctccaacctaatatttattaagtggaagtggaacatcataaaggtcttcatcctcgttgtctttatgttgagtagctcaggaggaggaggaagaggagaggttgttcatgctgtatcaggagcggtagaggcagaagaaaagccccataaaagtgggcccatgtagttcaaattcatgttgttcaagcgtcaactgtactgcttgccattttgcatagtggtgccctatagtgactcttttctccttttaggttgggcttttctctttattttcagccataggtgggttctcgtcagctttgcatggtttagtagccaaggcaacaaataataggacttgcagtgtgaatgaccacagttctaaagtttaacagcttgctttgtaaatccaaatttttactgttgtagtttaagttcgtttgttatagtgttctcatgaaaatagagagttttaatgagtcactgggctgcctttgatggatccgcaggagaattgtctaagagttggcaggggtgttagtaattattttagagcaagaataaactgaaagattttttatccagatgtattttacatttaagggtaagggaactttgagggatctagcctaaaggttataggaccagttactgaccaacacatcagagctcagatcttcagacttctagcccattgctcttctagtcaaggaaggggaaatctggaaacagtataggtagccaaaccttaagttacctggtattaatgagagattaagaaaccctctttctggcagtggaagactgcttgtttgaatggaggtttatctaagtttctcagcagagctcttgccagattcacaaggctggggacagaaattgaagtcaggacctgccacgttggaaggacccttattaacactccttggcatttggttgggactctgaaaggctgttccttgagaataaggggcgatccagaattaatctagctcccatagggacaagagtcctgatttaaatcattgcaatagcagttgaatgacagagatcggggattacgagtgtctggtctacttgcctgccagaagtaaaaataaatcctttctggaggattttctgggtgtgattatcattcatctttttttaaaaaaaattatttttctcgtttttttttttccttttttttaattatactttaagttttagggtacatgtgcacaacatgcaggtttgttacatatgtatacttgtgccatgttggtgtgctgcacccattaactcgtcatttaacattaggtatacctcctaatgctatccctccccactccccccacccaaaaacaagccccagtgtgtgatgttccccttcctgtgtccatgtgttgtcgttgttcaattcccaactatgagcaagaacatgcggtgtttggtttttttgtccttgcgatactttgctgagaatgatggtttccagcttcatccatgtccctacaaaggacatgaactcatccttttttatggctgcatagtattccatggtgtatatgtgccacattttcttaatccagtctatcattgttggacatttgggttggttccaagtctttgctattgtgaatagtgccacaataaacatacatgtacatgtgtctttatagcagcatgatttataatcctttgggtatatacctagtaatgggatggctgggatggctgggtcaaatggtatttctagttctagatccctgaggaatcgccacactgacttccacaatggttgaactagtttacagtcccaccaacagtgtaaaagtgttcctattcctccacctcctctcccgcacctgttgtttcctgactttttaatgatcgccattctaactggtgtgagatggtatctcattgtggttttgatttgcatttctctgatggccattgatgatgagcattttttcatgtgtctgttggctgcataaatgtcttcttttgagaagtgtctgttcatgtccttcgcccactttttgatggggttgtttgtttttttcttgtaaatttgtttgagttcattttagattctggatattagccctttgtcagatgagtaggttgtgaaaattttctcccattctgtaggttgcctgttcactctgatggtagtttcttttgctgtgcagaaagaagctctttagtttacttagatcccatttgtcaattttggcttttgttgccattgcttttggtgttttagacatgaagtccttgcccatgcctatgtcctgaatggtattgcctaggttttcttctagggtttttatggttttaggtctaagatttaagtctttaatccatcttgaattaatttttgtataaggtgtaaggaagggggatccagcttcagctttctatgtatagctagccagttttcccagtaccatttattaaatagggaatcctttccccatttcttgtttttgtcaggtttgtcaaatatcagatggttgtagatatgtggcattatttctgagggctctgttctgttccattgatctatatctctgttttggtagcagtaccatgctgttttggttactgctagtagccttgtagtatagtttgaagtcaggtagcatgatgcctccagcttagttcttttggcttaggattgacttggcgatgcaggctcttttttggttccatatgaactttaaagtagttttttccaattctgtgaagaaagtcattggtagcttgatggggatggcattgaatctataaattaccttgggcagtatggccattttcatgatattgattcttcttatccaggagcatggaacgttcttccatttgtttgtgtcctctttaatttcattgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttataagcttaaggagattttgggctgagacaatggggttttctaaatatacaatcatgtcatctgcaaacagggacaatttgacttcctcttttcctgattgaatgccctttatttccctctcctgcctgattgccctggccagaacttccaacactatgttgaataggagtggtgagagagggcatccctgtcttgtgccagttttcaaagggaatgcttccagtttttgcccattcagtatgatatcagctgtgggtttgtcatagatagctcttattattttgagatacgtgccatcaatacgtaatttattgagagtttctagcatgaagggttgttgaattttgtcaaaggccttttctgcatctgttgagataatcatacggtttttgtcattggttctgtttatatgctggattacatttattgatttgcgtatgttgaaccagccttgcatcccagggttgaagcccacttgatcatggtggataagctttttgatgtgctgctggattcggtttgccagtattttattgaggatttttgcgtcgatgttcatcagggatattggtctaaagttctttttttttgttgttgtgtctctgccaggctttggtatcaggatgatgctggcctcataaaatgagttagggaggattccctctttttctattgattggaatagtttcagaaggaatggtaacagctcctccttgtacctctggtagaattcggctgtgaatccatctggtcctggactttttttggttggtaagctattaatttttgcctcaatttcagagcctgttattggtctattcagagattcaacttcttcctggttttagtcttgggagggtgtatgtgtcgaggaatttatccatttcttcgaggtgtttatagtattctcagatggtagtttgtatttctgtgggatcagtggtgatatcccctttatcattttttattgcgtctatttgattcttctctcttttctttattagtcttgctagcggtctatcaattttgttgatcttttcagaaaaccagctcctggatttattggttgtttgaagggtttttttgtgtctctatttccttcagttctgccctgatgttagttatttcttgccttctgcttgcttttgaatgtgtttgctcttgcttctctagttcttttaattgtgatgttagcgtgtcaattttagatctttcctgctttctcttgtgggcatttagtgctctaaatttccctctatacactgctttgaatgtgtcccagagattctggtatgttgtgtctttgttctcgttggtttcaaagaacatctttatttctgtcttcatttcgttatgtacccagtagtcattcaggagcaggttgttcagtttccatgtagttgagcagttttgagtcagtttcttaatcctgaattctagtttgattgcagtgtggtctgagagacagtttgttataatttctgttcttttatatttgctgaggagtgctttacttcaactatgtggtcaattttggaataagtgcagtgtggtgctgagaagaatgtatattctgttgatttggggtggacagttctgtagatgtctattaagtctgcttgatgcagagctgagttcaattcctggatatccttgttaactttctgtctcgttgctctgtctaatgttgacagtgaggtgttaaagtctcccattattattgtgggagtctaagtctctttgtaggtctctaaggactggctttatgaatctgggggctcctgtattgggtgcatatatatttaggatagttagctcttcttgttgaattgatccctttcacattatgtaatggccttctttgtctcttttgatctttgttggtttaaagtctcttttatcagagactaggattgcaacccctgcctttttttgttttccatttgcttgctagatcttcctccacccctttattttgagcctatgtttgtctctgcatgtgagatggttttcctgaatacagcacactgatgggtcttgagtctttatccaatttgccagtctgtgtcttttaattggagcatttagcccatttacatttaaaattaatattgttatgtgtgaatgtgatcctgtcattatgatgttagctggttattttgccgttagttgatgcaatttcttcctagcctcgatggtctttagaatttggcatttttttgcattggctggtaccatttgttcctttccatgtttagtgcttccttcaggagctcttttagggcaggcctggtggtgacaaaatctctcagcatttgctttgctgtaaaggattttatttctccttcgcttatgaagcttagtttggctggatatgaaattctgggttgaaaattcttttctttaagaatgttgaatattggcccccactctcttctggcttgtagagtttctgccgagaaatcagctgttagtctgatgggcttcccttggtgggtaaccccacctttctctctggctgcccttaacattttttccttcatttcaactttggtgaatctgacaattatgtgtcttggagttgctcttctcgaggagtatctttgtggcgttctctgtatttcctgaatctgaatgttggcctgacttgctagattggggaagttctcctggataatatcctgcagagtgttttcctacttggttccattctccctgtcactttcaggtacaccaatcagacgcagatttggtcttctcacatagtcccatatttcttggaggctttgtttctttttactcttttttctctaaacttctcttctcacttcatttcattcatttgatcttccatcactgataccttttcttccagttgatcaaatcggctactgaggcttgtgcatttgtcaggtagttctcgtgccgtggttttcagctccatcaggtcctttaaggacttctctgcattggttattctagttagccatttgtctaattttttttcaaggtttttaacttctttgccattggttcgaacttcctcctttagctcggagtagtttgatcgtctgatgccttcttctctcaattcgtcaaagtcattctccgtccagatttcttctgttgctggtgaggagctgcattcctttggaggaggagaggtgctctgatttttagtttccagtatttctgctctgttttttccccatctttgtggttttatctacctttggtctttgatgatggtgatgtacagatggaattttggtgtggatgtcctttctctttgttagttttccttctaacagtcagcaccctcagctgcaggtgtgttggagtttgccagaggtccactccagaccctgtttgcctgggtatcagcatcggaggctgcagaacagcagatactggtgagcagcaaatgttgctgcctgatcgttcctctggaagttttgtctcagaggagtacctggttgtgtgaggtgtcagtctgcccctactggggggtgcctcccagttaggctgctcgggggtcagggacccacttgaggaggcagtctgtccattctcagacctccagctgcgtactgggagaaccactactctcttcaaagctgtcagacagggacatttaagtctgcagaggtttctgctgccttttgttttgctattccctgtccccagaggtggagtctacagaggcaggcaggcctccttgagctgtggtgggctccacccatttcgagtttcctggccactttgtttacctactcaagcctcagcaatggtggacgcccctcccccagcctcgctgccaccttgcagtttgatctcgactgctgtgctagcaatgagcgaggctccgtgggcgtaggaccctccgagccaggcgctggatataatcttctggtgtgccatttgctaataccgttggataagcgcagtattagggtgggagtgacctgattttccaggtgccatctttcacccctttctttgactaggaaagggaatttcctgaccccttgcgcttcccgggtgaggtgatgcctcgccctgcttcggctcacgctgggtgcgcggcacccactgtcctgcccccactttctgacactccccagtgagatgaatccggttcctcagttggaaatgcagaaattacctgtcttctgcgtcgctcacactgggagctctagactggagctgttcctattcggccatcttggctccaccaacctctcttttttttttttttttttgagacagggtctcactttgtcacccaggcctgagtgtagtggcacaaacatggctcactgcagcctcaatctcctgggtgtaaggcagtcctcctgccacagcccaccaagtagctgggactacaggcatgcaccactgcatgtggctaatttttgttattttttgtagaaatggtctcaaactcccgagttcaagagatccacttatcttggccttccagagtgttgggattacaggcgtgagccaccacacctggcttatttttcttactttttattttaatttttaagttttatggttacataatatttgtacatatttgtggactacatgtgatattttgatataagcatagaatgtataatgagcaaatcagggaatgaaagtgttagaagtgggcatccttgttccatatcttagaggaaaggctttcagtttttccccattctttgtgacactagctgtgggtttgttgtaagtcttctttattatattgaggtatgttccttctgtactcagtttgttcagggtttttatcatgaagggatgttgactgttactgaatgcttttttggcatctatggaaatgatcatatgctttttgtccttcattctgttgatgtgatgtatcaaatttattgatttgcatatgttgaactatccttgcatccctaagataaatcccacttggttgtgatgaatgatctttttaatgtgttattgaatcagtttgctaggattttattgaggatttttatatctgtgttcatcggaggtattggcttataattttacttgtctttgtctgattttggtgtcatggttaagactggctttataaaattattccctcctctaaggatggtttggaattattccctcctcagtttttttgaatactttaagtagggttggtgttagttcttttttaaaagtttggtagaatttagcagtgaagccatcaggtcctgggcttttctttgatgggagacttattattactgcctctcccttgttacttgctattggtctattcaggttttgtatttcttcatggtccaatcttggtaggttgtatgtgtctagaaatttatcaattttttttaggttttgcaatttattggcatatcgttgctcataatagtctttagtgatcctttgaatttctgtggtatgaatgataatgtctccttttttgtctctaattttatttatttggtctttcttttttttttagtctggctaaaggtttgttgattttgtcttttcaaaaaaccaacttttaaattttattgatgttttgtatttttttggtttcaattttatttctgctctttaatagtctactgaatttgtgtttgatttgctcttgcttttctagttctttaagatctgtcattaagctgtttatttgaagtctttctacttttttgatgtaggtatttattgctttaaacatccctgttagtactgcttttgctatatccagtaggttttggtatgttgtgttctcattttcatttgtttcaagaaatttttaaactttattcttaatctcttcattgacccagtggtcattcaggagcatattaatttccatgtgtttagtttccaaagtttctcttgtcattgatttctgaccttgtggtcagaaaagatacttttatgatttcaattattttgaatttttcgagacttgttttgtggcctaacatgtggtctatctgtgagaatgttccatttgctaaagagcagaatgttctgcagctattgcatgaaatgttctgtaaatgtctgttaggtatatttggcctacagtgtagcttgagcctgatatttctttattttttgtctagatgatctgctcaatactgaaagtcgggcgtgaagttcccgactattattatattgggctttatccctctttagctctaataatattttctttatatatctgagtgctccagcattgggtgcttatatatttacaattgttacaccctcttagtgaattgatcccgttatcattatataatgacttactttttatctttttacagtttctgtattgagatttattttatctgatacatgtatagctattcccgctcttttttggtttctgtttgcatggaatatatttttcagcccttcattttcagcctatatgtgtcttataggtgaagtgagtttctggtcagcagcgtttggttgggtcttggttttttatccagtgagccattctttctcttgattgaagaatttagttcatttacattcaatgtgattattgataggtaaggacttactactgcaattttgttatttgttttctggttgttttgttagtttctctttttttcctttttctctgtcttcctttgtgtataaatgatttttttggtagtatgttttaatttcttgctttttatttttatttattttttttaattttttaattttattattattatactttaagttttagggtacatgtgcacaacgtgcaggtttgttactaatgagcaaaataaccagctaacatcataatgacaggatcaaattcacacataacaatattaactttaaatgtaaatgggctaaatgctccaattaaaaattctcagctttttattttttgtgtatctattataggcttttactttgtttgccatgaggctgcacatgaggctgtgattggaattaagttatcttccgtttaaaataattggttatgtggccgggcacagtggctcatgcctgtaatcccagcattttgggaggccaaggcaggcagatcacatgaggtcaggaattcaagaccagcctgcccaacatggagaaaccctgtcccttctacacatacaaaattagccaggcatggtggtgcatgcctgtaatcccagctactcgggaggctgaggcagaagaatcacttgaacttaccaagaggcagaggttgcagtgagctgagatcgcaccattgcactccagcctgggcaacaagagtgaaactctgtttcaagtaatataatagtaataactattattattattattggttatgttattaaccaattattttaaactgaagataacttaattccaattacaatgaaaataaaaaaacaagccaaaagaaaactaaaaagttctggactttaacttcatccccccctcgctttcgacttcttgtcactttatatctttttatattgtgtatctcctaacaacttgtaattatgattatttttgatacgtttaccttagggtcttcattttaaggtatgagtggtttacataccacaattacagtgttagagtattctgtatttgtctgtgtacttacttttaccagtgagtctgtatttttagatgatttcttgttgctccttaccatccttttctttcagactgaagaactccttttaccatgtctcgtaagacagttctagtgttgatgaaatacctcagcttttgtttgtctgggaaagtctttatttcacctttatgtttgaaggataactttgctggtgatgatattctaggttggaagcttttttcctttagtgctttgaatatgtcatcccactccctcctggactgtaaggtttccactgaaaagtctgctgccagatatcttggaactcttttatatgtaatttgcatcttttcacctggtgtttttgggatcctttctttgtccttcacctttgaaagttggattattgtattccttgaggtagtcttgcttgggttgagtcttctttgtgtcctttaaccttctcatacctgcatattatatcaggcatctatctggtgctttattttattgtgactgagcctgatatctaagttgcaagacagtatcctctgtactctttcctctcctttgcccaagttgaaagatctctccccaagctgcactgcttggagttgggagagaggtgatgcaggtgttcccatggctggtacagttaatgtcgtactgggtcacatcccaagcccactgcttctaagaccagtgcagcaccagggcttgtccaaggcctacagttactatgtcctgattggcactcagatttatttggggccctaagtcactttagtcagttggtggtgaagccagcaggagtcacttttctcccactggggcagaagattcccctctggcccagggctggtctaaatgcttcttttgtgggacctggcagaagtctgcctggtgttgtgtgaggctttgacaaggcagcactgagttccagtgcaaagtcgcatactcattttgctctccctccttcaagcacacggattcttctccagactgcactgcctgggtttaggggaggggtggtgtaagcagtgcaagaccgtacttcctactctcttcaatgccactttcgttgttatgttaaaaccaggtacagtgattgctcctctgattttttagttcttaggagggtgctttcttgcatggatactttatatctttttatattgtctatctcctaatgggggtcaatcattggagggttcaattcagccattttgctctgcctcctcttatgtactgtcaaattcttgctcaggtttttcacatatgatattcagcactcactaggaaataactagatgtacaagaaaaccaagagaaaaatcagaaatagaaacaaacctgttggagatccagatagtggattgatcaaccatgcattttaactaatcattaatcatatattcaaagaattatgattatatggagattttttacgtagaactgactgaaaactgcaccaaaataatcaaatagaaattcttgagctgaaaacatttagtcacagttgatttcagctaacgttgattgagggcctaccatatgctggaatgtatgtgcagtggcagaaagccacagatgacatggtcccttcatcaaggagcttgttgtttagtggaaaaaataaacatggaagaaggcagtgagagggaataatcagctaaatggtaaaaggagagtgtttcagacagtagtgaactctgttaaatgctgctgcagagaagccagtgcagtctgggagaaatacaacttactggatttaatgaaaatattggggatccagcaggaatgattttagtggagaagtgggaggcagatggctgtggtgaagagtgaatgggaggtaaggaaatgaagatgattagacaatttcttcacaattttttttcccttttcataaactctctcttcctgataaccagaagagagaggaacaagctgggtgacaactggaaggaaaatacaggcccaaaagcacaaaaaaagcactgtctgggagggtgggaagcactttctgggggaggcgtggcctgttgggggcattggggccttgattaactatgatgcagggtaggctaggttacaggggactttgaaaactaaccagatggatgggctaaatgctggggacagcgggagccattgcaggtacctgagcagggtgaacttggcggttccaagagttaagcctcagtaatggtgtacaggagagaatagaggcagggagagccacttggtaagcacagagtgagggttctaattagggaacagaaaggaaaagaagcagttttgtccaagaaggcaaagagcaaacaaaaagcaatactcttatgtcttattgctgattagaagatcacgcaaaaggatagtcgaaagtgacatcaagggcctagaccagggtcagcaaacttctgcagagggccagatcataaagtttttttgtcattgcagatcacatggtcactgtcgcagctacttagttctgcagagtagacatgattgcttgtggccagatttggctcaggggcagcagtttgctgatccttggtctagagtgacagcagttgagatctagggtgacagcagtggaggtgggaagtgcatcttttctaagactcagggcatcttttctaagatacggaagtaacaagatgtgctgattggacatgggaagatgagagaaagatcaggattaaggacatgaccaaggtttcaggcaccggatggaatgacaccttcatgacacttgaagaagcctggtgaagaagcagattttggaggaaaatcaaagagttctgcttgaacatgttgaatcaggtgctgtggtccagatgatgtgtcaggtgggcagtgagatatggtatctggagattgcaggctagaatagagctatagatatggcagattgtcagaaaatagatagtgtttaaagctataggagtggatggtgtttcttagggggtgattatatgtagacaggggcaaggtctgagggctgctccaacatggagagagggtggggtaggaccagtcaacagaggagacacagagaggtggggtgatgaggaaagttaaacagtgtgctgtatgcttgaaaggcagggtatcttgtaaagaaagatggtgtcaatgtgataacctgtgtcagatgctgccaagagtgcgagtaaggtgaggactgagacttaggctaactctacatttgggtggtatcatgggctgaattgtgtcccccaaaagatatgtcgaagttttaacccagtgtgccctaaactgtgacaccttatttggaaatataattatagcagatgtaattagttaagatggggtcttactgcagtagggtgggcctttaactcagtatgactgctatcctcataagaagaggggaatttggacacagacatgctcagagggaagacaacatgaagacactcagggagaaaacagccgcatgcccacagggggctggattggagttatgcagccaagccaaggaatgctggggcgactggaagctggaagacgctgggaggatcctgccatggagactcgggagggagcatggccctgctagcaccttgattttgaactcctcacctctaaaaccatgaaagaaaaaatttctgtggttttaagccatcaaatttgtgggatttggttggtaatgccaggagttagagagaaatgaagattcagcctaattggagaaataaaacctataccagataggaatattagtgcatggctttcttaggccagattcagtaatcgcagctgctttatttctacgttgatctctttttcaagtttttctttttcttttttgataaaatatacataacataaaatttacctttctctttgtaggtatatagcccagtggcattaagtacatttacattgttgcgaaaccatcgccattacccatctcctgaatttttcatcttcccaaactgagacctgcatccattaagcagtaattttccatttccccatccccccagcccctggcaacctccattctgttttctgtctctctgcatttgtctattctagatacctcatataagtgaaaccatacaatatttgtccttttgtgtctggcttatctcactgaagaaaatgttttcacagttcattaatgtggtgacatacatcagaatctccttcctttttaagactgaataacatcccattgtaaatttgtacgagattttgtttatccgttcatcagcgcatacttgggttgcttgcccttattggctattgtgaatattgctgctgtgaacatctgttcgagtcctcactttgtttcttttggatacataccccaaagtggaattgctggattctctttcaaagatgaaaaggttttcttgtggcttctccacactgagcagactcgggactgttaagctgttagggtcctctcattcaggctccgagggccagagtgatcagtgccttttctgaggtcgcacagccagatggcaggtgagcccacatccttcttcagatttcagacatgtttcccatgtgagaaggtccagttctaacttctgtggcttgagaattctggactgtagcctgtaggtgatggtcacctgctgatgagctgcagttcaacacaaggagagtctttctggcacaattgctgtccagcaggggagcccactgttgacccaggagttccttagttcagcgtgctcatggacttgcgtaatttcttcccatgcctgtatttcttaccttgctactgtttcttcatagaaaactcagttccttagctgttctggatactggctatgccttccccatgccctcctcattgctgtcattctcccagtcacccctcattcattcaggactcagtcatgctcatcctccttcaccaccccaaggtgacttctgtgtcctcctggatggcacatctagcctcagtctctgtctcatctgcaagaacttttacctcctttccatttccatctccatcatgagttcctgtggccacctcattctgaacttgctgtcacttgaaactaacttcaggcatcccactccctgtctctgcctcctgccctccaaggccttccccaagcactttcaaataaaatggaagcttgacatgaaaatatcttgccataattctgctttattaattctttatctcttaagactgtaagctttatgcaggcagagaccatgaccatgtcttgtttatccatgtacccctgagacaatgcgtagtccatagtgggtgcttgaagactatatgcggaagggaagagggcagtgaggtagttgtgtgtcctgttcagaaccagacttggttctccaggagcatcctgacaaaggatgggggattagaggcacagggtttattcagcacttctcaatttaattctgatgctgaagttaggagagctcagttaccccaaagaagttattcagtgtaatatttaagtcagcactggtatgacactggtatgatcaatggtgtcatttttctccaaccgactttgatttctccctgtcttcctcctccctttctctcccactccatgcactactgatgacctctaaggacacactgtgaggcctttgctggagatgtgggtacagtctcggggggtggggggcacccagtaggtggcgctctaacactgcttgagaactggcttttttttttcctttgagtgttctgttccctttgttcaagtttagaatgcgggaggcaactattagtaagatttctctctgaaacaggaaagtccgtttttgactgaaaaaaacaataagaaaaacaagaacaaaattaggagagtgggcaaatctttatttctcttaagtagactcatagaaacttggttggaggaatcctctgaggctttcagaccagaggcttccaaaccttagcattgccagagtggccttgtgaaaattcaggctcccgaggccatctaggccattaggttggagcttctgtggttaaggtcaggaatgtggtttttatcggcttcccaggagattctgatgtgagcccatcttgccgtacaatgtgggcaccacccatctacaccatttctcaaattctctgtgcatgcagatcacctggggattttgttgaactttaggctctgattcagcaggtctgatagggacctgcaattctgcatttataacagactgccaggtgataactgaggtttgtggtctatggaccacaccactctttgagaagcaagaatccagagccagggttggcagactaggacacacatgcttgagccaaatcagtccatacctgtttttgtaaataaaattttattggaacacaactgtgccccatttgttcacacattatctgtggctgcttttgcactataatggcagagttgagcagctgcaacagagaccatgtagctctcaaacctgtaatatttactctctggccctttacaagaaaaccctatggacccttaatctggaatactcaagctctcccagatgatcacaaactgtattgaaagggagctccttgcctcataggacaattcattgcatttcatagatccgtgggaaggctgctccttgtcacttggttctacttatcttggtaggcatcttttcctccttctgtgaacagatactttgctcgctgtcttctccagggctctccccatgatgggttccctccagctgcactccagaatgtcacccagtgcaaaccacagcacctttggtgctgaatagaagccatgccatctgtattttctgccttctgtaagcttctcagggagtgcacattagctttctggggtagctgttcactcttgactcccgctgtctaggattgtctgtaagtgcggtattacctgaacagcatatagccagaacagacatccttcatgcatctttttactccacttccccagtgcaggatgttcttggtttacctacttcctactttctgactgcttttctccatttcttccaagattctctttttgcctgacccttaaatgttatagggtctcaggcctgttcgtggtcttctggtcttctccttctgcccattctccttggatgatcttaaccatacagttggctttgaccacatatgtgctgccaaatcctgaattgtacagctagattcttttcctttattttcagttatctactacagaccagggcgttttgactgcaggtatctcatgttcaaaatttctcatcttctcaggtctgcctcccacctcactcccgtctgctctgaatctgggactcttcatttatttcacctgaaggttccaccccgtcatgcccttgcatgagctacacacccggcgtgatcctcagttcttctccttttccgtccccctcttctgtgtggacactgaagtgtatgtctcccccatctgttgctctcagatctgtcttctcttcctgcctctctgccacagtgacctcctgcctggtctctctccttcccatgtgtttcttctttgcctctgtagtggttttctggaatatatttgattttgccctctaccagtggtaccccattgtgtatggtgtgggaatttgtggccctcttaattcagtctctgcttacactttttgtgagtttcctagatctgctataacaaattacaacagaaatgtatttcctcctagttttggaggccagaagtccacaatcaaggtgttgccagaattggctccttttggtgctttcagggagagtctgtgatgtgctttcttctagttcctggtggctgctggcagtcctctgtgttcctagggtggtagatgcatcactccagtctctacctctgtcatcacaggcttcttcctgtgtgtctctgtgtcttcatttggccttctgataaggacacaagtcattggattaggacccaccctaatttatcatgaccttatcttaatttaactaattatatttgcaaagacctatttccaaacagtatcacactctgaggttccaggtggtcattagttagggttggggggcagtattcaagccagcacacccttccagcctctgctctgtctacttcctcactcacaggcttgttcatttaccttggtgctctggatgagtgagaattcaacagacaaacacggaggaaaggattccaagcagaggaaagaggattccaaagggccacagaggtgacatttgtgctgagtcttaacataaggctttgttttattttattgccgcactgtactttaagacatagttcaggtgttacctcttttatgaagcttccctgaccacctccccagggacttttctgttccctcagtgcttagtacctacatgttttgatgatttaattatcagcttgtgttcccatctgtcctgtgtaatcttggggcagactctgtgcctagtctgtgggggccgtgcatccagcccactgcctagcacatagcaggtccccaggagatgtttttgagtgaatttacccatctgcacttaatcccctaagatgaggtcacatgcattttaggggaggagttgttcagtccgaattggatggttctttgccttcgatgaggtagagaggatttgaatatggagggaagttgtactgctcaccctctaggttccttccatctggaggtttctgttgttttaactataacccattccagaaacagcacacatttttaaggcagatagactgaaaattgtagttggacagctgcttggtcccacaatgatttgagaagtttccctattcttggaagagctcaatactcactcgaacatcatgcagaatagtgccatcatggcttcaagagatgctgagcatcccaggcctaatgtggagttgacacagcttatgaacaaagctgtttccatctgcagatgcaccctcaaagccctgcagcttttccatatttcttatttgaaattaaagactgtaattttgtgttattttggattcttatttcctgttttactacatttttatagaatcactgaaagttgcctttttattttggtgggaaaaaaataaaaagaggttttagtgtggagaaaaccaagagatgtggcattaaatgatgttattatagtggtgatcaaggtacaaggctattttagggaaatttacaccctatatgtaatttgtttttctaattacaatgagctgtgctgaactattcattgtaccacttattgtaccaaattattgtaccacttgggcatgtttaaaaataccacagactgtaaatagtcactttttaattcaagggaacagttcgaagtgaaatgccattattcaaatagctttgaaacaaaagtgacttatacagatgtttcacaagcccatgttagaaaaagttttctccctgtggttcccagatagaatgcctggctttcgtggttatggaagcagcagaaactctgtgtcatgcacttatgtttttaaactaatgggcacccttctgattgggcaagaattaaatgaacattccttctccccacagccagctatgaattatgcagccaaaattcagctaatcacagcctgctttgtgtgtcattgtgtagcagccctttgcaaattgggttaatacttttgaaacacctcatcccgtgccagaatgccaaagtaaagcagctgtcttggtaagagggctttgcaaagttttggggtcatttgtgcttatttctgtcttgcgtctggggcagagattccttatgtgggtctgtgatagtgacaggaggcctgcaaactaggataggaaaatatatgacagctttattttttattcacttccaaataaaatttagcattaagaaagtttttatgtaggcaacaatccatagtgatattagcagtacctgtgagtttgtcacccacagaaaatcacagatatcctggaatatcgtttactcttcactacttcaaagtttcaatagctgttagatcatctgctagatcctaatttaagtatgaataaagaattggatgcaaaatattaatattttggtaactgtatatcagtgctctatttcctttgtgaacctatatatatattattttatgcatttaaaaacaaggaaagattgaagaactgtcacaaaaccaaggagtctagggagacatggcaactaaatgcagtgagtaccctggattggatcttggaacaggaagaggacagtaggggaaaaactactactgtactttacaaataaaagtctgaagtttagtttctgataatgtgccgatgttggcttcttagtcttaacaaatatatcacagaaatatgagtcattagcaatgggggaaactgagtgaggggcttatgggaatgctctgtacatctgaaattacagtgagggccatgttgtgggggctgccgtccactcccagaaatgttttgaggggagggtttcatgtcaacttacggccatcatggcctcgtccattacaactctgagaaatggtggagatagacccatccaaaagtaaggagaagttttccagaggagtaaagtaattgagagtgtgttagattggaaaaagatgtctctggggtcagagaggttggcaacatagtctgactctcacttaccagctttgtgatctggggccagaaactgctcccggctttctcttcccatttgcagaatggagccatctatagagtccctgccagggttgctgtgaggactgaacataacgtgtccacctagctaatctttttgtggttacctggagtgtttgagtgcctgttctatgccaggccctttgctaagcattttccatcaattatctcctttaatcttcatgacacctctattccatgaccatttcatacataaggaaactgagggtcagagactttgaaaactaaccagatggatgggctaaatgctggggacagcgggagccattgcaggtacctgagcagggtgaacttggcggttccaagagttaagcctcagtaatggtgtacaggagagaatagaggcagggagagccacttggtaagcacagagtgagggttctaattagggaacagaaaggaaaagaagcagttttgtccaagaaggcaaagagcaaacaaaaagcaatactcttatgtcttattgctgattagaagatcacgcaaaaggatagtcgaaagtgacatcaagggcctagaccagggtcagcaaacttctgcagagggccagatcataaagtttttttgtcattgcagatcacatggtcactgtcgcagctacttagttctgcagagtagacatgattgcccaaggccgcaatgctgagcttcaattcagatctgcactgactgcaatttacggtcttcctaagtcttctgctgaggctaagccacctctgaccaactggtggtcctggttactggggtgctcctcaccctctctgacgtgtgaatcccctcttgtttggtgtgtgtctgcaccctgatgtggatgctctcctcttgattcccttgcccgttgtggatggcctctctgagcccaagtttatccaactatacgatgagggtgttggactgccttcaaagtctgttccacattcattctgcattctgtgaattcaactgcttatttcagctgtcttattgggatgattactgaatcactgaagtcgaagcttttctaatttgttttgggggaagttacatgtttctttggcattttcccagattccagagtagggcaaaaatggagccgtatgccttagttgcttcttaaaaccataaaagttaacaaaaacccagcagaagccttcgtgatagctgcaggtttcttaactgggattttgttcagggaacgggagtaattttatttttttattttccttctgtgattagaacgtacacaccatgtgtcaccatgcagttgctgattacttcaaattaatacctatggaagaaaaaaaaataggtagttacctgtgacaggtattacctggacaggggaatttagccataagaagtagttattaggtaatgagcccaatttccacaatacacatttgtctcaagatgtgagaaaatgagagcatcacttggcgccataggttactgcatggggggtttgttaagcccatgatttgttctcttgtttttcagtttttcccctacatcctgctgctctttgcgatcctcctgtacctgcccccgctgttctggcgtttcgcagctgctcctcatatttgctcagacttgaagtttatcatggaagaacttgacaaagtttacaaccgtgcaattaaggctgcaaagagtgcgcgtgaccttgacatgagagatggagcctgctcagttccaggtgttaccgagaacttagggcaaaggtaacttagccccagcaggcagctcatcgggttttgtaggacaaattctctgcccttctactgccagtctgggcccagagttctcattgctaggaggcggggcaggagtggaagcagggggacgtcatgcacctagtgacagcctgtagtatcccgggatgtccactctccccaaatctcaccgcgacccatcctacccatttgtttatccttctgtcaagactcattcccttgatgagtgaaacattacatctcattttaaaaatgcagttcttgtaggggtaacagattgaggtgctatatgaagcttgcttgctttgatctatttaactccttaatggagacgcacagaggatttcaaggcagctgagcaagggatgagagagaaatggggaatgagtaggtcgtggcttgccttttcacaaccttcttttggttcttgttattgaataattggaataataataagagccatcattttttgaatatttaatatatctcacacaccgtattgagttatttaagtacattatctcctttaaccctcagagcaacattactagtgcatttgttaacctcctcctccacttttattctggataaaaatactcttctgtagctgtaagtgagagtctgggaactgaaccatgccctttagaccccatagtttttgcccataccccctgagttgtcccaccccttgcctgtaagaggcgtatgcttacacatatttaggatttaccagatgccaggcatcactctaaaaatttccaaatattaactcatttaattaactaggccttctgttaaatattaaggggaaaagcattttattattccttttcttcctcctcttttaaacggattttatttttgactactgacgttgtaggtaaagaagtatgggtgtttgaaatttttagtgtgacattgttgaatgtgtatctgcctttaatatttgatggtcttgatgagtgcctaagttatttttgtttcctttattttttagtttgtgggaggtatctgaaagccacttcaagtacccaattgtggagcagtacttgaagacaaagaaaaattctaataatttaatcatcaagtacattagctgccgcctgctgacactcatcattatactgttagcgtgtatctacctgggctattacttcagcctctcctcactctcagacgagtttgtgtgcagcatcaaatcagggatcctgagaaacgacagcaccgtgcccgatcagtttcagtgcaaactcattgccgtgggcatcttccagttgctcagtgtcattaaccttgtggtttatgtcctgctggctcccgtggttgtctacacgctgtttgttccattccgacagaagacagatgttctcaaagtgtacgaaatcctccccacttttgatgttctgcatttcaaatctgaagggtacaacgatttgagcctctacaatctcttcttggaggaaaatataagtgaggtcaagtcatacaagtgtcttaaggtactggagaatattaagagcagtggtcaggggatcgacccaatgctactcctgacaaaccttggcatgatcaagatggatgttgttgatggcaaaactcccatgtctgcagagatgagagaggagcaggggaaccagacggcagagctccaaggtagggtttgcttttggcagaggctacgggagtctaccgagagcctttgcagcagccttgtgggaatattgacagtctttaccctgcccatcatttaaaccatttccaagcattaaaaaccttaataccaaggtgcggggtagggggagtgggaacccctcagtataaggagagagaggaaaagaattggtgctgctctacatttccaaagaagaataacttctgtgctttttctggtttttccctcttctctgtctgtctcacactctctcttgctcagcaatcttccttgtctttcttgcttatttttgtcttatcttactggctttcctttctacctctgatctccttctctgttactctctgactttctctttcaaaggggactaaaagtttattgattcttttagttaggccaagaagcaaaacatggtatagactgtgagaggaatttttggcagaagaaaaattgattagtattggtaattcctgctatgtttctgtcataaatatttgttttcaattttgacaggtatgaacatagacagtgaaactaaagcaaataatggagagaagaatgcccgacagagacttctggattcttcttgctgatgatttttttccttgagctgtaaatctgtgacttctgcgacatgggatttaatttggctaaagcacccctgttggtttcacagctggtttgcaataaatggttcttggtggagatactgagcatgtcttattgagtccctaatggaaatggtgatcaacaaaaggttatggaagaatggtttatgaacttcccataggaagcacctgagagatagtaaactgcagcaagtaactatgtgtaagtcctcatcaaatgaaaagcagaaagacaagaacaattagtcaagagcagtagccctgtcagagcctcggagcaatacctttctgtacccgtggtgagacaagacccagagctactggaaaacaagcactttggaagatttgttttgttttcatggaataataatatgtcagggtataatttaacgtgagtttcttatgtgcccttaaagactgttagacaagaaaagcattcactggctaataatccataggtcgacctatgtcctaagttaggtgtaaggtccgatgccttggcccacactcgagctctctttacattgttagttgtcaaccttggctgatggaaatcccgtaaccactatttgttgcactgtgccttgaagggcagcaggcccaagtgctgctctgactgaaaactgagttaacaagatgaaatctaaaggatattcacagtgacttcaattcaggaagaatgcttccaaaagagcccagtggggaaatctgacatcacagaagacattaattcagtcactttcaaagagtttgtctacaggcggtttctctgttatcaaaggcatttgaaataggattttacttaaacaataatggaacacaggagtatttaaagtgaagaacactttgcctgaatgtgatcagggcacataagtgacattggcatgcttcatatggcgtgcttggagccagaaaaacttagcggtttattttgtttatatttaagcacagctttaaaaaattcattatcgtttattcagtgtccgaattgaggccatttgggaagaaaattctagcactggtggagaattatagaataaagattataaatggttggataagacaa

SEQ ID NO: 760 - DNA, 45559 bp, Homo sapiens
gctgcactgaaaatgttttatacctgaatggttatcattgtcatcatcatcaatccatctcggttctgatatctgcaggctggtcattcagatctaagaagataataaatatgcttgctaaatgtcaaaggaaacattgggagtctgcttaatgcctctggatcatgcaatttaaaatggttggctgggcgtgatggggcacacctgtaatcccagcactttgggaggccgaggcagaaggatcgcttgaaactaggaatgtaagaccagcctaggcaacataaccacaactctgtctctacagaaaatctaaaaattagccaggcatggtggcacaggctgtagtcccagctatttaggagcctgaggcagaaggatcagttgagcccagaagttcaaggctgaagtgagctatgatggcaccactgcactccaggctaggcaacagagcaagaccctgtctctaaaaaataacaataataaataaatgcaatggttaatgttatgttatgtgtattttaccacaatttaaaaagcaaacattggccgaggacagtggctcacgtctgtaatcccagcactttgggagagcgaggcaggtggatcacctgatgtcaggagttcgagaccagcctggccaacatgatgaaactccatctctattaaaaatacaaaaatcagctgggtgtggtggcacatgcctgtaatcccagctactcgggaggctgaggcaggagaatcgcttgaatatgggaggcggggtttgcagtgagcggagatcgcgccactgcactctaccctgggagacagagactctgtctcaaaacaaaacaaaaagcaaacattaaagaattaacctccttctgagctccctctgccaaaaaaaaaatttaaaaaattgtccgtattattatttgaaataacagcttccttacctggggccagaaacaaatggtcagcagcaatggctgtgtcagtgctgggttccagagtttcttctctgtggaactgtctagaatgccaggcccctgtttcaggctgggctcattgaatagaggcggctagggagggaggaggtggagacgcccggccggccgctcaggtctgggccaggttctcagccggatgcactggcttgctgttgggtggcttaacgactgctattttcagtcaacagaagtcagaacagctgctttccatttctcccaggaagtcttcctgggccacagcagcacttatcatgccagggtttgtttagtttgtttacagtgttccctctcctacccctgaagaaaattctagtattcagaaatgtacatagaacaatataacaaacacatggtacccaccgctcaggactagccattgctaacgatttcctctctttgctttgagtctttttaatttttttatttttattttttagaaatatggacttcattgttttgagatggagtctcactctgttgcccaggctggagtgcagtggcacgatcttagctcattgcaacctccgcctcccgggttcaagtgattctcctgcctcagcttcccgagtagctgggactacaggcatgtgccaccacgcccggctaatttttgtatttttagtagagatgggttttgccatgctggccaagatggtctcgaactcctggcctcaagtgttccgctcaccttggcctcccaaagtgctgggattacaggtgtgagccactgcacccagccaagtctatttttattcttaaagaagtaaggtattgcatatcttcatgcttttgtcttcaatacccagacaaactccaacatgaattggttgtgtagccttccaatctattattattattattttattgtttagagagaaggtctcgctctatcacccgggctggagtgcagtggcacaattatgggctcactgcagccttgaattcctgggcttaagcgattttcccatcccagccttcggagtagctgagactataggcacacgccactacacctggctaatttttcttcttcttttttttaaagtttttagtagagatggggtctcactatgttgcccaggctggtcttgaactcctagactcaagtgatccacctgcctcagcctcccaaagtactgggactacagttgtgagccacagtgctcggcattttttttcttaagacagggtctcactctgtcgcccaggctggagtgcagtggcgccatcatggctcactgctgcctcaacctcccaggctcaagcaatcctcccgtttcaggctcctgaggagctgaaactacaggcgtgcaccactgtgtcctgccttacaccagtacttcttatttatttatttattttttttgagacggagtctcgctctgtcgcccaggctggagtgcagtggcgcgacctccacgcactgcaagctccgcctcccgggttcacgccattctcctgctcagcctcccgagtagctgggactacaggcacccgccaccacgcccggctaatttttttttgtatttttagtagagacggggtttcactgtgttagccaggatggtctccatctcctgacctcgtgatccgcccgccttggcctcccaaagtgctgggattacagacatgagccagggcgcccagccacactgatacttacattggctaatttttaattcttaattgttaatcccagtggagcaacggtccttaactcagggccccctgacagaggaattgtaaaataccacacgtttcccacaagttgcatacaatgctttatgtgcatgggtatttttctgaggagagttcctagaattttcatcaaatttcccaagaaatttatgaccccaaaagttctggaacaaaaccctgaagagccagggccatcgggcttaaccctcctctgtgctgtttccgttttctcaggtgtggcttttgaacctgccgacacagagtgaggttgacacagaccagtccagtcgacaggggagctgcagcagatagcagggggcatggggaaggggctctgcctcgcaaggtgctttgtgcacatcttcaccctgaagtcatcaccagggtccctgtgggctcctaggaccccaagtcacttcagagacctctcatggctcagcagctgcctcaggcattgacttgggctgagtctgccatcttcctgggattggggtcgtctttagccctggcaagttggaaactgaaatacactctccagacgaaggcagcagcagggagtgtggggacctgggttccagccttggccattctgctaaatacatttataaccctgcagtcatttcttttctctgggcctcagtttccctgtctgttaaatgaggtgattggactgtgttcattgttttcacactatgttacggcatatcgaagagttcaatcattcctttctttttcaaattttgtagagacagggtcatgctctgttgcccaggctgcagtgcagtggcacgatcatagcccatggcagcctcaaactcgtggactcaagtgatcctcccacctaagcctcccgagtagctggaattacagacatgggcctctatgctcagctcaaacatttctttaatggctgtttactgagcacatactatgtgtcagccactgttctaggcactggggaatacagcagtgatgaagacaaactctaatgtgggaaagaaacaatgacagagtaaactaagtcctggcgccaggactaagccagccctggggtgccgtgctcctcttcattctctctcatccctgcttgttttcctcatctgtctctctggccaactgtgctgttcccaaagccctcgactgcaattactttctcctggtttacccagcacactgtgtgggacagaaggaggacagtgacatttgctaaattaattgtaacagaaaaaagtcagctttaaaagtcataactctccacacccaccaggatggtgacaattttatattgtttgtttttgagacagagtctcactctgtcacccaggctggagtgcagtggcatgataccagctcaccacaacctccaccttccgagttcaagcaatcctcccacttcagcctcatgaacagctgagaccacaggtgtgtgccaccatgcccggctagcagtttttggattttttagtagagatgaggtttcaccacgttgcccaggctggtcttgaactcgtgggctcaagcgatctgcctgcctcagcctcccaaagtgctgggattacagatgtgagccactgttcccggccctggatggtgataattaaaaacaaaaacaaaaccagaaaataacaagtgttggtgaggatgtggggaaattgcaaccctcatggattgctggtgggaatgcaaaatggtgcagccgctgtggaagacagtctggcagttcctcaaaacgttgagcacagagttctcatgggacccagcaattccactcccaggcatctacccaagagaggcgaaagcaaactcccacaaaaaaaacatgaatgttgggccgggcgcggtggctcatgcctgtaatcctagcactttgggaggccgagatgggtggatcacgaggtcaagagattgagaccattctggctaacgcggtgaaaccccgtctctactaaaaacgcaaaaaattacctgggtgtggcggtgggcgcctctagtcgcagctactcgggcggctgaggcaggagaatggcatgaacccgggaggcggagcttgcagtgagccgagattgcatcaccgcactccaacctgggcgacagagcgagactccgtctcaaacaacaacaacaacaacaaaacatgaatgttcccactattagcagcactaatagcagtactattcacaatagcccaaaggtggaaacagcccaaatatctatcaacagatgaatggataaacaaaatgtggcatagccatacaataggatatcattcagccatgaaaaggaataaagtgctgattcatgccacaacatggttggaccttgtacacatgatgagagaagccagacacgaaaggccacgtagtatagggttccatgtacatgaaaaggccagaggggccaatctgcagagccagattttagaatgctggcggccaggggctgtgtggaggaagaattggggagtgactgttaatgggtatagggttttctgttagggtgatgaaaatgtcctggaattagataatgatgatggttacacaacatcataagtgtactagatgtcactaatgataagttttatattgtctgcatgttgctgcaataaaaacaattttaaaaacattaggctgggcgcagtggctcacacctctaatctcagcactttgggaggccgaggcaggtggattacttgaagccaggagttcaagaccagcctggccaacatggtgaaacactgtctctactaaaaacacaaaaaaattagctgggtgtggtggcaggcgcctgtagtcccagctactcaaaagactgaggcaggagaatcgcttgaaccagggaggcagaggttgcagcgagctaagattgtgccactgcactccagcctggatgacagagagagatcctgtctcaaaaactaaaacaaaaaaccctgccaaaataaaacaaacaaaagaaaacattatatctctagctgggcgtggtggctcatgcctataagctcaacactttgggaggccaaggtgggaggattgattgaggccaggggtttgagaccagcctgttcaacaaagcaaggcctgtctctacaaaaaaaaaaaaagcaaaagaaaaaattagctgggcatggcgatgtgcacctgtagccccagctactctgaaggctgaggtgggaggatcacttgagcccagaaggttgaggctacagtgagctgtgatagcacctctgcactccagtctgggcaatagagcaagaacctgtctctaaaaacaaacaaacaaacaaacaaaaacactcctatcttaaatgtaatgtgggacactggaacagaaagaggacattagtaagaaaactagtgacacacaaatacagcttgcagtttcactgatagtgacatgctatgttggtttcctaattgtgacaaatgtaccccagtactgtgggattttaagagaagagaaactgtgaggggtggggcataagggaactttctgtattgttttgtgacttttctgtaaatctaaaattatttcaaaattaaactttttttttttttgagacagtctcgctctgtcacccaggctggagtgcagtgacgtgatctcggctcactgaaacctctgcctcccggattcaagcaattctcctgcctcagcctcccgagtagctgggactacaggcgtgtgccaacacgcccggctaatttttgtatttttagtagagacagggttttaccatgttggccaggctggtcttgaactcctgacctcgtgatccacccaccttggcctcccaaagtgctgggattacaggcatgagccactgcatctggcctaaacattacttttttaaaactcctatgtacctcctaaaaagaaggtaattcggtctctggaaggttcttttgtctgcctatggcgcacttttgggtgtgggtttacaaatcaaggcactggagctaactccataggagagggagaagaatctggaattctcagcctgaaagtgcagggatgagaagagacaggcagatgggagaggagcttagactggaacggggctgggctggggccaggaagccccttgcgagggactttgcagaacaggaatgtccaacactgacgctacaaactagagatgcacaggctggagaccacctctacacatgtgcttgttggtcctcggttttgtcaaaataatttgagccaatacataaaaaacagctgatctcacatgaaaattggaatttccaacttctctggaaacatctgaagatatgctaagtctctgaaaacttaaccccctctgcttcctaaaatcaaaaaggaagtcctgaggttaacttcaaccaaggttgcaagttcccctctgtagcaggctgagtggtggcccccaaaagcttcccttgtcaaacccctgaacctgtgaagtgaccgtatttggaaaaaagggtctttgcagatgcaaaggaccgctagatgagatcagcccggattatctaggtggcctctaaatccaatgacaagtgcttttataagagaaagacaaggctggccaggcgcggtggctcacgcctataatcccagcacttagggaggccaaggtgggcaggccatctgaggttaggagtttgagaccagcctggccaacacagtgaaacccatctttactaaaaatacaaaaatgagccgggtgtggtggtgggtgcctgtagtcccagttactcaggaggctgaggcaggagaatcgcttgaactcgggaggtggaggttgtagtaagccaagattgtgccactgcactccaatctgggtgacagagcaaggctctgtctcaaaaaaaaaaaaaaaaattgaaatactactctaccagttggcacagagccctcctcctgggaccccagagttcttcacaattcagcaagtaagaataaccaccgcaggggtcttcctgtgtccgggcccaaacctccctgctgattgagctgtcctcctgggtaatatttctttactgcatggattggggtgggtgtcgggtgcctgggccccgatggaaaagaacaggtggcatttgttgggcctcagttcagctgtcccgggaagcacagaggcccctgggatttcaaggcaacgtctctatccccctgcgcaatccccgtggagacaggcagacaggaatgtctacaccagagaccctgggatgggaggagtgcagatggggctcccagacacagggggaggccctggaccacccaaagtctctctgcaactccaccagagagggctgagaggagagccgtggtctggtggaaaaacctaactgggcgatgaggcagttggcccaagtagaagtcagaggttaggggtaagaggtagtacactttattgaccgggttctctcaacatgttgcaacctctggcaaagccagatcctgggctttgccaccatcccatccaccaaagacagaagagaatgcatctcatgaacatccacgtggcctccagacagcagagcacaggggcgggtgtggggagggaggctgccagccaggggtgggtggacgaggggcgaaagcgctgggtgccgggctgggggcacccctgaggcccctccagacctggccagcccctcactcccccagttgaggtttcgtgtggttcacagtgagactggcttagattggcagcgggcgatggcagacagatgccctccacgctccctacccgccctggccagactcacagagctggcaagagggagagacggaaaatcccgttccccgtgtctccctccgggacagggaagccccttctctggaggggtaaaggggagaggcctagtctctggacatcccccaggctactaaggaagggccattcactcctggctcagaagtttctagaacatcttggtgaaagtgcccgccattactcccaattagaaaaaggtttttgaaatctaggagttgactggggtgcctcaaaccaaacagtaaaaaccctggtaagacctaggtttaaaaaggcagctctacctttgcttaggaggctagggaggtccgtgaaggcgttggctcagggcagcaggggtaaggagtgccctgggaatggggcagggaccaggggcaagatgcaggaagcggtgatccatgggacatggcaggtcgtctttcagtgctgcaggcctgggctcggagggcagctgggggcctccgtgggcacatctgccaggcaggcaccgggtcctctgccccaccgggagaagcaggggccccccatcaggccttgtgactgccgttggctacaggctcgttgtggccagctgtgaagtctgcggcgggctgaagccccagcatctgccgctgcaccagcttggcgtagaggccgccctgggccagcagctgctggtgggtgccctgctgcactacgcggcccttgtccagcaccacaatgaggtgcgcgtgctccacggtgctcagccggtgcgcgatgatgagtaccgtgtgcttctgcaggttgccatggatggcctgctggatctgcggggacagtgggggcctggcttgcatggcacggacgccccacccgcaaccgtgcttcatgccacggcctatgggctgatgcttaacctctctgaggctcagttcacaaacgatggccagcttcctgggtttttcttaaagggagacagctcagggccagacacaatgaggcacctggtgaatgggggatcagctctaccctggccctccagtcttctggtccttcccttccccctcctttttttttttttttttttttaagtcttgctgtcacccaggctggagtgcggtggtgcgatctcagctcactgcaacctctgcctcgtgggttcaatcgagtctcacgcctcagcttcccaagtagctaggggattacaggtgcccgccaccatacccagctaatttttgtatttttagtagagacagggtttcaccatgttggccagactggtctcgaacacctgactttgtgatccgcctggcctcggcctcccaaagtgctgggattacaggtgtgagccaccgcgcctggccttccttgtttcttatctgccttccccactggaatggaaacaccatggggacaagggtctttgtctagttagcccacgataaccccagaatggtgcctggtgcctggtgcctgagaagagctcagtaactctctgtgtaacaaatgaatcaatccgcgcatagactgaggttgctagccatctgcaaatacatgactgggcccacctgaccagtgagaatgcgactcagaggggaagcactagcttgaggtcacacagttataaactgtaggacggagctgctaatccaggtatccccattctgttttttgtttttgtttgtttgtttgttttttcagatggagtctcactctgttgccaaggctggagtgcagtggtgcaatctcggctcattgcaacctctgcttcccaggttcatgctattctcctgcctcagcctcccaagtagctaggattacaggcacctgccaccatacctggcggacttttgtatttttagtagagatggaatttcaccatgttggcccggctggtcttgaactcctgacctcaggtgatccacccgcctcggcctcccaaagtgctgggattataggcataaaccactgcgcccagcctttttttttttttttttgtagatggagtctcactctgtcgcccaggctagagtgcagtggcacaatctcagctcactgcaacctccatctcccgggttcaagtgagtctcctgcctcagcctcccgagtagctggggttacaggcatgcaccaccatgcccagctaatttttgtatttttagtagagacagggtttcactgtattgaccaggcttgtctcgaactccggacctcaagtgatccacctgccttggcctcccaaagtgctgggattataggcatgagccatcatactgggcctattttattttgttttgttttgtctgtttgtttgagccagatggagtctggctctgtcgcccaggctggagtgcagtggcacaatctcggctgactgcaacctccacttcccaggttcaagcaattctcctgcctcagcctcccaagtagctgggattataggcatgtgctaccacacctggctagtttttgtatttctagtagagatggggtttcaccatgttggccaggctggtctgcaactcctgacctcaggtgatccacctgcttcggcctcccaaagtgctgggattacaggtgtaagccaccactcatgacccaggtctccccattctgatgccttctcttgccccacaccatacagctctgcctggagcctggaggctgggtccagagtggctcctggctccccactctcaacaccaggaattcaccagcccaggaggctgatagtctgggagagctcctggggcccgtctcttctcagcatccatctgctgggcgatgggggctctggccacctggagccgctcctgcccccgcattgcccaccaccctgtgactcaccagatactcgctctcggcatccaaagcgctggtggcttcatccaggatgaggactggggggttccgcaccagagcccgggccatggccacccgctgcttctggccacctgacagctgggcgcccttctcccctgtctctgtatggtggaggcacagagacaatttagcaatgggtgaggccgggcagcaccggggaagagtgagaggccctgccctgcagctgtggaaagggcgggctggaacccacaacttgaaagctcatgaaatgatgttccccccacccaactcataaggggcatgcagattaagcctacatgcaaattgatagcaagttaccaattttcactcattcatttggcagaaacccaaacatctgatagcacacagtgcaggtgaggctgcagggagacaggccctcacccgtcctcctggagaaggggagttggagcgagccccatggcttgaagagctgcagcaataaccctgggtctatgagtctgtgcagtgcaaaggttgtgtgtattcaccacagatgtgtggcctgtggccccgcaagcccacctggaccaattttccccatggaccgacttcctcccatgcacaacaatatagacacaggtcacctgtgacccacagcgctgttattgcaaaaaataaaacaaatagactcaaatgtccatcaataggaaattgagtcaatcaattattattattttagagacagggtctcactctctcacccacgctagagtgcagtagtacaatcactgcttactgtagcctcaaacttctgggttcaagcaatcctccagcctcagccttctgagtaactgagactacaggtgcatgccaccacacctggctaacttaaaatatttttctgtagaggtggggtctcactacattgcccaagctgttctcaaacccctggcctcaagcgatcctcttgccttggcctccaaagtgctgggattacagacgtgagccactgcacctggccacgccaccagttctttattatttcatttttctttcattgagatgaaactgacataacataaacataaccattgtaaagtgaataatccgggctgagcacggtggctcccagcactttgggaggccaaccaaggtgggcgggtcacaaggtcaggagattgagaccatcctggctaatatggtgaaaccctgtctctactaaaaatacacaaaattagccgggtatggtggcacatgcctgtaatcccagctactcgggaggccgaggcaagagaatcacttgaacccgggaggaagaggttgccgtgagccgagatcgcgccactgcactccagcctgggcgacagagcgagactccatctcaagaaaaaaaaaaaaagtgaataatccagtggcatttagtgcattcacaatgttgcacaaccaccacctctactgaatttcaaaacactattctaaaataatatatatttattatatcaattaattactagaactacttaagttcatatcgaggtaatttttttaaaaattagtgtatttagtatattttaatttaaaaattcttttaaattgacaagtaaaaatagtttgtatttaatggtgtacaacgtgatgctctgaaatacatatacactgtggaatagctaaatcaagccagttaacatatacattatctcacatatttatcacttttttaaagagagaacacttaaaatctactctcttagctattttcaagtacacagtacactgttactaaatatagctggccagacacagtggctcacacctgaaatcccaccactttgggaagccaaggcaggcagatcacctgaggtcaggagttcaagaccagcctggccaaaatagtgaaaccccgtctctactaacaatacaaaaaaaaattagcaaggtgtggtggtgggcacttgtaatcccagctactcaggaggctgaggcaggagaatcgcttgaacctgggagacggaggttgcagtgaggcaagattactccactctactccagcctgggcgacagagtgagactgtctcaattaaaacacaaacaaacaaaaaactatagtcaacaggtctcttgaccttattcctaagggaaaatttttatcttttgatcaacatctccccaacccccctatacattgtatatatttaattattgaaaaggggctattcgtgtggttcaaaaatctaaaaatacaggctggatacaatggctcatgcctgtaatcccagcactttgggaggcaggaggattgcatgagcccaggaatttgagaccagcctgggaaacatagcaagaccccgtctctacaacaaaaataaaaagtggggtggaaggatggcttgagcccaagaggttgaggctgcagtgagccgtgatcacgccactgcactcccacctgggtgacagagcaagcccctgcctcaaaaaaaaaaaaaaaactaaaaaaactaaaaatatataaaactctaaataatgaaaagtttaagttctttcttcagttccctcctgctcccaccaaaacgtctttcattagttgcttacatgtccttgtctagtttctttatgcaaatatgaacatgttatttttatctccccagtcctttaataggaaaaaaaaaacccagctccttatgctctgcacctggctcttctcactcagcatcctatctcagtgacctttccatactgctatatggagagctgcctcctcctctgcctccacctcctcctccgcctccacctcctcccccttcttctacttcctctttttcccagcagcataatattccagtgtatgggcttctataataatttacttaataaatattttgctgagtcacagcacagtggctcatgcctgtaatcccagcactttggggattgcaggaagattgcttgagcgcaggaggttcgagtctggccagggtaacgtagcgggaccccatctctacaaaaaaaagagcaggtggcagggggcagtgcttaactcagagggttatgtccctgagggtgaccctgtgggcccaggagaggggccacccccagctccacacctgtgctgtagccgtcctggagttccatgatgaagccgtgggcattggccttctgtgcggcctccaccaccatctcgaaaggcacagtgggcaggccgtaggagatgttatccgtgatggagcgggcgaacagcacgggctcctggctcaccagggagatctggggaggagggagcatggagcatgagaggccaggaatgtgttcatccagctgtccccagcagccttgctgcctggggcctggagacaccagcagtctcaggcctgaaacctgatcagggcccagtgactgcactgagctgcctctcttcttccccaacagtgactcccgcctgtacccacaagccctcagcctcccctaatcagcaaactggggcctgctacatttgctgctctgggataagccaagttccctgacctctaagagaaagctcactggccatccctgtcctgaaaaaaagaaagagggatagaatatagaatgttgctgtgaatgagtctgctcatctcaggaagcaagaggccacagcagggctccaggtcacacagactgccctggcggtggtcccctcccttctaagagaacaatttaaaggagctatcatctctagattccagtttcaggaatctgggcctacaaaaataatagtatggccaggcctggtggctcatgcctgtaatcccagcacttagggaggcagaggcaggagaatggctttagtctaggagttcaagaccagcctgggcaacacagaaagaccccatatctacaaaatgaaaaaaatatatagtatggaagatatcattgcaacaccataagtagcaaaagttaattagttaattaattaaattaaaatggaaacaatctaggtgtccataaatggggattggttaaatagtgacagtgcatccttaaaactgaattgtaatagatacatatacacagcatgattctatttttgtttaaaaaaattataaacgtgtaccttcatatattgatatatttctataaagataggaaacacattgaaaaggatatttactaaactgttaacactggctacctccatgtggtggaattcaaaaggtaaggtggaggggaacattcatgtcttagttacaagattcattacaactatgagaatatgattagcttgtagcattttattgttttatgtttatagaaattaacattttaaatttaaaaatagaggccagccatggtggttcacacctgtaacaccaacagtttgggaggctaaggtgggaggatggcttgagcccaggagtttgagatcagcctgagcaacacagtgagaacccgtctctacaaaataattaaaaattggccaggtgtacacggtggctcatgcctgtaatcctagcactttgggaggccgaggtgggcggatcacctgaggtcaagagtttgagaccagcctgaccaacatggagaaactctgtctctactaaaaataaaaaattagctgggtgtggtggtgcatgcctgtaatcccagctactcaagaggatgaggcaggagaatcacttgacccctcgaggcggaggatgtggtgagctgagatcgtgccattgtactccagcctgggcaacaagagcaaaactccatctcaaaaaaaaaaaaaaaattgaccagatgtggtggtgtgcacctatagtccctcaggaggctgatgtgggaggattgcttgagcccaggaggtcgtggctgcagtgaaccatgatcacaccaccacattccagcctgggtgacagagtgagatcctatctcaaacaaaaagtacataaatagtccaggcgccatggctcactcccagcattttgggaggccaaggcgggtggatcacttgaggtcaggagttcgagaccagcctggccaacatggtgaaaccttgtctctactaaaactacaaaaaattagccgggtgtggtggtatgtgcctgtagtcccagctacttgggaagctgaggcaggagaatcgcttgaacccaggaggaagaagttgcagtgagccgagatcatgccacagcactctagcctgtgcgacagagcgagactccatcttaaaaaaaaaaaaagaaaagaaaaagtacataaataaataattaagagaggctattcatgaaggaaaaccaaatggccaatatatgaaaaggtgtttaatatcttcagtcatcaggaaaacacaaaagaccacaataagctaccactacattctcaccagttagcaaaaattcaggactgacaatgttaggtgtctgagaatcgaagcgtggtacctactgcaaagtgtgaacggctctgcccagggggctcttctaaaactttggtgagcagcagcctggtggcctcccacttggcaccatttcacaacaatctacctctggttacatgcacatggtgtgggcagatttcacaacccatggccctcaccaccatctcgaacttggctaggagttctggaatctctgtgccaacactcaggctttcacataatttatgttgatgatgtaaacggtgctcccttaatagtttatatttcttggacagtgcacaacctgagcaaccatccagggcatccctgctcttaggccagcacagggacaggtgttatggttcctttcctgaaaggattactaaaaactgtccagtcatgaatagcctattttgagtactggagatgacctaaatgtggaacagctgaaactctccttcactgctagtagaatgtaaattgtaaaatgtaaattggtataaccacctggggatagctgttgtgacagaaactacggcagttggggatgtacatccactatcaccaagctttctactcttaggattataccttgggagaacgtactcatgtacaacagaaaacatagacaaaattgtccacatcccacactggtatttttggtaatggtaaaacaaaacaaaacaaaacaaaactgaaaaacaggccgggggcagaggctcacacctgtcatcccagcactttgggaggctgaggcaggaggatcacttgaggccaggtgtttgagatcagcctgggcaacatggtgagaccacatttctacaaaaaaataaaattagctgggcataatggcatgtgcctgcagtcccagctacttgggaggctgaggtgggaggatgacttgagcacaggactctgaggctgcagtaagttgtgactgtgccactgcactccagcctgggcaacagagggagaccctttctcaaaaaaataaaaataggccaggtgcagtggctcatgcctgtaatcccagcactttgggaggccgaggcgggtggatcacgaggtcaggagatcgagaccatcctggctaacatggtgaaatgccgtctctactaaaaatacaaaaaattagccaggcgttgtggtgtgcacctgtagtcccagctactcaggagactgaggcaggagaatggcgtgaacccgggaggtggagcttgcaatgagccgagatcgtgccactgcactccagcctgggcgacagagcgagactctgtctccaaaaaaaaataaaaataaaaataaacaaataaataaaataaaatataaagggaaacaacccagcgaggcacggtggctcacgcctataaacccaacactttgggaggccaaggcaggctgatcacctgaggtcaagggttcgagaccagcctgggcaacacggtgaaaccctgtctgtactaaaaatacaaaaattagtcaggcatggtgacgcactcctgtaatcccagctactaggggggctgagataggagaatagcttgaacccgggaggcggaggctgcagtgagctgagatctcaccactgcactccagcttgggcaacagagcaagactcatctcaaaaaacaaaaataaagggaaacaacccaaatacccagaatgcataaataattgtgataaacatatgtatagtgggttaccacccagcaatgaaaatgaatgaactctgtccccagcctcaacctggatgactcacaatgtcgagtgggagacacaagacacaaactaatccacacaccaatcacgattctacccagatgaagttccgagcaggcagcacagagctcaggggtgcacacagagatggcagaaccaatgaaaagcaagagcatgaagactctaaaagtcaacacattacttcttggggaaagagaagggacacatggcggggggtaggaggcttctggagtgccagaatgttctatttcttttttttcatgagacagagtcttattctgttgcccaggctgcagtgcagtggcccagtctcggctcactgcaacctctacctcccgggttcaagtgattctcgtgcctcagcctcctgaggagctgagattacaggcatgtgccaccacacccggctaatttttgtatttttagtagagatggggtttcgccatgttggccatgctggtcttgaactcctgagctcaagcagtccacctgccttggcctcccaaagtgctgggattacaggtgtgggccatcacatctgccctttttttcttttttaatagagacggagtctcactatgttgtccaggctggcctcaagggatcctccagcctcagcttcccaaaatgctgggattacaggtgtgagccaccacgtctggacaagaatgttctgtttctctaggagggcattgtaattggtgataattctttgaactgtccatttatctctagtgccctcttccgcacctgttacagctcacaagaaagacggttagatgcagaaagggcggagaagtgtggcccaggcccgtgcacataccacacggtgcaagtacttgtggtcgtaggcgctgatgggcttgccgtccagcagcacccggcccccctccagggggtagaagttctccaggatgttgacacaggagctcttcccactgcccgagggccccaccagggccgtcaccttgccgggggacaggctgaaggagacattctgcaaagaacacacaggcacagtgcggggttatcggctcaggtcccaggactggatgccctgaccttggacacaggtgggtgcccttcccagcccaccccatgtgcctctccctcgcttgggcactgctggcccctaaacgttctttctaagacactaggacttggaagcaccttgagatttgctgtttcctctgtctggaatgttctctctgcagggaggcccctggtgaggtctcacctcaaatgtcacctcctccaagaaccccttcttgactgttaccaccattcccatggaccatccctaccacagcaccctgatctattttctttctagcacttattatcgggaatcattctgttaagtatctgtcttccccaactggagcccaaaactcctggagggcaatgatcttgcctgacatattcccagctgccctgccacagcctggtgtataggaggtgcaccagaaatggggtgacggaaaggctgattctggcaggcctcaagccgcgccctcacctgcaggacctgggtgtggggccgagtgcggtaggtgaaggtcacattctcaaagtccacccggccctccaggtggtcgggggccaagctgccatcgtgcaccatggtcggctgccggtcgatgaactcgaacaccttctcagcagcccccactccctgcatcaggccactgtagacggagcccacggactggggagaggagacacgcgttcctgtcccaccgatacccgactcctgggacccacccctgctactagagaggaggcaggtatagggaaagcaaggagttctggcggggagatgcaggaggccacctgaccacccactggtgcattagataacgacagtaaggggagctgaggacagcagcatcactagcactctaccggccatccagctgagtgggtgccatcatccccacaggagcagatggaagcgaaggaaccggcaggggtgtggcacagtgggaatccagccttgatctttcaattgcgatagcatagctttttttttttttttttaagatggagtctccctctgtcgcccaggctggagtgcattggtgcaatcttggctcactgcaccctccgcctcccaagtcaagtgattctcctgcctcagcctccagagtagctgggattacaggtactcgccaccacgcccagataatatttgtatttttagtagagacagggtttcaccacactggccaggctggtctcaaactcctgaccttaagtgatccgcccacctcaccctcccaaagtgctgggattacaggcatgagtcaccagacatggcttgatttcaattttcaaaatgggtcttaatgtgtactataaataaatatattctccttgggtaaaaatacatagaatatgaatgtaaatcataataacggcccattttcttaagtattctctatttattttttttgagaggagggtctcactctgttacccaggctggagtgcagtggtgtgatcttgctcactgcaacttctgcctcccgggttcaagcaattctccaacctcagactcctgagtagctgggaccacaggcatgagccactactaagcccagttaattttttgtattttcagtagaaatggggttgcaccatgttgcccaggctggtctcgaacttctgagctcaaggaatccgcctgcctcagcctcccaaagtgctgggattacaggtgtgggccactgcgtccggccaagcatgctctgtatgttaggaggtaggttctaacattatctccttttttactgatgaggaatctcaggcacagagggctcaagtaacttggcccaggtcacagagcctagaagtggcagagccaggatttgaatccaggcccatctgtctcctgagttcaggctcttaggtgctgaatgtcctcattggtgataagggggtgatatcggcatctgtgtcctgttactgtgaagacaacagcaacagccggtagtaaacacctaaaaccccagagctggccgggcacagtggctcacacctgtaatcccagcactttgggaggcggaggcaggcggatcatttgaggtcagaagttcgagatcagcctggccaacatggtgcaaccccatttctactgaaaatacaattttgtactaaattttgtactaaaagtacaaaaattagctgggcatggtggtgcatgcctgtagtcccagctactggggaggatgaggcaggagaatagcttgaacccgggaggcaggggttgcggtgagccaagattgcaccactgtactccagcctgggcgacagagcaagactccatctcaaaaaaaaaaaaaaaaaaaacctaaaaagaaaaacattagctgggtgtggtggcatgtgactgtaaccccagctactcaagtggctaaggtgggaagatcacttgagtccaggaggtcaaggctgcagtgagtcatgaaagcaccactgcaccccagcctgggtgacaatgtgagactgtctcaaatagtaatgataataaataaacaacactgcactgaacatctctggacatacatcttcgcccactgctgtgagtactcttgaagcatggattcctaggggcagatttactgctgagtcaaataatatggcaggtgtgattctccagcagatgcaatggcctgagtagcagatgctaggaacaccccaccaacatccttgagcctttgtcagcgcagcacacaaaggcccaatctcttactgcctgcgggctgcgggcttttttgtgggagcgaggcagacaagagaattaacaccctcactccaggctgaccttgagcaatggctgatggcagcttgggtgtaaacaccccagctccctggccctcagatgggatgactctggtgctggtgtcctaccctgtccgctagaaggatcccacctcagttgcccacactggtaactggctccacaactcactctgctgacttccttccttccacgtctcactttccactcccacccccgtttcctgagatcacctcccaaacaaatccgttgcacgccaattctgtctcaggatctgcttgtgcggaaaccaaaatcaagacaatctaaaacacccttgcatttccgaggcactacgctggaagtaggctgggaggaagtcaggcccggctggccctgagccccgttcccgagcaaatgtgatggacgagtcactccaccgctcaggttcagttttcttttcatcacttcaatttctcacagagctgttaagaccattttctgaaatcacctctgtccctaaagggtgttgctgtcacttgttggtagtattatcattctttctttcttttttttttgagatggagtttcgctttggttgcccaggctggagtgcagtggcgcgatcttggctcactgtaacctctgcctcccgggttcaagcgattctcctgcctcggcctcctgaggtgtgagccaccgcacctggccctttctttctttttgagacacggtctctctctgtcgtccagcctggagtgcagtggcgtgatcacggctcactgcggccttgacctcccaggctcaagcgattctctagcctcagcctcctgaggacctgggattacaggcacatgccaccatactcggcttgcctatttatttatcaagacggagtctcgctctgtcacccaggctggagtacagtggtgcgatctcagctcactgcaacctctgcctccagggttcaagcaattctcctctcaagtagctgggattacaggtacccaccaacacgcttggctaatttttgtgttttcagtagagatggggtttcaccatgttggccaggctggtctcgaactcctgacctcaagtgatccacccgcctccgcctcccaaagttctgggattataggcgtgagccaccacgccctgcctagtattatcattcttgatatgatcatgctgtctcccctacttaccttagagagaaataccacattgtcagagtccctggagccccgcccccaccctgttaagatccctcttccccaaactcctcccttctctctggatccccggacacactggcctctcacctccatacaatctcccaggacaaactcgtagatgatgaaggcgatgaggttgccgctggtcatctggcctgagatgacaaggtggcccccgtagtagaggatgctgacctggaccaccagcagtgtgagctggggcagagggagaggggatgtgggtcgaggggaccttagatcccccaccatccccattccctgacccatcccaggctgcagggggaggtgagggcagacccagccacaaactgaaatgccggccgttggcaggggtgtcttccaaggcttgtcactcatgccttcccctgccccgagcatttccctacagaggcctccagctggagcaggctgtgggcttggccacagaacaaggctttctttgtgaggtcctggcacacacatgccacccccaggctcctcagcttggccacctgggaactattcgtcctcctcatggggaagagcatgactcagagagggcaagtgccctggctaaggtcacacagtgagctctctgtctcctcccccagtggggttccgtgaagaaggggctgtgatgggagcgcccatgccttcctcctgtgcctggggggcatctgggaagggagtggagtctgagtacccatggcagcccacaccctagtcagggactccatctgtcctcctcatgcccagccagaactaggctgctgtctggaccaccgtgccttggtggaagctgcaaaggcaccccctgccagcagacggattgctaagaggctcagctagctgagctggaccttagcccctcctctcctccttggctgatacttttgggaggtggcagcaccaggaagtcccagatatcctctttcccctggctcccctgtagaccaccagctccctcctccctctcactccaaaccctcctcattcctccgcagctatgccctgacctgcccacctcccatgtgtgtccagtgtagcagtgacatgatccaagtgctccccatcctccaaggagaggctgtgacgcactcccgggagtgtgccagacactgtcgggagtgtgtgtggctgtgacatgagacctgcccgaaagtggcctagggacctgctgactccccacctcagcaaggatgtttccccagctgggaaaagaaagctcccaccctgccaccccacgtcaggtgactgggagaggggcagccttgcttctgggaaagattctcagcagggcgcggtggctcacgcctgtaatcccagcactttgggaggctgatgcgggtggatcacctgagctcaggagttcgagaccagcctggccaagatagtgaaaccccgtctctaccaaaaatacaaaaattagccaggcatggtggcgggcgcctgtggtcccagctatgcaggaggctgaggcaggagaatcgcttgaacccaggaggcggaggttgcagtgagctgagatggtgccactgcactccagcctgggtgacagagtgaggctctgtctcaaaaaaaaaaaaaaaaaaaaagaaagacagacagattctccaccagcttgacaccaacatgcaggactgatgtcctagatcgagggcttcccccatctttgcatcccatccctccacagccagagctgcctggccaggggcacgtaccccgctgccccagacgtagtacatgtaggcagctgcctccttcctgttcagcttgtacacctgctgcagcttccgcaggtacacctctgcctcctcctcctcattggcgaagctccggacagtcttcatggcactgatggtctcctccgccgtgttgctcgctctggccagggcattctggacctctttggagagcctctatggacaggagggggacaagaaggagaagaccccaaaacagcctcactatgtactggagcccccaggcctctctgggtttttccacccttcgctggcaccagctatatgcaagaggttcctaggacaaaaagacaagatctagccctttctcccccatccccttctggctcaatttgacacactcaggtagtcaactccagagaggctcttggggcaatggtttcagctcctgaaggatagggcacggtgctgatcgttaagtcatccccagtattcaaaagaggctattcatgactggacagtttttggtaatcctttcagaaaaggggcctcaacacctgaccctgtgctggaagagcaggggatgccttggacggttgttcaggttgtacactatttaagaaacaccaactattaaaggggcaccatttacatcatcaacataaattatgttagagcctgagggttgataaagagattccagaactcccagccaagttctacatggtggcaggggccatgggttgtgaaatctgcccacaccatgtgcatgtcaccacaggcagagctgaaaagtggtcccaagtgtgcggccatcaggctgctgttcaccagagtcctggaagaggcccctgggtggagctgttcacactttgcaggagtcactatgctgattctcaagccagccaggaaggctgcctgagagtccaggacaggagcatgcactggcatgtcccatgaccatgtgtcacgccccagccgcaggaagcatgcagggtgcctgagtcatgtttggccatgggcggtgtgtgtggtttgtggagatgactcgctggctacacacaacacattcaggcatggggtggaaaacccaaacagagccttcctgaggcctcccttagctgaactaaaaggcagggcctgcagtgcacacagaggtgggggctgagggggagctccagggtttcttgctccatcccaggggctggtgggaaggccggaagcaaggggtggggagcagcgtgccagaaatggctcagactctaaagaatagatttactttctcatctcagtgaggacggtggggaggctcgtgaccaggaacttcgggaagaggtcctacctgtgtggctggagaagactgtggggagtggcctcaccgggggctgggtgggagatggcttcctttgctaccctggtctcaggtcaccaacaccaaaggctccaatggagctgcgacaatgacttacccggcaccacctggaggccgtcatgcatccaagcccctgctctagaagtaccccacgtgggcctgggtgactgtgagggggttgcctgtacctgtcacagggtcacagccctgcctgtctgaacccagcctgtctgtcccttagggctcgggggcacccgcccattcaggaagcaggaggagggtgaggtcaaacctggctcacggccctagctcggaagcagaagcagtgccgtggggtggccagaggggacagcagcctgcccatgatggcatcacagcgggcccgcgatggcatcacagcgggcccgcaccacccccacatacacaccaggcacgttccaacccagggccttttcactggctgtgccctctgctcagcacatacctcccaagatgcccgcctccttcagacccttattcagatgtccccttctcagcaagacctatttaacttgtatttattcattcattttagagacagggtcttgctgtgtcacccaggctagagtatagtggcacgatcattgctcactacagcctcgacctcctgggctcaggcgatcctccacctcagcatcccaggtagctgggaccacaggcatgcgccaccaagcccagctaactaaaaaaaatttttttttgtagagatggggtcttgctatattgtccaatcttgtctcgaactcctaggctcaagtggtcctcctgcctgtgcctcccaaagttctgggattacaggcatgagccaccgggcccagccagtaaatccaatttaaaattgcagctacacccaatgctcccaatccctctgctcacttcatgtttctccttagcactgaccatcttttactgtattgtggattctcattctttatgctgttggtacctagtatctgtctctgacactagatacaagttccaggaaggcaggggccttgtctttttcactgatgtatcccagtgcctgggacatagcaggtggtcaataattatttattgaatgagcgaagaaatgaatgaatgaatgcaaacacagcctcaagacctgtccttcactagcccttagtggccccctgagcccctcctaaggggatgtttgggggctgccagggtgcacagtccccagcagagacagggcaggcctaccttgtagtacttgccgtagatgttggacaccatcatgatgatggggaagcccatgaaggtgaccaaggagagctgccatgagaggctgaacatgaagaccaccacgcccgtgaccttgactgtgttccgcaggaagacattgatgttctgggagaccaggtcgctgaccatggtggtgtccgaggtcaggcgggagatgaggtcccctggaacacacgcggctcagctctcaccacagcaacccgggccttgggggtggcggtgggggatgctaaggggcctctgagacagacactgggaagccgggcctccctacctgtgggcggggttggggggtgggggagaagagcagatacccctcgagggctactctgagccaatcccagtcatcagcatcttgcttaagcttcatgacatcccgctgtacagcggaggaggctggggctcagaacaggaaggcccccgtagagtcacacagcctgtccgtgactgagccagacttcaaacccatgtctcctccctgtcactggcagagggggtaactcctcttcccttctagggaaataacaacctggctggtggcgggcaggaaagcgcagacacttcttacctaagttggacattgtgctaagagctgtgtaaggaccccatggggtggctactatccgtgttcccattttacagacaagaaaacagaggatcagagaggtgaagttcgtgagtggaggaaccagggcttcgacccaggccggtgtctctcagagcttggatcttggtggatattctatcgtcttccccgttgtggcccctggccctcacctgctgacccccatgggagcagggtctctgtcggccacaggcgtgggtagtcctggacctggtggtttccatggggcaatggaaagcaaggccttggctcctgcagggacctcgggtggcctggcctgggccccacagaggccgcagcccacaccaaaacctcagtgagcaagccagctcccaggacacaggccaagcccagggtgttcccagcctgaactaacagcaggaggagaagacagagggctgagaccacccacacgcccatttcattcctcagtgccaggcaagcccacaggggtggggcccagcccccaggacacctagggcactggaaggaccaacctgtgcggttctcatcaaagaagcttgtctcctgggacaccagtgagcggaagagacagtttcgaaggcgaatgttcagtctggcaaatatgagggtaaaaatgccgccccgaatacctgcggcaaatgagctaattgcagataagagatattatagcacgatgtccttccagaccagtgaccacacccggctgccccctcccgctgccggcaggcctgggagccccaccgcagccccactccagggctggcatccctgcggggtccccctcattcccagtgggagcccccctcaaggtgagggcaaaggggacagttgtgggacaagagacccaaatgtgccagccagaccctcttccttccagaacagctcagacaaagccggttctgtttgggaccagattcctacttggaaaacagccagggagggtgagcagggaaccctgaggactgaagcccttttcagggaccagagggtgtggttctagggtgctctaagacagtgtggaagccggttcccagggtgaccagctgagggacaggcccaccaggggcatttccagggcctccctggcccctgtcttccttaggaacaggccctcccttccctccctggtgcaggtcggggtgtgcggggcagggcgtgggggttgagccagctacctgccaatggccagcaggcacacgatgacgacagccgtgctgaactgatccatgcttttctggatgacgatgccatcaatggcgcggcccgtgtagtagggcaggaaggtctctcctgggggaggcagggcagcctcagggacgtctgcagccaggggaacccgcacccttcctcctgaggctccagaagtccacacaccaacccctctgcccactccaccggtgggctttcctccctcggcaaactcttgctgcccatcgtggggccccagggtgcttaatgcccccctcctcagagaacaggggagcactgggccttgcatccacacagcctgctggttcttctttatttatagtggctaccaggcatcgagccagggctcctgcaggatgcttcattctcttgttttttgagacagggtctcgctgtgtcccccgggctggagtgcagtggtgtaatcatagctcactgcagcatcaaactcctgggctcaggtgatcctcctgtctcagcctcctgagtagggaatacaggcatgtgccaccatgccaggctaatttttttttttttttttttgtagagacaggggtctcactatgtggcccaagctggtctcaacctcctgggttgaagcaatcctcctaccttggcctcccaaagtactgggattataggtatgagccaccgctcctgaactttgtttcattccctttggagcaggccctggaatcacccccattttacaaatgagaaaaattaatttgtttttctttttctaaaatattttcctttttttttttttttttaactttttgagacagggtttcactcctgtcgcccaggctggagtgcagcctcaacctcctgggctcagtggatcttcccacctcagactcctgagtagccgggactacaggcacacgccaccaggcctagctaattttttgtatttttttgtagagacgaggtttcgctaggttgcccaggctggtctctaactcctgggctcaagcgatccacccacctcagcttcccaaagtgctggggttacaggcctgagtcacagcgtccggctgaaagtgaagttgaatgagatgactcgtccaggccacatggcaatcagtggctgattgacgccaaagttgatttcattcttctcaatgggttcagagtccaaattctggaacctcagaagacgttgctattctggttccaagcaatgctggaaattgccaccccacccctcctggtggggcacttgacaccttgctgggtgctttcttacccgcttgccttactgtgttttcacaacaatcctggggtggaatgggagactcacagaggctgaggaatttactccaggtcacacagcaaggggaaaggctgggactcaaacctaaactggctttcaacctgggggctctttcttttcccttcctcctgtggtctgaatgcatctcccaaaatttacatattgaaacataatcgccaatgtgatagggcagagctctccaggatgggatgagggcccttttcaaagggcttgtaagcctggtttgccatctctcgcccttccaccttctgcagcgtgaggacacagcagtcttcccctccagaggacacagcaaggagggaccatcttggaagcagagagtggccctcacgacaccaaacctgctggcaccttgatctgggacttcccagcctctagaacagtacgaaatcagtttctatggtttctaaatgacccagtctgtggtattttgttacagcagcagaaatgagactcccccgacaataatccggaatgtccactctcctcttaaggaaatagtggcatcaccaggccaggccaggcccttgttcatcccaggacctgtttccactgaagttctttccatgagcagagccaggtttggggctgggcatacagtaggtgctcaataaaggtcagtgaatgaaccccgggcaggtctggctagcacagtctggcctggctcagacacttgggtagtgagactttctgtgcagttctggtgccctctgctgggaccatgaggtggcagcctagagggcctgtgtccccacagtccttggccagacgaggtctccagctgaggctgcagagttccacccagcctgagtttctgcctcagtttacccacagaaaagaagagggcaacgatgagctgtgacagaatattctggaatatctgattccagcaagcaccaatgctaataatcgccttactgggtaccaggggctgtgcaaagcatgccggcaaactctcttgctgaatctgcacaagaattacgtgaaactctccaatgcaccagcaaatactcagaccatttccagaacctgaccactttcactgcctctactgccccaaccctggtccaagtcattaacctcactgggactatctcagtagcctgctctcaactttgctcacatcagcctgtccacacagtagaaggcaggatcctgttggaactaacttcagatcttgttgctccttggctcaaaacagtccaaatcccccttctcatccagtgagatggtaaaagccaaagtctttacaatagcccacaaggacctgcatgattgagccgctagcagagacctttgtcttctccccgccccatctcactccctctgctccagctaactggtgtctgctcttgaacaactgggcaccttcctgcctcaggacctttgcatgggctagtccttctgcctggagtgctcttaccacatacatttttttttttttttgagatggagtctcagtctgttacccaggctggagtgcagtggcatgatctcagctcactgcaacctccacttcctgggttcaagtgattctcatgcctcagcctcccaagtagctgagattacaggtgaccgccatcacacccggctaaattttatatatgtatatatatattttgagatggagtcgcactccgtcgcccaggctggagtgtattggcacgatttcagctcgctgtaacctctgccacctgggttcaagtgattgtcctgcctcagcctcccgagtagctgggattacagacacctgccattgcacctggctaatttttgtatttttagtagagatggggtttcaccatgttggcctggctgatcttgaactcctgacctcgtgatccacctgccttggcctcccaaagtgctgggattacaggcatgagccatcgcacctggcctaaattttatatttttattagagacagggtttcaccatgttgcccaggctggtcttgaactcttgacctcaagtgatctgcccgcctcggccttccaaaatgctgggattacaggtgtgagccaccacacccagccacttaccccagatatctgctcccctaccttcttaagtctcaaaggccacccagtaatcctataggtttggtacaattattccttccatttgtggaaatgtattctttacacaaaagaggaaactgaggctcagagagattaagtcacttgcccaagtttatacatttggtttgccatgaaatccatattaaagaatcttaggctacagaaggtagctcacacctgcaatcccagcactttgggaggccgaggtgggaggatcacttgagctggagaggtcaaggctgaagtcgctgtgatcactccactgtactccatccagcctgggtgacagagggaggccctgcctcaaaaaaaaaaaaaaggactccatttgttttttatgtattttttttattttttttgagacggagtttcactcttgttgcccaggctgcgatgcaatggtgcgatctccactcacagcaacctctgcctcctgggttcaagcgattctcctgcctcagcctcccgagtagctgggattacaggcatgcgccaccacacctagctaattttgtatttttagtagagacggggtttctccatgttggtcaggctggtctcgaactcctgacctcaggtgatctgcccccccttgctgagattacaggtgtgagccaccgtgcccggcctattttttattttttgagacagagtctcattccgtcacccaggctggagtgcagtggcacgatatcagctcactgcaacctccacctcccaggttcaagcaattctcctgcctcagccttctgagcagctgggattacaggcgtgtgccaccacgcccggctgatttttgtatttttagtagagacggagtttcaccatgttggccaagctagtcttgaactcctgacctcaagtgatctgcccacctcagccttccaaagtgctgggattataggtgtgagctgctgcacttggcctctaaagaaccttaatttaataagagatactcaaccctaaaactaacatttcccaatgggtggttttttgttttttgtttttgtttgtttgttttaagattctgagggtacagaaaagctgggcactgctgaatgcttgttgattgaaaaataattattaataatcacagtacctaattgtcttttttgagatggggtctcgctatgttgcccaggttggtctcaaactcctaagccaaagcaaccctccctccttggccacccaagtagctgcggtcacaggtacatggcattgcacctggccctaacactgattaagtatttacttgtgctaggcaccaagcttcctctcacttctttctcacagtaccccaagaaagccctcacttcagaatggtcaagtgagcgttggccaggttaataacttgcctaaagttatcagtgaagtcgggagcctgagcctcgagtctgcgccctgactcttgatgcaatcctgcaagccgggaaaatctgctcagcagtatttaaggatgtctgcattccccgaccacacagcagctgacggcagggccccagcaggtcgggtaaacaaggtcatggcatggggcaccatctgtctgcacaggcatgacagtcattcatacttttgttcatttattcattcagtgagcccatctctgtgccagctactgggatccagggtgagtcagacctggcccctgcccctgaggggctcaggacctgggaggggaggcaggagggtgaatgcatacataacagggtcttgctatgttggccagactggtcttgaactcctggcctcaagtgatcctcctgcctcagactcccaaagtactggcattgtaggcatgagccactgtgcccagcataaatgcatagttttttgggtttttgtttttttgttttttttttttttgagacggagtctcactttgttgcctaggctggagtgctgtggcacaatcccagctaactgcagcctccacctcctgggttcaagatatcctcctgcatcagccttctgagtagctgggattacaggcggctgccaccatgcccagctaatttttgtagttttagtagagacggggttttgccatattgtccaggctagtctcgaactcctaacctcaggtgatctgcaggcctcagctccccagagttctgggattataggtgtgagccaccgtacccagcctgaacatatgatttttatgtcataaaagctataactgaggtgcagacaaagttaccacagttggcagaatctaaggtggcttcctaaggaggggacttttgggccgcccagcatgagccaggagaaactgcctggtttaatgggaaggggtcatcccagtcctcacacctgctagtattactgggaggtgtctatgtgccaggagctgtccaaggtgtctcacccatgtggattcactgacctttccaaccccattggaggggtactactatgcccatgtcacagaagaggaggctaagacttagaggggttaaataacttgcctaacctcacacagatgttgaggagatgggactgagagggcagaggtagatcgtaggagtacagggctgcagagtcagggccagctctgggtttgcctgtcctctctcagaacattctggcattgttattgcattgtcacctctctaggctctgtctctgtcagttaacatttttattttactattttattatttatgttttttgagatggagtctcactttgtcactcaggctggagtgcagttgtgtgagcttggctcactgcaacctctgcctcccaggttcaagcaattctcctgcctcagcctcccaaatagctggaattacaggcgtatgccagcacatctggctaagttttatatttttagtagacatggggtttcaccatgttgccaggctggtctcgaactcctgacctcaggtgatccacttgcctcggcctcccaaagtgctgggattataggcatgagccactgtgcccggctaatatttatatatcttttagcagagacggggtttcaccatgttggccaggctcgtctcaaactcctgacctcaagtgatctgcccacctcggcctcccaaagtgttgggattacaggcatgagccaccgcgcccagcttaaaatttttaaaactcataatagctaacaaccctgagcacttaccatgacaagccaagctctgtacttagtccttctcctatttttttttttttctttggtagagacaggtcttgctctgttgcccgggctggagggcagtggcgtcatcatggctcactataactcaagctcctgagctcaagggatcctcccaccttagcctcctgagtagctgggactataggcaagtaccaccatgcccagctaattaaaaaaacatttcttttagagacagggtcctgctgtgttgcccagagtggtctcaaactcctgggctcaagtgatcctgtagccttggtctcccaaagtgctgggattagacatgagccactgcacccagctctcccgttcttttcagcatctaaaatgtcaggaaataaggactccaacaatccttgttgcacagaggagggaagtgaggctcagaaaggctggagaacttacgcagggccactcggctgggtagggagcaggacagggatttgtgcccaggcctcgttgcccccagaacctgtgagctccaaccatgcagtgccaccttcccacccatgttgctgagtggtgccttcaaactgtttggaccagactcacaggcacaaatacatttcatgtcacaaaccaggccacacctgcacgtaggcacacacaactaaaatattaatatcttttttttttttttttggtctcaaactgctgagagttttttttttttttcgttatctgcctgcctcggcctcccaaagcgctgggattacaggcatgagccaccatgcctgcccactctgatgttttctagtctattctctgatgatcccagctccaggaatttattctacagatccatccacattcatatgaaatgtgtatgaacagaattattgacgtgcaggtcgggcgcagtggctcatgcctgtaatcccagcaccttgggaggccaaggcaggcagatcgcttgaactcaggagtttgagactagcctggccaacatggtgaaaccctgtctctactaaaaatacaaaaattagccagacgtggtggcaggcgcctgtaatcccagctgcttgggtggctgaggcaggagaatcgcttgaacccaggagatggaggttgcggtgagccaagatcgcaccactgcattccagcctgggtgacagagcaagactccatctcaaaaaaaaaaaaaaaaaaaaaattcatgttaagaggaaaaggctcaaaataacccaagagtcaaatgatgggagaccaactaaataatctatggtatagccgcacaatggaatattatgaagccaaataaaacaatgaggtactggttggaaaaattccagaacatattgttaagtgaaaagagcaaaacataaaacaatgtgggtgagaggtgggggagtgatgcatgttcttttgatgtgcttgtagctgcataaggaaaagctgggaacatgcacaagaattgagtaagaaagaatgctttcctggccacctgggagtttctgggtccttttcctgcagttagccctgggcagaatgatcagggtagaattagaagtgaaacacagccaggcattgtggcttgcgcctgtaatcccagtgctttgagaggccaaggtgggaggatcacttgagcccaggagttcgagatcagcctggacaacatagtgagatcctatctttacaaatttttctttttttaattagctgggtgtggtgcacgcccctgtagtcccagctatttggaagactgaggtggggggattacttgagcctgggaggttgaagctgccgtaagctgtgatcatgccactgcactacagcctgggcaacagagtgagaccctgtctaaaaaaagaaaaaaacaggagtggaactcatagtttcctttttcttctcttgtcttttactttttccttttttaaattgagatggggtcttgtcatattgcccaggctggtcttgaactcctgggctcaggcaatcttcccaccttggcctcccaaagtgctgggattacaggcgtgagccaccgcgcctggcctattttttcgttttaaattacataaaatagaaatggggcaggcaccgtggctcacgcctgtaatcccagcactttgggaggccgaggccagtggatcacctgaggtcaggagttcaagaccagcctggccaacatggcgaaaacctgtttctactaaaaatacaaaaattagttgggtgtggtggcatatgcctgtagtcccagctacttgagaggctgaggcaggagaatcacttgaagctgggaggcagaggttgcagtgacctgagattgtgccactgcactctagcctaggtgacagagcaatactatgtttcgaaaaaataaataaatacaataaataaataaataaataaaatagaaatgggttctcgctatgttgcccaggctggttttcaactcctgggctcaagtgatcttcctacctcagcctcccaaagtgctgggattatagatatgagccactatgcctggcctcttttccttttcatatcaatttgatgtctgaaccacgtaagtaaaatcttttaaaatctaaggcagtcatatccacctaatttgatgttctggtggccacatgtccccgaggtccttacttacccagagctgccacgatgaggaagaaggaggcggccacgaggaaggccacgtcgggcttggtgtaggagagcagcttctgcagcgtggccccagacgcctgctcgggcggtggccggccgctcccagggaagccctcagcctcggtggccgcccctggctccagggcctgggtgcctggccgcacggtggacagcagccaccagagcaggaaggatgcgccgagtgaaatgtacgtccacacgaacagggcccaaaaccaggggtcccggatgggcctgcgcacctctgagaagagcagcagcttcaccatggcatagatgcccacgaagaggcacacgagggtgatgaccagccacgaggcccgcagccgccggggccccagcgcactgttcttggccacaccaatggtggctcccagcagcaggcagctgcggtacaggcaggctgcccagagatccagcaccgagtcaaagatgttgaagtggcggatgtcctccaggaggctgcggtccaggtggctgaagacatagatggccgtggtcacgcagatgtccacactcatgaaggccaaagtcaccaccaccgccttccacagccgcatcctgctggttggaggtgggcgggtgctgaaggccaggttgtagctcacgggggcaaggccatcatcatccacagggcgaggccaggcctgtagggacaacagcaaacatcagcacaaggggttcaggtttgccactcgctggctgtgtgaccttgagaaagtcacttgacatctctgagccttagttttctcatctgtaaaatggcaatatcaacttcccgggtactaagattccactcattcaagggatacttactgagtgcccactgcggccaggtgctgttctttgttctttgtcatgaacaaaaagaacaaagatccctgctctcctggagatgacatactcatgcaggagacagataataaggaaatgggctcacgcctgtaatcccagcactttgggaggccgaggtaggtggatcacctgaggtcaggagttgaagaccagcctggccaacatggtgaaacccccatctctactaaaaatacaaaatttagctgggtgacagagcgagactccatctcaaaaaaaaaaaaaaaagataataaggaaataatgtgtgtcttgtgaggccaaggttggaggatcccttgaggccaggagttggagagcagcctgggcaacagggtgagaccctgtctttaaaaagcaaacaaacaaacaaacaaacaaacattaactgagtgtggtagcatgctcctgtagtccaagctacttgggaggccaagatgggaggatcgcttcttcagcctgggagttcgaggccacagtgagctatgatcatgccactacactccagccctggtgacagcaagatcctatctctaaaaaaaaaaattttttttaattaaaaaaagagataagggttgtggtggaaaaaagaggggggtaaataggatggggtgagggtgaataggataggggtgggggaagacagagatcaattttattttatttatttatttatttgagacagagtcttgctctgtcgcccaggctggagtacagtggtgcgatcccggctcaccgcaacctccgtctccctggttcaagcgattctcctgcctcagccccccaagtagctgggactacaggtaccccaccaccatgaccagctaactttttgtattttttttagtagagacggggtttcaccatgttggccaggctgttctcaaactcctgacctcaagtgatccacatgcctcagtaacccaaagtctgggatcaaaagcgtgagccactgtgcggggccagagatcaattttaaatagggggccagagaagacctcgctgggtaggtaacacttgagcaagacttgaaagagttatggaagtctgccaagtggctatctggggaaaagcacttggcacaggtgaaacagtgccagagccccaaggcaggagtgccccttgggaaggcagcaaggccccatgagatcagagagggtggggagtatctggaggattttgcatccatagtgaggacgaagctgagataagcagagtttaataaacagccgctgtctttactaccactactcatttctctgaacctgtttcctcatttgcaaaatgtgagtgtgaggttcaatgtgtcagttctgggcagagtgcctggtgcataattgctgctgattgtaatcaaccatatacagtgtgtgcttaataaatgtttgtccacttttctcctcccacgtcaggccttctatctctgcaaccccaaataaactattttggtctaagagggaacttgacagctgtgggggtggcttgcaggccacacagcaatccagaaaccttggcatctgcttggaagtttccagaatcttttcctcctgcccaggttggccctcgtgcccagccctaggcccctttggttttctgaatcttgatgtctgctttatccaaggcatctcccggcactgggtccctcaggactcccccagagccgcagggacacccgggaagtgggcctggaggcctgagtttgtgagtggggcttgtccacggtagggttaggaccgggctggggtgtgtccctgggtgctacctcctgtctcagctccagtccttcctcccgtgggccttttgttgtcatatctgcaaaatgggctgggctctagatcccccaagaggaggggtgaggcgctgggtgacagcggggatgactgtcgtggctgggaaggggccatcctgagagagatcctctccccgaagctctggcgcccaggtgcccaaaccgctcacactgtggcatgactggaacctcacacagtcccacgaggccagggtttccatattcccgtttacagttagggaaactgaggcacagagagacaaaaccacctgatccagacattcagccaacaagggcccaagccaggatgacttgaggcagtcagtgagtgtaggaccccagcatctgcctctccacctgtctactgcatgcctggcacaaagcagttgtctaataactacaagcagacagggatgtaacactgcacttcctgtgagccctgccctgcaccatgtgcttcaaatccaggtggccccacctatttaatcctcacagcaactttgtgagatgtgcactgtcatcccttccacttaacagatggagaaactgaggcccagagaagtgaagaatttgcccaagattacacagcttctgaatagcagagctgggatgtggattcataggtgtctgagcccagaatctgtgttcttcacccctaaactaagataacattcaatatagaaaatgctaccaggggccaggcatggtggctcacacctgtaatcccatctgggcctcttgggaggccaagatgggcaacagcttgagctcacgagttcgattccagcctgggcaacatggcgaaatcccgtctctactaaaaatacaaaaattagccgagcatggtggtgcacgcctgtaaccccagcaactcaggaggctgaggcagaagaatcacttgaaactgggaggtggaggttgcggtgagccgagattgcgccactgcactccagcctgggtgacagagtgaaggaaaatgctaccgggaagtgttcatctaaggaaaagggtccccagcagagggctgggccgtgtggcagaggtgataagactgctgaggctaattgctggcaatgacagcagctggtgccagctgacattggctccaggcacttacatgcgtcagcactcaccagagccctatgaagtaggtcctatcattatccccattttacagttaggaaaactgaggaacagagagattaagtgacctgccctgggtcacagagctaggtgacccacagagttgggtcacaagctgggatgtgaaccctggccgtccagttccaaaatctgtactctcaactccatagctccaacccttcaaaacagcctctccaggaggtaggcacaacccctactaatgctgagaaggggtctgagatgcagagggggaatggagtggggggatataacaacctccaagcctgggccctgctttcacccccacacctccaggcacaccgaagcccatcgcagagatgacagttgcttagtcagcagctgcccctccaaagacggtcagggccaagcagggtcaagggcaaggggaagtgggtaggatggtcggacaccctcagcccaggtcctggctccctccccagccctgcctgtgctgcccacgcaggctcctgtctgctgcaatgcagaggccgtggggagcgagcgagtgggtgagctccagtcagagcccagggagggaagctcctggcctggtgccattccaggcctcccagccaagccactgccggctgcaccaggtgctgccagccgcctcagctgctgctctcctcgtggtgggcacatggggtccctcagtccccagaaaggggctcgggctcagaagtggaacaggaggcagatccgcaagagactcaaaacctggacagcagcccaggggcttggctgactctcccaacctgactcccagcctctgggggaattccttccccatcccccaacagcccagggtaccagtcatgccccccgcctccagaagcctatttatcttcatcagaataaacaaaatttcaaacactcatatcgcagactaccaaagccacattttgcagatggggaaactgaggcccacagagggagggggtgaggcttgtctcaggtcatccaccaggctggggcagagcagtgctagcacctgggtccctgcccccaagcactagtccttctaccacagactcctagcagagtggactccagccccgggtcgggttacagtcctcggtggggacagttactccgttatttttaaagctactgggcagaagcgtgaccaccagccaaggctgcttagaggcctgtcaccgctctccaactgcctgactcagaggatgcgctgggctcggccaggtggagctggagggcaaattgtgagcacatgggtgacctgcttggcctgagggacaaggacaaggtggtggccagaataggccccacccagaaccggacaaggcccaggaagacaggggtggctcgccctgactccgtgcactaaagaatggcacaggataagcaagtggccttgtccccaccaggggtcttgtcaaaggcttttcttcccagggtaggagacattggttggggtatctctaggcatcagctgcagagaaggccagaagacgatagatagcagttattatgacgctgcaacagagaccctttgcagagaaggccaggagacaatagataaaagttattatgacactgcaacagagacccttcaccgggccctactatgtgcctggcacctcccaaagcagccaggcctccccacttccctgggaggaccctgtggtcatcagcttcgttttacagctggggagacagaagaggttaagtgacacgcagaaaaaggacgaaggcaggatggagacccgcatccagggtctccaggatggagactcgggggtcccctgtccaggctattcagggattgcaagaaaaggggccaaagaacttgggtggcccagtggcctcggttcacccctgacatggtgagctttttaccccggtgtgggcccagacccagataagcccattccattcgctgcgcagcaaagcactgactgacagaggcctgctgggtgggagggcctgactgtgggggtccctggctctggggcaggagcgggctgggtctgcgtgggtccatcctgatttcatccctgctgagcctctggcagcccacgtggggcccagcctcactctgggacttgagaagctgtctcaggtgctctcagctctaggagaggcagagaggcgcgaggtgccctccctccaagcctcctcttgtcacccggccctgcactatccggaaaaggggaatgggcagaggcggggatcctgtcagcccagcttaaagctgtctcagttaatgtcaggccgggggaggaggctttttttttttttccagaggcccagaaataaaagaggctcccctgggaacctacaggcctcactgccagcgtggatggcggggagcagcggcagcccactggcctgctgaggagactgagaaaagggctttgcccaggtcagcaggaacaggccagatcccccaggcttctgccaaagccctggtgctcaggatccctgggaagccctgacatggacagtgggagccctcagaaggcgcgccagccccgtcctgggggaacgacagccatcccaggatcctccaacacctcccacattttccaagaggcagcggcgccttgggggttaaaaaaaatggcaacattcgccctacgggcgcggaaaggatgctgcagggatgggggctgggagctgcggctgcgggctccgggagggctccagggaggctcccaccttcaaccgagatgcctattcccaccgaggcaggggtgcccagacgccccccaacgcgtgcctggcctggcaccctggcctggaaaggtcccaaaaccaggggtctagggtgccttgcccttacctgttacctggcaccaggtgagctctgggagggggcgcgcagcaggctcgggtctggggtgcagtttccgcgctgctcattgaagactgcgccggacgcggtcctcgctccgctcttcccgctgctcctccccgcctcccacccgcgctgcgccgctgcaaggtcggagctgagactggcgtgcgttgagacaggctgatggacggggcggggcctcagtgac

SEQ ID NO: 761 - DNA, 41985 bp, Homo sapiens
cagctcaaacatttctttaatggctgtttactgagcacatactatgtgtcagccactgttctaggcactggggaatacagcagtgatgaagacaaactctaatgtgggaaagaaacaatgacagagtaaactaagtcctggcgccaggactaagccagccctggggtgccgtgctcctcttcattctctctcatccctgcttgttttcctcatctgtctctctggccaactgtgctgttcccaaagccctcgactgcaattactttctcctggtttacccagcacactgtgtgggacagaaggaggacagtgacatttgctaaattaattgtaacagaaaaaagtcagctttaaaagtcataactctccacacccaccaggatggtgacaattttatattgtttgtttttgagacagagtctcactctgtcacccaggctggagtgcagtggcatgataccagctcaccacaacctccaccttccgagttcaagcaatcctcccacttcagcctcatgaacagctgagaccacaggtgtgtgccaccatgcccggctagcagtttttggattttttagtagagatgaggtttcaccacgttgcccaggctggtcttgaactcgtgggctcaagcgatctgcctgcctcagcctcccaaagtgctgggattacagatgtgagccactgttcccggccctggatggtgataattaaaaacaaaaacaaaaccagaaaataacaagtgttggtgaggatgtggggaaattgcaaccctcatggattgctggtgggaatgcaaaatggtgcagccgctgtggaagacagtctggcagttcctcaaaacgttgagcacagagttctcatgggacccagcaattccactcccaggcatctacccaagagaggcgaaagcaaactcccacaaaaaaaacatgaatgttgggccgggcgcggtggctcatgcctgtaatcctagcactttgggaggccgagatgggtggatcacgaggtcaagagattgagaccattctggctaacgcggtgaaaccccgtctctactaaaaacgcaaaaaattacctgggtgtggcggtgggcgcctctagtcgcagctactcgggcggctgaggcaggagaatggcatgaacccgggaggcggagcttgcagtgagccgagattgcatcaccgcactccaacctgggcgacagagcgagactccgtctcaaacaacaacaacaacaacaaaacatgaatgttcccactattagcagcactaatagcagtactattcacaatagcccaaaggtggaaacagcccaaatatctatcaacagatgaatggataaacaaaatgtggcatagccatacaataggatatcattcagccatgaaaaggaataaagtgctgattcatgccacaacatggttggaccttgtacacatgatgagagaagccagacacgaaaggccacgtagtatagggttccatgtacatgaaaaggccagaggggccaatctgcagagccagattttagaatgctggcggccaggggctgtgtggaggaagaattggggagtgactgttaatgggtatagggttttctgttagggtgatgaaaatgtcctggaattagataatgatgatggttacacaacatcataagtgtactagatgtcactaatgataagttttatattgtctgcatgttgctgcaataaaaacaattttaaaaacattaggctgggcgcagtggctcacacctctaatctcagcactttgggaggccgaggcaggtggattacttgaagccaggagttcaagaccagcctggccaacatggtgaaacactgtctctactaaaaacacaaaaaaattagctgggtgtggtggcaggcgcctgtagtcccagctactcaaaagactgaggcaggagaatcgcttgaaccagggaggcagaggttgcagcgagctaagattgtgccactgcactccagcctggatgacagagagagatcctgtctcaaaaactaaaacaaaaaaccctgccaaaataaaacaaacaaaagaaaacattatatctctagctgggcgtggtggctcatgcctataagctcaacactttgggaggccaaggtgggaggattgattgaggccaggggtttgagaccagcctgttcaacaaagcaaggcctgtctctacaaaaaaaaaaaaagcaaaagaaaaaattagctgggcatggcgatgtgcacctgtagccccagctactctgaaggctgaggtgggaggatcacttgagcccagaaggttgaggctacagtgagctgtgatagcacctctgcactccagtctgggcaatagagcaagaacctgtctctaaaaacaaacaaacaaacaaacaaaaacactcctatcttaaatgtaatgtgggacactggaacagaaagaggacattagtaagaaaactagtgacacacaaatacagcttgcagtttcactgatagtgacatgctatgttggtttcctaattgtgacaaatgtaccccagtactgtgggattttaagagaagagaaactgtgaggggtggggcataagggaactttctgtattgttttgtgacttttctgtaaatctaaaattatttcaaaattaaactttttttttttttgagacagtctcgctctgtcacccaggctggagtgcagtgacgtgatctcggctcactgaaacctctgcctcccggattcaagcaattctcctgcctcagcctcccgagtagctgggactacaggcgtgtgccaacacgcccggctaatttttgtatttttagtagagacagggttttaccatgttggccaggctggtcttgaactcctgacctcgtgatccacccaccttggcctcccaaagtgctgggattacaggcatgagccactgcatctggcctaaacattacttttttaaaactcctatgtacctcctaaaaagaaggtaattcggtctctggaaggttcttttgtctgcctatggcgcacttttgggtgtgggtttacaaatcaaggcactggagctaactccataggagagggagaagaatctggaattctcagcctgaaagtgcagggatgagaagagacaggcagatgggagaggagcttagactggaacggggctgggctggggccaggaagccccttgcgagggactttgcagaacaggaatgtccaacactgacgctacaaactagagatgcacaggctggagaccacctctacacatgtgcttgttggtcctcggttttgtcaaaataatttgagccaatacataaaaaacagctgatctcacatgaaaattggaatttccaacttctctggaaacatctgaagatatgctaagtctctgaaaacttaaccccctctgcttcctaaaatcaaaaaggaagtcctgaggttaacttcaaccaaggttgcaagttcccctctgtagcaggctgagtggtggcccccaaaagcttcccttgtcaaacccctgaacctgtgaagtgaccgtatttggaaaaaagggtctttgcagatgcaaaggaccgctagatgagatcagcccggattatctaggtggcctctaaatccaatgacaagtgcttttataagagaaagacaaggctggccaggcgcggtggctcacgcctataatcccagcacttagggaggccaaggtgggcaggccatctgaggttaggagtttgagaccagcctggccaacacagtgaaacccatctttactaaaaatacaaaaatgagccgggtgtggtggtgggtgcctgtagtcccagttactcaggaggctgaggcaggagaatcgcttgaactcgggaggtggaggttgtagtaagccaagattgtgccactgcactccaatctgggtgacagagcaaggctctgtctcaaaaaaaaaaaaaaaaattgaaatactactctaccagttggcacagagccctcctcctgggaccccagagttcttcacaattcagcaagtaagaataaccaccgcaggggtcttcctgtgtccgggcccaaacctccctgctgattgagctgtcctcctgggtaatatttctttactgcatggattggggtgggtgtcgggtgcctgggccccgatggaaaagaacaggtggcatttgttgggcctcagttcagctgtcccgggaagcacagaggcccctgggatttcaaggcaacgtctctatccccctgcgcaatccccgtggagacaggcagacaggaatgtctacaccagagaccctgggatgggaggagtgcagatggggctcccagacacagggggaggccctggaccacccaaagtctctctgcaactccaccagagagggctgagaggagagccgtggtctggtggaaaaacctaactgggcgatgaggcagttggcccaagtagaagtcagaggttaggggtaagaggtagtacactttattgaccgggttctctcaacatgttgcaacctctggcaaagccagatcctgggctttgccaccatcccatccaccaaagacagaagagaatgcatctcatgaacatccacgtggcctccagacagcagagcacaggggcgggtgtggggagggaggctgccagccaggggtgggtggacgaggggcgaaagcgctgggtgccgggctgggggcacccctgaggcccctccagacctggccagcccctcactcccccagttgaggtttcgtgtggttcacagtgagactggcttagattggcagcgggcgatggcagacagatgccctccacgctccctacccgccctggccagactcacagagctggcaagagggagagacggaaaatcccgttccccgtgtctccctccgggacagggaagccccttctctggaggggtaaaggggagaggcctagtctctggacatcccccaggctactaaggaagggccattcactcctggctcagaagtttctagaacatcttggtgaaagtgcccgccattactcccaattagaaaaaggtttttgaaatctaggagttgactggggtgcctcaaaccaaacagtaaaaaccctggtaagacctaggtttaaaaaggcagctctacctttgcttaggaggctagggaggtccgtgaaggcgttggctcagggcagcaggggtaaggagtgccctgggaatggggcagggaccaggggcaagatgcaggaagcggtgatccatgggacatggcaggtcgtctttcagtgctgcaggcctgggctcggagggcagctgggggcctccgtgggcacatctgccaggcaggcaccgggtcctctgccccaccgggagaagcaggggccccccatcaggccttgtgactgccgttggctacaggctcgttgtggccagctgtgaagtctgcggcgggctgaagccccagcatctgccgctgcaccagcttggcgtagaggccgccctgggccagcagctgctggtgggtgccctgctgcactacgcggcccttgtccagcaccacaatgaggtgcgcgtgctccacggtgctcagccggtgcgcgatgatgagtaccgtgtgcttctgcaggttgccatggatggcctgctggatctgcggggacagtgggggcctggcttgcatggcacggacgccccacccgcaaccgtgcttcatgccacggcctatgggctgatgcttaacctctctgaggctcagttcacaaacgatggccagcttcctgggtttttcttaaagggagacagctcagggccagacacaatgaggcacctggtgaatgggggatcagctctaccctggccctccagtcttctggtccttcccttccccctcctttttttttttttttttttttaagtcttgctgtcacccaggctggagtgcggtggtgcgatctcagctcactgcaacctctgcctcgtgggttcaatcgagtctcacgcctcagcttcccaagtagctaggggattacaggtgcccgccaccatacccagctaatttttgtatttttagtagagacagggtttcaccatgttggccagactggtctcgaacacctgactttgtgatccgcctggcctcggcctcccaaagtgctgggattacaggtgtgagccaccgcgcctggccttccttgtttcttatctgccttccccactggaatggaaacaccatggggacaagggtctttgtctagttagcccacgataaccccagaatggtgcctggtgcctggtgcctgagaagagctcagtaactctctgtgtaacaaatgaatcaatccgcgcatagactgaggttgctagccatctgcaaatacatgactgggcccacctgaccagtgagaatgcgactcagaggggaagcactagcttgaggtcacacagttataaactgtaggacggagctgctaatccaggtatccccattctgttttttgtttttgtttgtttgtttgttttttcagatggagtctcactctgttgccaaggctggagtgcagtggtgcaatctcggctcattgcaacctctgcttcccaggttcatgctattctcctgcctcagcctcccaagtagctaggattacaggcacctgccaccatacctggcggacttttgtatttttagtagagatggaatttcaccatgttggcccggctggtcttgaactcctgacctcaggtgatccacccgcctcggcctcccaaagtgctgggattataggcataaaccactgcgcccagcctttttttttttttttttgtagatggagtctcactctgtcgcccaggctagagtgcagtggcacaatctcagctcactgcaacctccatctcccgggttcaagtgagtctcctgcctcagcctcccgagtagctggggttacaggcatgcaccaccatgcccagctaatttttgtatttttagtagagacagggtttcactgtattgaccaggcttgtctcgaactccggacctcaagtgatccacctgccttggcctcccaaagtgctgggattataggcatgagccatcatactgggcctattttattttgttttgttttgtctgtttgtttgagccagatggagtctggctctgtcgcccaggctggagtgcagtggcacaatctcggctgactgcaacctccacttcccaggttcaagcaattctcctgcctcagcctcccaagtagctgggattataggcatgtgctaccacacctggctagtttttgtatttctagtagagatggggtttcaccatgttggccaggctggtctgcaactcctgacctcaggtgatccacctgcttcggcctcccaaagtgctgggattacaggtgtaagccaccactcatgacccaggtctccccattctgatgccttctcttgccccacaccatacagctctgcctggagcctggaggctgggtccagagtggctcctggctccccactctcaacaccaggaattcaccagcccaggaggctgatagtctgggagagctcctggggcccgtctcttctcagcatccatctgctgggcgatgggggctctggccacctggagccgctcctgcccccgcattgcccaccaccctgtgactcaccagatactcgctctcggcatccaaagcgctggtggcttcatccaggatgaggactggggggttccgcaccagagcccgggccatggccacccgctgcttctggccacctgacagctgggcgcccttctcccctgtctctgtatggtggaggcacagagacaatttagcaatgggtgaggccgggcagcaccggggaagagtgagaggccctgccctgcagctgtggaaagggcgggctggaacccacaacttgaaagctcatgaaatgatgttccccccacccaactcataaggggcatgcagattaagcctacatgcaaattgatagcaagttaccaattttcactcattcatttggcagaaacccaaacatctgatagcacacagtgcaggtgaggctgcagggagacaggccctcacccgtcctcctggagaaggggagttggagcgagccccatggcttgaagagctgcagcaataaccctgggtctatgagtctgtgcagtgcaaaggttgtgtgtattcaccacagatgtgtggcctgtggccccgcaagcccacctggaccaattttccccatggaccgacttcctcccatgcacaacaatatagacacaggtcacctgtgacccacagcgctgttattgcaaaaaataaaacaaatagactcaaatgtccatcaataggaaattgagtcaatcaattattattattttagagacagggtctcactctctcacccacgctagagtgcagtagtacaatcactgcttactgtagcctcaaacttctgggttcaagcaatcctccagcctcagccttctgagtaactgagactacaggtgcatgccaccacacctggctaacttaaaatatttttctgtagaggtggggtctcactacattgcccaagctgttctcaaacccctggcctcaagcgatcctcttgccttggcctccaaagtgctgggattacagacgtgagccactgcacctggccacgccaccagttctttattatttcatttttctttcattgagatgaaactgacataacataaacataaccattgtaaagtgaataatccgggctgagcacggtggctcccagcactttgggaggccaaccaaggtgggcgggtcacaaggtcaggagattgagaccatcctggctaatatggtgaaaccctgtctctactaaaaatacacaaaattagccgggtatggtggcacatgcctgtaatcccagctactcgggaggccgaggcaagagaatcacttgaacccgggaggaagaggttgccgtgagccgagatcgcgccactgcactccagcctgggcgacagagcgagactccatctcaagaaaaaaaaaaaaagtgaataatccagtggcatttagtgcattcacaatgttgcacaaccaccacctctactgaatttcaaaacactattctaaaataatatatatttattatatcaattaattactagaactacttaagttcatatcgaggtaatttttttaaaaattagtgtatttagtatattttaatttaaaaattcttttaaattgacaagtaaaaatagtttgtatttaatggtgtacaacgtgatgctctgaaatacatatacactgtggaatagctaaatcaagccagttaacatatacattatctcacatatttatcacttttttaaagagagaacacttaaaatctactctcttagctattttcaagtacacagtacactgttactaaatatagctggccagacacagtggctcacacctgaaatcccaccactttgggaagccaaggcaggcagatcacctgaggtcaggagttcaagaccagcctggccaaaatagtgaaaccccgtctctactaacaatacaaaaaaaaattagcaaggtgtggtggtgggcacttgtaatcccagctactcaggaggctgaggcaggagaatcgcttgaacctgggagacggaggttgcagtgaggcaagattactccactctactccagcctgggcgacagagtgagactgtctcaattaaaacacaaacaaacaaaaaactatagtcaacaggtctcttgaccttattcctaagggaaaatttttatcttttgatcaacatctccccaacccccctatacattgtatatatttaattattgaaaaggggctattcgtgtggttcaaaaatctaaaaatacaggctggatacaatggctcatgcctgtaatcccagcactttgggaggcaggaggattgcatgagcccaggaatttgagaccagcctgggaaacatagcaagaccccgtctctacaacaaaaataaaaagtggggtggaaggatggcttgagcccaagaggttgaggctgcagtgagccgtgatcacgccactgcactcccacctgggtgacagagcaagcccctgcctcaaaaaaaaaaaaaaaactaaaaaaactaaaaatatataaaactctaaataatgaaaagtttaagttctttcttcagttccctcctgctcccaccaaaacgtctttcattagttgcttacatgtccttgtctagtttctttatgcaaatatgaacatgttatttttatctccccagtcctttaataggaaaaaaaaaacccagctccttatgctctgcacctggctcttctcactcagcatcctatctcagtgacctttccatactgctatatggagagctgcctcctcctctgcctccacctcctcctccgcctccacctcctcccccttcttctacttcctctttttcccagcagcataatattccagtgtatgggcttctataataatttacttaataaatattttgctgagtcacagcacagtggctcatgcctgtaatcccagcactttggggattgcaggaagattgcttgagcgcaggaggttcgagtctggccagggtaacgtagcgggaccccatctctacaaaaaaaagagcaggtggcagggggcagtgcttaactcagagggttatgtccctgagggtgaccctgtgggcccaggagaggggccacccccagctccacacctgtgctgtagccgtcctggagttccatgatgaagccgtgggcattggccttctgtgcggcctccaccaccatctcgaaaggcacagtgggcaggccgtaggagatgttatccgtgatggagcgggcgaacagcacgggctcctggctcaccagggagatctggggaggagggagcatggagcatgagaggccaggaatgtgttcatccagctgtccccagcagccttgctgcctggggcctggagacaccagcagtctcaggcctgaaacctgatcagggcccagtgactgcactgagctgcctctcttcttccccaacagtgactcccgcctgtacccacaagccctcagcctcccctaatcagcaaactggggcctgctacatttgctgctctgggataagccaagttccctgacctctaagagaaagctcactggccatccctgtcctgaaaaaaagaaagagggatagaatatagaatgttgctgtgaatgagtctgctcatctcaggaagcaagaggccacagcagggctccaggtcacacagactgccctggcggtggtcccctcccttctaagagaacaatttaaaggagctatcatctctagattccagtttcaggaatctgggcctacaaaaataatagtatggccaggcctggtggctcatgcctgtaatcccagcacttagggaggcagaggcaggagaatggctttagtctaggagttcaagaccagcctgggcaacacagaaagaccccatatctacaaaatgaaaaaaatatatagtatggaagatatcattgcaacaccataagtagcaaaagttaattagttaattaattaaattaaaatggaaacaatctaggtgtccataaatggggattggttaaatagtgacagtgcatccttaaaactgaattgtaatagatacatatacacagcatgattctatttttgtttaaaaaaattataaacgtgtaccttcatatattgatatatttctataaagataggaaacacattgaaaaggatatttactaaactgttaacactggctacctccatgtggtggaattcaaaaggtaaggtggaggggaacattcatgtcttagttacaagattcattacaactatgagaatatgattagcttgtagcattttattgttttatgtttatagaaattaacattttaaatttaaaaatagaggccagccatggtggttcacacctgtaacaccaacagtttgggaggctaaggtgggaggatggcttgagcccaggagtttgagatcagcctgagcaacacagtgagaacccgtctctacaaaataattaaaaattggccaggtgtacacggtggctcatgcctgtaatcctagcactttgggaggccgaggtgggcggatcacctgaggtcaagagtttgagaccagcctgaccaacatggagaaactctgtctctactaaaaataaaaaattagctgggtgtggtggtgcatgcctgtaatcccagctactcaagaggatgaggcaggagaatcacttgacccctcgaggcggaggatgtggtgagctgagatcgtgccattgtactccagcctgggcaacaagagcaaaactccatctcaaaaaaaaaaaaaaaattgaccagatgtggtggtgtgcacctatagtccctcaggaggctgatgtgggaggattgcttgagcccaggaggtcgtggctgcagtgaaccatgatcacaccaccacattccagcctgggtgacagagtgagatcctatctcaaacaaaaagtacataaatagtccaggcgccatggctcactcccagcattttgggaggccaaggcgggtggatcacttgaggtcaggagttcgagaccagcctggccaacatggtgaaaccttgtctctactaaaactacaaaaaattagccgggtgtggtggtatgtgcctgtagtcccagctacttgggaagctgaggcaggagaatcgcttgaacccaggaggaagaagttgcagtgagccgagatcatgccacagcactctagcctgtgcgacagagcgagactccatcttaaaaaaaaaaaaagaaaagaaaaagtacataaataaataattaagagaggctattcatgaaggaaaaccaaatggccaatatatgaaaaggtgtttaatatcttcagtcatcaggaaaacacaaaagaccacaataagctaccactacattctcaccagttagcaaaaattcaggactgacaatgttaggtgtctgagaatcgaagcgtggtacctactgcaaagtgtgaacggctctgcccagggggctcttctaaaactttggtgagcagcagcctggtggcctcccacttggcaccatttcacaacaatctacctctggttacatgcacatggtgtgggcagatttcacaacccatggccctcaccaccatctcgaacttggctaggagttctggaatctctgtgccaacactcaggctttcacataatttatgttgatgatgtaaacggtgctcccttaatagtttatatttcttggacagtgcacaacctgagcaaccatccagggcatccctgctcttaggccagcacagggacaggtgttatggttcctttcctgaaaggattactaaaaactgtccagtcatgaatagcctattttgagtactggagatgacctaaatgtggaacagctgaaactctccttcactgctagtagaatgtaaattgtaaaatgtaaattggtataaccacctggggatagctgttgtgacagaaactacggcagttggggatgtacatccactatcaccaagctttctactcttaggattataccttgggagaacgtactcatgtacaacagaaaacatagacaaaattgtccacatcccacactggtatttttggtaatggtaaaacaaaacaaaacaaaacaaaactgaaaaacaggccgggggcagaggctcacacctgtcatcccagcactttgggaggctgaggcaggaggatcacttgaggccaggtgtttgagatcagcctgggcaacatggtgagaccacatttctacaaaaaaataaaattagctgggcataatggcatgtgcctgcagtcccagctacttgggaggctgaggtgggaggatgacttgagcacaggactctgaggctgcagtaagttgtgactgtgccactgcactccagcctgggcaacagagggagaccctttctcaaaaaaataaaaataggccaggtgcagtggctcatgcctgtaatcccagcactttgggaggccgaggcgggtggatcacgaggtcaggagatcgagaccatcctggctaacatggtgaaatgccgtctctactaaaaatacaaaaaattagccaggcgttgtggtgtgcacctgtagtcccagctactcaggagactgaggcaggagaatggcgtgaacccgggaggtggagcttgcaatgagccgagatcgtgccactgcactccagcctgggcgacagagcgagactctgtctccaaaaaaaaataaaaataaaaataaacaaataaataaaataaaatataaagggaaacaacccagcgaggcacggtggctcacgcctataaacccaacactttgggaggccaaggcaggctgatcacctgaggtcaagggttcgagaccagcctgggcaacacggtgaaaccctgtctgtactaaaaatacaaaaattagtcaggcatggtgacgcactcctgtaatcccagctactaggggggctgagataggagaatagcttgaacccgggaggcggaggctgcagtgagctgagatctcaccactgcactccagcttgggcaacagagcaagactcatctcaaaaaacaaaaataaagggaaacaacccaaatacccagaatgcataaataattgtgataaacatatgtatagtgggttaccacccagcaatgaaaatgaatgaactctgtccccagcctcaacctggatgactcacaatgtcgagtgggagacacaagacacaaactaatccacacaccaatcacgattctacccagatgaagttccgagcaggcagcacagagctcaggggtgcacacagagatggcagaaccaatgaaaagcaagagcatgaagactctaaaagtcaacacattacttcttggggaaagagaagggacacatggcggggggtaggaggcttctggagtgccagaatgttctatttcttttttttcatgagacagagtcttattctgttgcccaggctgcagtgcagtggcccagtctcggctcactgcaacctctacctcccgggttcaagtgattctcgtgcctcagcctcctgaggagctgagattacaggcatgtgccaccacacccggctaatttttgtatttttagtagagatggggtttcgccatgttggccatgctggtcttgaactcctgagctcaagcagtccacctgccttggcctcccaaagtgctgggattacaggtgtgggccatcacatctgccctttttttcttttttaatagagacggagtctcactatgttgtccaggctggcctcaagggatcctccagcctcagcttcccaaaatgctgggattacaggtgtgagccaccacgtctggacaagaatgttctgtttctctaggagggcattgtaattggtgataattctttgaactgtccatttatctctagtgccctcttccgcacctgttacagctcacaagaaagacggttagatgcagaaagggcggagaagtgtggcccaggcccgtgcacataccacacggtgcaagtacttgtggtcgtaggcgctgatgggcttgccgtccagcagcacccggcccccctccagggggtagaagttctccaggatgttgacacaggagctcttcccactgcccgagggccccaccagggccgtcaccttgccgggggacaggctgaaggagacattctgcaaagaacacacaggcacagtgcggggttatcggctcaggtcccaggactggatgccctgaccttggacacaggtgggtgcccttcccagcccaccccatgtgcctctccctcgcttgggcactgctggcccctaaacgttctttctaagacactaggacttggaagcaccttgagatttgctgtttcctctgtctggaatgttctctctgcagggaggcccctggtgaggtctcacctcaaatgtcacctcctccaagaaccccttcttgactgttaccaccattcccatggaccatccctaccacagcaccctgatctattttctttctagcacttattatcgggaatcattctgttaagtatctgtcttccccaactggagcccaaaactcctggagggcaatgatcttgcctgacatattcccagctgccctgccacagcctggtgtataggaggtgcaccagaaatggggtgacggaaaggctgattctggcaggcctcaagccgcgccctcacctgcaggacctgggtgtggggccgagtgcggtaggtgaaggtcacattctcaaagtccacccggccctccaggtggtcgggggccaagctgccatcgtgcaccatggtcggctgccggtcgatgaactcgaacaccttctcagcagcccccactccctgcatcaggccactgtagacggagcccacggactggggagaggagacacgcgttcctgtcccaccgatacccgactcctgggacccacccctgctactagagaggaggcaggtatagggaaagcaaggagttctggcggggagatgcaggaggccacctgaccacccactggtgcattagataacgacagtaaggggagctgaggacagcagcatcactagcactctaccggccatccagctgagtgggtgccatcatccccacaggagcagatggaagcgaaggaaccggcaggggtgtggcacagtgggaatccagccttgatctttcaattgcgatagcatagctttttttttttttttttaagatggagtctccctctgtcgcccaggctggagtgcattggtgcaatcttggctcactgcaccctccgcctcccaagtcaagtgattctcctgcctcagcctccagagtagctgggattacaggtactcgccaccacgcccagataatatttgtatttttagtagagacagggtttcaccacactggccaggctggtctcaaactcctgaccttaagtgatccgcccacctcaccctcccaaagtgctgggattacaggcatgagtcaccagacatggcttgatttcaattttcaaaatgggtcttaatgtgtactataaataaatatattctccttgggtaaaaatacatagaatatgaatgtaaatcataataacggcccattttcttaagtattctctatttattttttttgagaggagggtctcactctgttacccaggctggagtgcagtggtgtgatcttgctcactgcaacttctgcctcccgggttcaagcaattctccaacctcagactcctgagtagctgggaccacaggcatgagccactactaagcccagttaattttttgtattttcagtagaaatggggttgcaccatgttgcccaggctggtctcgaacttctgagctcaaggaatccgcctgcctcagcctcccaaagtgctgggattacaggtgtgggccactgcgtccggccaagcatgctctgtatgttaggaggtaggttctaacattatctccttttttactgatgaggaatctcaggcacagagggctcaagtaacttggcccaggtcacagagcctagaagtggcagagccaggatttgaatccaggcccatctgtctcctgagttcaggctcttaggtgctgaatgtcctcattggtgataagggggtgatatcggcatctgtgtcctgttactgtgaagacaacagcaacagccggtagtaaacacctaaaaccccagagctggccgggcacagtggctcacacctgtaatcccagcactttgggaggcggaggcaggcggatcatttgaggtcagaagttcgagatcagcctggccaacatggtgcaaccccatttctactgaaaatacaattttgtactaaattttgtactaaaagtacaaaaattagctgggcatggtggtgcatgcctgtagtcccagctactggggaggatgaggcaggagaatagcttgaacccgggaggcaggggttgcggtgagccaagattgcaccactgtactccagcctgggcgacagagcaagactccatctcaaaaaaaaaaaaaaaaaaaacctaaaaagaaaaacattagctgggtgtggtggcatgtgactgtaaccccagctactcaagtggctaaggtgggaagatcacttgagtccaggaggtcaaggctgcagtgagtcatgaaagcaccactgcaccccagcctgggtgacaatgtgagactgtctcaaatagtaatgataataaataaacaacactgcactgaacatctctggacatacatcttcgcccactgctgtgagtactcttgaagcatggattcctaggggcagatttactgctgagtcaaataatatggcaggtgtgattctccagcagatgcaatggcctgagtagcagatgctaggaacaccccaccaacatccttgagcctttgtcagcgcagcacacaaaggcccaatctcttactgcctgcgggctgcgggcttttttgtgggagcgaggcagacaagagaattaacaccctcactccaggctgaccttgagcaatggctgatggcagcttgggtgtaaacaccccagctccctggccctcagatgggatgactctggtgctggtgtcctaccctgtccgctagaaggatcccacctcagttgcccacactggtaactggctccacaactcactctgctgacttccttccttccacgtctcactttccactcccacccccgtttcctgagatcacctcccaaacaaatccgttgcacgccaattctgtctcaggatctgcttgtgcggaaaccaaaatcaagacaatctaaaacacccttgcatttccgaggcactacgctggaagtaggctgggaggaagtcaggcccggctggccctgagccccgttcccgagcaaatgtgatggacgagtcactccaccgctcaggttcagttttcttttcatcacttcaatttctcacagagctgttaagaccattttctgaaatcacctctgtccctaaagggtgttgctgtcacttgttggtagtattatcattctttctttcttttttttttgagatggagtttcgctttggttgcccaggctggagtgcagtggcgcgatcttggctcactgtaacctctgcctcccgggttcaagcgattctcctgcctcggcctcctgaggtgtgagccaccgcacctggccctttctttctttttgagacacggtctctctctgtcgtccagcctggagtgcagtggcgtgatcacggctcactgcggccttgacctcccaggctcaagcgattctctagcctcagcctcctgaggacctgggattacaggcacatgccaccatactcggcttgcctatttatttatcaagacggagtctcgctctgtcacccaggctggagtacagtggtgcgatctcagctcactgcaacctctgcctccagggttcaagcaattctcctctcaagtagctgggattacaggtacccaccaacacgcttggctaatttttgtgttttcagtagagatggggtttcaccatgttggccaggctggtctcgaactcctgacctcaagtgatccacccgcctccgcctcccaaagttctgggattataggcgtgagccaccacgccctgcctagtattatcattcttgatatgatcatgctgtctcccctacttaccttagagagaaataccacattgtcagagtccctggagccccgcccccaccctgttaagatccctcttccccaaactcctcccttctctctggatccccggacacactggcctctcacctccatacaatctcccaggacaaactcgtagatgatgaaggcgatgaggttgccgctggtcatctggcctgagatgacaaggtggcccccgtagtagaggatgctgacctggaccaccagcagtgtgagctggggcagagggagaggggatgtgggtcgaggggaccttagatcccccaccatccccattccctgacccatcccaggctgcagggggaggtgagggcagacccagccacaaactgaaatgccggccgttggcaggggtgtcttccaaggcttgtcactcatgccttcccctgccccgagcatttccctacagaggcctccagctggagcaggctgtgggcttggccacagaacaaggctttctttgtgaggtcctggcacacacatgccacccccaggctcctcagcttggccacctgggaactattcgtcctcctcatggggaagagcatgactcagagagggcaagtgccctggctaaggtcacacagtgagctctctgtctcctcccccagtggggttccgtgaagaaggggctgtgatgggagcgcccatgccttcctcctgtgcctggggggcatctgggaagggagtggagtctgagtacccatggcagcccacaccctagtcagggactccatctgtcctcctcatgcccagccagaactaggctgctgtctggaccaccgtgccttggtggaagctgcaaaggcaccccctgccagcagacggattgctaagaggctcagctagctgagctggaccttagcccctcctctcctccttggctgatacttttgggaggtggcagcaccaggaagtcccagatatcctctttcccctggctcccctgtagaccaccagctccctcctccctctcactccaaaccctcctcattcctccgcagctatgccctgacctgcccacctcccatgtgtgtccagtgtagcagtgacatgatccaagtgctccccatcctccaaggagaggctgtgacgcactcccgggagtgtgccagacactgtcgggagtgtgtgtggctgtgacatgagacctgcccgaaagtggcctagggacctgctgactccccacctcagcaaggatgtttccccagctgggaaaagaaagctcccaccctgccaccccacgtcaggtgactgggagaggggcagccttgcttctgggaaagattctcagcagggcgcggtggctcacgcctgtaatcccagcactttgggaggctgatgcgggtggatcacctgagctcaggagttcgagaccagcctggccaagatagtgaaaccccgtctctaccaaaaatacaaaaattagccaggcatggtggcgggcgcctgtggtcccagctatgcaggaggctgaggcaggagaatcgcttgaacccaggaggcggaggttgcagtgagctgagatggtgccactgcactccagcctgggtgacagagtgaggctctgtctcaaaaaaaaaaaaaaaaaaaaagaaagacagacagattctccaccagcttgacaccaacatgcaggactgatgtcctagatcgagggcttcccccatctttgcatcccatccctccacagccagagctgcctggccaggggcacgtaccccgctgccccagacgtagtacatgtaggcagctgcctccttcctgttcagcttgtacacctgctgcagcttccgcaggtacacctctgcctcctcctcctcattggcgaagctccggacagtcttcatggcactgatggtctcctccgccgtgttgctcgctctggccagggcattctggacctctttggagagcctctatggacaggagggggacaagaaggagaagaccccaaaacagcctcactatgtactggagcccccaggcctctctgggtttttccacccttcgctggcaccagctatatgcaagaggttcctaggacaaaaagacaagatctagccctttctcccccatccccttctggctcaatttgacacactcaggtagtcaactccagagaggctcttggggcaatggtttcagctcctgaaggatagggcacggtgctgatcgttaagtcatccccagtattcaaaagaggctattcatgactggacagtttttggtaatcctttcagaaaaggggcctcaacacctgaccctgtgctggaagagcaggggatgccttggacggttgttcaggttgtacactatttaagaaacaccaactattaaaggggcaccatttacatcatcaacataaattatgttagagcctgagggttgataaagagattccagaactcccagccaagttctacatggtggcaggggccatgggttgtgaaatctgcccacaccatgtgcatgtcaccacaggcagagctgaaaagtggtcccaagtgtgcggccatcaggctgctgttcaccagagtcctggaagaggcccctgggtggagctgttcacactttgcaggagtcactatgctgattctcaagccagccaggaaggctgcctgagagtccaggacaggagcatgcactggcatgtcccatgaccatgtgtcacgccccagccgcaggaagcatgcagggtgcctgagtcatgtttggccatgggcggtgtgtgtggtttgtggagatgactcgctggctacacacaacacattcaggcatggggtggaaaacccaaacagagccttcctgaggcctcccttagctgaactaaaaggcagggcctgcagtgcacacagaggtgggggctgagggggagctccagggtttcttgctccatcccaggggctggtgggaaggccggaagcaaggggtggggagcagcgtgccagaaatggctcagactctaaagaatagatttactttctcatctcagtgaggacggtggggaggctcgtgaccaggaacttcgggaagaggtcctacctgtgtggctggagaagactgtggggagtggcctcaccgggggctgggtgggagatggcttcctttgctaccctggtctcaggtcaccaacaccaaaggctccaatggagctgcgacaatgacttacccggcaccacctggaggccgtcatgcatccaagcccctgctctagaagtaccccacgtgggcctgggtgactgtgagggggttgcctgtacctgtcacagggtcacagccctgcctgtctgaacccagcctgtctgtcccttagggctcgggggcacccgcccattcaggaagcaggaggagggtgaggtcaaacctggctcacggccctagctcggaagcagaagcagtgccgtggggtggccagaggggacagcagcctgcccatgatggcatcacagcgggcccgcgatggcatcacagcgggcccgcaccacccccacatacacaccaggcacgttccaacccagggccttttcactggctgtgccctctgctcagcacatacctcccaagatgcccgcctccttcagacccttattcagatgtccccttctcagcaagacctatttaacttgtatttattcattcattttagagacagggtcttgctgtgtcacccaggctagagtatagtggcacgatcattgctcactacagcctcgacctcctgggctcaggcgatcctccacctcagcatcccaggtagctgggaccacaggcatgcgccaccaagcccagctaactaaaaaaaatttttttttgtagagatggggtcttgctatattgtccaatcttgtctcgaactcctaggctcaagtggtcctcctgcctgtgcctcccaaagttctgggattacaggcatgagccaccgggcccagccagtaaatccaatttaaaattgcagctacacccaatgctcccaatccctctgctcacttcatgtttctccttagcactgaccatcttttactgtattgtggattctcattctttatgctgttggtacctagtatctgtctctgacactagatacaagttccaggaaggcaggggccttgtctttttcactgatgtatcccagtgcctgggacatagcaggtggtcaataattatttattgaatgagcgaagaaatgaatgaatgaatgcaaacacagcctcaagacctgtccttcactagcccttagtggccccctgagcccctcctaaggggatgtttgggggctgccagggtgcacagtccccagcagagacagggcaggcctaccttgtagtacttgccgtagatgttggacaccatcatgatgatggggaagcccatgaaggtgaccaaggagagctgccatgagaggctgaacatgaagaccaccacgcccgtgaccttgactgtgttccgcaggaagacattgatgttctgggagaccaggtcgctgaccatggtggtgtccgaggtcaggcgggagatgaggtcccctggaacacacgcggctcagctctcaccacagcaacccgggccttgggggtggcggtgggggatgctaaggggcctctgagacagacactgggaagccgggcctccctacctgtgggcggggttggggggtgggggagaagagcagatacccctcgagggctactctgagccaatcccagtcatcagcatcttgcttaagcttcatgacatcccgctgtacagcggaggaggctggggctcagaacaggaaggcccccgtagagtcacacagcctgtccgtgactgagccagacttcaaacccatgtctcctccctgtcactggcagagggggtaactcctcttcccttctagggaaataacaacctggctggtggcgggcaggaaagcgcagacacttcttacctaagttggacattgtgctaagagctgtgtaaggaccccatggggtggctactatccgtgttcccattttacagacaagaaaacagaggatcagagaggtgaagttcgtgagtggaggaaccagggcttcgacccaggccggtgtctctcagagcttggatcttggtggatattctatcgtcttccccgttgtggcccctggccctcacctgctgacccccatgggagcagggtctctgtcggccacaggcgtgggtagtcctggacctggtggtttccatggggcaatggaaagcaaggccttggctcctgcagggacctcgggtggcctggcctgggccccacagaggccgcagcccacaccaaaacctcagtgagcaagccagctcccaggacacaggccaagcccagggtgttcccagcctgaactaacagcaggaggagaagacagagggctgagaccacccacacgcccatttcattcctcagtgccaggcaagcccacaggggtggggcccagcccccaggacacctagggcactggaaggaccaacctgtgcggttctcatcaaagaagcttgtctcctgggacaccagtgagcggaagagacagtttcgaaggcgaatgttcagtctggcaaatatgagggtaaaaatgccgccccgaatacctgcggcaaatgagctaattgcagataagagatattatagcacgatgtccttccagaccagtgaccacacccggctgccccctcccgctgccggcaggcctgggagccccaccgcagccccactccagggctggcatccctgcggggtccccctcattcccagtgggagcccccctcaaggtgagggcaaaggggacagttgtgggacaagagacccaaatgtgccagccagaccctcttccttccagaacagctcagacaaagccggttctgtttgggaccagattcctacttggaaaacagccagggagggtgagcagggaaccctgaggactgaagcccttttcagggaccagagggtgtggttctagggtgctctaagacagtgtggaagccggttcccagggtgaccagctgagggacaggcccaccaggggcatttccagggcctccctggcccctgtcttccttaggaacaggccctcccttccctccctggtgcaggtcggggtgtgcggggcagggcgtgggggttgagccagctacctgccaatggccagcaggcacacgatgacgacagccgtgctgaactgatccatgcttttctggatgacgatgccatcaatggcgcggcccgtgtagtagggcaggaaggtctctcctgggggaggcagggcagcctcagggacgtctgcagccaggggaacccgcacccttcctcctgaggctccagaagtccacacaccaacccctctgcccactccaccggtgggctttcctccctcggcaaactcttgctgcccatcgtggggccccagggtgcttaatgcccccctcctcagagaacaggggagcactgggccttgcatccacacagcctgctggttcttctttatttatagtggctaccaggcatcgagccagggctcctgcaggatgcttcattctcttgttttttgagacagggtctcgctgtgtcccccgggctggagtgcagtggtgtaatcatagctcactgcagcatcaaactcctgggctcaggtgatcctcctgtctcagcctcctgagtagggaatacaggcatgtgccaccatgccaggctaatttttttttttttttttttgtagagacaggggtctcactatgtggcccaagctggtctcaacctcctgggttgaagcaatcctcctaccttggcctcccaaagtactgggattataggtatgagccaccgctcctgaactttgtttcattccctttggagcaggccctggaatcacccccattttacaaatgagaaaaattaatttgtttttctttttctaaaatattttcctttttttttttttttttaactttttgagacagggtttcactcctgtcgcccaggctggagtgcagcctcaacctcctgggctcagtggatcttcccacctcagactcctgagtagccgggactacaggcacacgccaccaggcctagctaattttttgtatttttttgtagagacgaggtttcgctaggttgcccaggctggtctctaactcctgggctcaagcgatccacccacctcagcttcccaaagtgctggggttacaggcctgagtcacagcgtccggctgaaagtgaagttgaatgagatgactcgtccaggccacatggcaatcagtggctgattgacgccaaagttgatttcattcttctcaatgggttcagagtccaaattctggaacctcagaagacgttgctattctggttccaagcaatgctggaaattgccaccccacccctcctggtggggcacttgacaccttgctgggtgctttcttacccgcttgccttactgtgttttcacaacaatcctggggtggaatgggagactcacagaggctgaggaatttactccaggtcacacagcaaggggaaaggctgggactcaaacctaaactggctttcaacctgggggctctttcttttcccttcctcctgtggtctgaatgcatctcccaaaatttacatattgaaacataatcgccaatgtgatagggcagagctctccaggatgggatgagggcccttttcaaagggcttgtaagcctggtttgccatctctcgcccttccaccttctgcagcgtgaggacacagcagtcttcccctccagaggacacagcaaggagggaccatcttggaagcagagagtggccctcacgacaccaaacctgctggcaccttgatctgggacttcccagcctctagaacagtacgaaatcagtttctatggtttctaaatgacccagtctgtggtattttgttacagcagcagaaatgagactcccccgacaataatccggaatgtccactctcctcttaaggaaatagtggcatcaccaggccaggccaggcccttgttcatcccaggacctgtttccactgaagttctttccatgagcagagccaggtttggggctgggcatacagtaggtgctcaataaaggtcagtgaatgaaccccgggcaggtctggctagcacagtctggcctggctcagacacttgggtagtgagactttctgtgcagttctggtgccctctgctgggaccatgaggtggcagcctagagggcctgtgtccccacagtccttggccagacgaggtctccagctgaggctgcagagttccacccagcctgagtttctgcctcagtttacccacagaaaagaagagggcaacgatgagctgtgacagaatattctggaatatctgattccagcaagcaccaatgctaataatcgccttactgggtaccaggggctgtgcaaagcatgccggcaaactctcttgctgaatctgcacaagaattacgtgaaactctccaatgcaccagcaaatactcagaccatttccagaacctgaccactttcactgcctctactgccccaaccctggtccaagtcattaacctcactgggactatctcagtagcctgctctcaactttgctcacatcagcctgtccacacagtagaaggcaggatcctgttggaactaacttcagatcttgttgctccttggctcaaaacagtccaaatcccccttctcatccagtgagatggtaaaagccaaagtctttacaatagcccacaaggacctgcatgattgagccgctagcagagacctttgtcttctccccgccccatctcactccctctgctccagctaactggtgtctgctcttgaacaactgggcaccttcctgcctcaggacctttgcatgggctagtccttctgcctggagtgctcttaccacatacatttttttttttttttgagatggagtctcagtctgttacccaggctggagtgcagtggcatgatctcagctcactgcaacctccacttcctgggttcaagtgattctcatgcctcagcctcccaagtagctgagattacaggtgaccgccatcacacccggctaaattttatatatgtatatatatattttgagatggagtcgcactccgtcgcccaggctggagtgtattggcacgatttcagctcgctgtaacctctgccacctgggttcaagtgattgtcctgcctcagcctcccgagtagctgggattacagacacctgccattgcacctggctaatttttgtatttttagtagagatggggtttcaccatgttggcctggctgatcttgaactcctgacctcgtgatccacctgccttggcctcccaaagtgctgggattacaggcatgagccatcgcacctggcctaaattttatatttttattagagacagggtttcaccatgttgcccaggctggtcttgaactcttgacctcaagtgatctgcccgcctcggccttccaaaatgctgggattacaggtgtgagccaccacacccagccacttaccccagatatctgctcccctaccttcttaagtctcaaaggccacccagtaatcctataggtttggtacaattattccttccatttgtggaaatgtattctttacacaaaagaggaaactgaggctcagagagattaagtcacttgcccaagtttatacatttggtttgccatgaaatccatattaaagaatcttaggctacagaaggtagctcacacctgcaatcccagcactttgggaggccgaggtgggaggatcacttgagctggagaggtcaaggctgaagtcgctgtgatcactccactgtactccatccagcctgggtgacagagggaggccctgcctcaaaaaaaaaaaaaaggactccatttgttttttatgtattttttttattttttttgagacggagtttcactcttgttgcccaggctgcgatgcaatggtgcgatctccactcacagcaacctctgcctcctgggttcaagcgattctcctgcctcagcctcccgagtagctgggattacaggcatgcgccaccacacctagctaattttgtatttttagtagagacggggtttctccatgttggtcaggctggtctcgaactcctgacctcaggtgatctgcccccccttgctgagattacaggtgtgagccaccgtgcccggcctattttttattttttgagacagagtctcattccgtcacccaggctggagtgcagtggcacgatatcagctcactgcaacctccacctcccaggttcaagcaattctcctgcctcagccttctgagcagctgggattacaggcgtgtgccaccacgcccggctgatttttgtatttttagtagagacggagtttcaccatgttggccaagctagtcttgaactcctgacctcaagtgatctgcccacctcagccttccaaagtgctgggattataggtgtgagctgctgcacttggcctctaaagaaccttaatttaataagagatactcaaccctaaaactaacatttcccaatgggtggttttttgttttttgtttttgtttgtttgttttaagattctgagggtacagaaaagctgggcactgctgaatgcttgttgattgaaaaataattattaataatcacagtacctaattgtcttttttgagatggggtctcgctatgttgcccaggttggtctcaaactcctaagccaaagcaaccctccctccttggccacccaagtagctgcggtcacaggtacatggcattgcacctggccctaacactgattaagtatttacttgtgctaggcaccaagcttcctctcacttctttctcacagtaccccaagaaagccctcacttcagaatggtcaagtgagcgttggccaggttaataacttgcctaaagttatcagtgaagtcgggagcctgagcctcgagtctgcgccctgactcttgatgcaatcctgcaagccgggaaaatctgctcagcagtatttaaggatgtctgcattccccgaccacacagcagctgacggcagggccccagcaggtcgggtaaacaaggtcatggcatggggcaccatctgtctgcacaggcatgacagtcattcatacttttgttcatttattcattcagtgagcccatctctgtgccagctactgggatccagggtgagtcagacctggcccctgcccctgaggggctcaggacctgggaggggaggcaggagggtgaatgcatacataacagggtcttgctatgttggccagactggtcttgaactcctggcctcaagtgatcctcctgcctcagactcccaaagtactggcattgtaggcatgagccactgtgcccagcataaatgcatagttttttgggtttttgtttttttgttttttttttttttgagacggagtctcactttgttgcctaggctggagtgctgtggcacaatcccagctaactgcagcctccacctcctgggttcaagatatcctcctgcatcagccttctgagtagctgggattacaggcggctgccaccatgcccagctaatttttgtagttttagtagagacggggttttgccatattgtccaggctagtctcgaactcctaacctcaggtgatctgcaggcctcagctccccagagttctgggattataggtgtgagccaccgtacccagcctgaacatatgatttttatgtcataaaagctataactgaggtgcagacaaagttaccacagttggcagaatctaaggtggcttcctaaggaggggacttttgggccgcccagcatgagccaggagaaactgcctggtttaatgggaaggggtcatcccagtcctcacacctgctagtattactgggaggtgtctatgtgccaggagctgtccaaggtgtctcacccatgtggattcactgacctttccaaccccattggaggggtactactatgcccatgtcacagaagaggaggctaagacttagaggggttaaataacttgcctaacctcacacagatgttgaggagatgggactgagagggcagaggtagatcgtaggagtacagggctgcagagtcagggccagctctgggtttgcctgtcctctctcagaacattctggcattgttattgcattgtcacctctctaggctctgtctctgtcagttaacatttttattttactattttattatttatgttttttgagatggagtctcactttgtcactcaggctggagtgcagttgtgtgagcttggctcactgcaacctctgcctcccaggttcaagcaattctcctgcctcagcctcccaaatagctggaattacaggcgtatgccagcacatctggctaagttttatatttttagtagacatggggtttcaccatgttgccaggctggtctcgaactcctgacctcaggtgatccacttgcctcggcctcccaaagtgctgggattataggcatgagccactgtgcccggctaatatttatatatcttttagcagagacggggtttcaccatgttggccaggctcgtctcaaactcctgacctcaagtgatctgcccacctcggcctcccaaagtgttgggattacaggcatgagccaccgcgcccagcttaaaatttttaaaactcataatagctaacaaccctgagcacttaccatgacaagccaagctctgtacttagtccttctcctatttttttttttttctttggtagagacaggtcttgctctgttgcccgggctggagggcagtggcgtcatcatggctcactataactcaagctcctgagctcaagggatcctcccaccttagcctcctgagtagctgggactataggcaagtaccaccatgcccagctaattaaaaaaacatttcttttagagacagggtcctgctgtgttgcccagagtggtctcaaactcctgggctcaagtgatcctgtagccttggtctcccaaagtgctgggattagacatgagccactgcacccagctctcccgttcttttcagcatctaaaatgtcaggaaataaggactccaacaatccttgttgcacagaggagggaagtgaggctcagaaaggctggagaacttacgcagggccactcggctgggtagggagcaggacagggatttgtgcccaggcctcgttgcccccagaacctgtgagctccaaccatgcagtgccaccttcccacccatgttgctgagtggtgccttcaaactgtttggaccagactcacaggcacaaatacatttcatgtcacaaaccaggccacacctgcacgtaggcacacacaactaaaatattaatatcttttttttttttttttggtctcaaactgctgagagttttttttttttttcgttatctgcctgcctcggcctcccaaagcgctgggattacaggcatgagccaccatgcctgcccactctgatgttttctagtctattctctgatgatcccagctccaggaatttattctacagatccatccacattcatatgaaatgtgtatgaacagaattattgacgtgcaggtcgggcgcagtggctcatgcctgtaatcccagcaccttgggaggccaaggcaggcagatcgcttgaactcaggagtttgagactagcctggccaacatggtgaaaccctgtctctactaaaaatacaaaaattagccagacgtggtggcaggcgcctgtaatcccagctgcttgggtggctgaggcaggagaatcgcttgaacccaggagatggaggttgcggtgagccaagatcgcaccactgcattccagcctgggtgacagagcaagactccatctcaaaaaaaaaaaaaaaaaaaaaattcatgttaagaggaaaaggctcaaaataacccaagagtcaaatgatgggagaccaactaaataatctatggtatagccgcacaatggaatattatgaagccaaataaaacaatgaggtactggttggaaaaattccagaacatattgttaagtgaaaagagcaaaacataaaacaatgtgggtgagaggtgggggagtgatgcatgttcttttgatgtgcttgtagctgcataaggaaaagctgggaacatgcacaagaattgagtaagaaagaatgctttcctggccacctgggagtttctgggtccttttcctgcagttagccctgggcagaatgatcagggtagaattagaagtgaaacacagccaggcattgtggcttgcgcctgtaatcccagtgctttgagaggccaaggtgggaggatcacttgagcccaggagttcgagatcagcctggacaacatagtgagatcctatctttacaaatttttctttttttaattagctgggtgtggtgcacgcccctgtagtcccagctatttggaagactgaggtggggggattacttgagcctgggaggttgaagctgccgtaagctgtgatcatgccactgcactacagcctgggcaacagagtgagaccctgtctaaaaaaagaaaaaaacaggagtggaactcatagtttcctttttcttctcttgtcttttactttttccttttttaaattgagatggggtcttgtcatattgcccaggctggtcttgaactcctgggctcaggcaatcttcccaccttggcctcccaaagtgctgggattacaggcgtgagccaccgcgcctggcctattttttcgttttaaattacataaaatagaaatggggcaggcaccgtggctcacgcctgtaatcccagcactttgggaggccgaggccagtggatcacctgaggtcaggagttcaagaccagcctggccaacatggcgaaaacctgtttctactaaaaatacaaaaattagttgggtgtggtggcatatgcctgtagtcccagctacttgagaggctgaggcaggagaatcacttgaagctgggaggcagaggttgcagtgacctgagattgtgccactgcactctagcctaggtgacagagcaatactatgtttcgaaaaaataaataaatacaataaataaataaataaataaaatagaaatgggttctcgctatgttgcccaggctggttttcaactcctgggctcaagtgatcttcctacctcagcctcccaaagtgctgggattatagatatgagccactatgcctggcctcttttccttttcatatcaatttgatgtctgaaccacgtaagtaaaatcttttaaaatctaaggcagtcatatccacctaatttgatgttctggtggccacatgtccccgaggtccttacttacccagagctgccacgatgaggaagaaggaggcggccacgaggaaggccacgtcgggcttggtgtaggagagcagcttctgcagcgtggccccagacgcctgctcgggcggtggccggccgctcccagggaagccctcagcctcggtggccgcccctggctccagggcctgggtgcctggccgcacggtggacagcagccaccagagcaggaaggatgcgccgagtgaaatgtacgtccacacgaacagggcccaaaaccaggggtcccggatgggcctgcgcacctctgagaagagcagcagcttcaccatggcatagatgcccacgaagaggcacacgagggtgatgaccagccacgaggcccgcagccgccggggccccagcgcactgttcttggccacaccaatggtggctcccagcagcaggcagctgcggtacaggcaggctgcccagagatccagcaccgagtcaaagatgttgaagtggcggatgtcctccaggaggctgcggtccaggtggctgaagacatagatggccgtggtcacgcagatgtccacactcatgaaggccaaagtcaccaccaccgccttccacagccgcatcctgctggttggaggtgggcgggtgctgaaggccaggttgtagctcacgggggcaaggccatcatcatccacagggcgaggccaggcctgtagggacaacagcaaacatcagcacaaggggttcaggtttgccactcgctggctgtgtgaccttgagaaagtcacttgacatctctgagccttagttttctcatctgtaaaatggcaatatcaacttcccgggtactaagattccactcattcaagggatacttactgagtgcccactgcggccaggtgctgttctttgttctttgtcatgaacaaaaagaacaaagatccctgctctcctggagatgacatactcatgcaggagacagataataaggaaatgggctcacgcctgtaatcccagcactttgggaggccgaggtaggtggatcacctgaggtcaggagttgaagaccagcctggccaacatggtgaaacccccatctctactaaaaatacaaaatttagctgggtgacagagcgagactccatctcaaaaaaaaaaaaaaaagataataaggaaataatgtgtgtcttgtgaggccaaggttggaggatcccttgaggccaggagttggagagcagcctgggcaacagggtgagaccctgtctttaaaaagcaaacaaacaaacaaacaaacaaacattaactgagtgtggtagcatgctcctgtagtccaagctacttgggaggccaagatgggaggatcgcttcttcagcctgggagttcgaggccacagtgagctatgatcatgccactacactccagccctggtgacagcaagatcctatctctaaaaaaaaaaattttttttaattaaaaaaagagataagggttgtggtggaaaaaagaggggggtaaataggatggggtgagggtgaataggataggggtgggggaagacagagatcaattttattttatttatttatttatttgagacagagtcttgctctgtcgcccaggctggagtacagtggtgcgatcccggctcaccgcaacctccgtctccctggttcaagcgattctcctgcctcagccccccaagtagctgggactacaggtaccccaccaccatgaccagctaactttttgtattttttttagtagagacggggtttcaccatgttggccaggctgttctcaaactcctgacctcaagtgatccacatgcctcagtaacccaaagtctgggatcaaaagcgtgagccactgtgcggggccagagatcaattttaaatagggggccagagaagacctcgctgggtaggtaacacttgagcaagacttgaaagagttatggaagtctgccaagtggctatctggggaaaagcacttggcacaggtgaaacagtgccagagccccaaggcaggagtgccccttgggaaggcagcaaggccccatgagatcagagagggtggggagtatctggaggattttgcatccatagtgaggacgaagctgagataagcagagtttaataaacagccgctgtctttactaccactactcatttctctgaacctgtttcctcatttgcaaaatgtgagtgtgaggttcaatgtgtcagttctgggcagagtgcctggtgcataattgctgctgattgtaatcaaccatatacagtgtgtgcttaataaatgtttgtccacttttctcctcccacgtcaggccttctatctctgcaaccccaaataaactattttggtctaagagggaacttgacagctgtgggggtggcttgcaggccacacagcaatccagaaaccttggcatctgcttggaagtttccagaatcttttcctcctgcccaggttggccctcgtgcccagccctaggcccctttggttttctgaatcttgatgtctgctttatccaaggcatctcccggcactgggtccctcaggactcccccagagccgcagggacacccgggaagtgggcctggaggcctgagtttgtgagtggggcttgtccacggtagggttaggaccgggctggggtgtgtccctgggtgctacctcctgtctcagctccagtccttcctcccgtgggccttttgttgtcatatctgcaaaatgggctgggctctagatcccccaagaggaggggtgaggcgctgggtgacagcggggatgactgtcgtggctgggaaggggccatcctgagagagatcctctccccgaagctctggcgcccaggtgcccaaaccgctcacactgtggcatgactggaacctcacacagtcccacgaggccagggtttccatattcccgtttacagttagggaaactgaggcacagagagacaaaaccacctgatccagacattcagccaacaagggcccaagccaggatgacttgaggcagtcagtgagtgtaggaccccagcatctgcctctccacctgtctactgcatgcctggcacaaagcagttgtctaataactacaagcagacagggatgtaacactgcacttcctgtgagccctgccctgcaccatgtgcttcaaatccaggtggccccacctatttaatcctcacagcaactttgtgagatgtgcactgtcatcccttccacttaacagatggagaaactgaggcccagagaagtgaagaatttgcccaagattacacagcttctgaatagcagagctgggatgtggattcataggtgtctgagcccagaatctgtgttcttcacccctaaactaagataacattcaatatagaaaatgctaccaggggccaggcatggtggctcacacctgtaatcccatctgggcctcttgggaggccaagatgggcaacagcttgagctcacgagttcgattccagcctgggcaacatggcgaaatcccgtctctactaaaaatacaaaaattagccgagcatggtggtgcacgcctgtaaccccagcaactcaggaggctgaggcagaagaatcacttgaaactgggaggtggaggttgcggtgagccgagattgcgccactgcactccagcctgggtgacagagtgaaggaaaatgctaccgggaagtgttcatctaaggaaaagggtccccagcagagggctgggccgtgtggcagaggtgataagactgctgaggctaattgctggcaatgacagcagctggtgccagctgacattggctccaggcacttacatgcgtcagcactcaccagagccctatgaagtaggtcctatcattatccccattttacagttaggaaaactgaggaacagagagattaagtgacctgccctgggtcacagagctaggtgacccacagagttgggtcacaagctgggatgtgaaccctggccgtccagttccaaaatctgtactctcaactccatagctccaacccttcaaaacagcctctccaggaggtaggcacaacccctactaatgctgagaaggggtctgagatgcagagggggaatggagtggggggatataacaacctccaagcctgggccctgctttcacccccacacctccaggcacaccgaagcccatcgcagagatgacagttgcttagtcagcagctgcccctccaaagacggtcagggccaagcagggtcaagggcaaggggaagtgggtaggatggtcggacaccctcagcccaggtcctggctccctccccagccctgcctgtgctgcccacgcaggctcctgtctgctgcaatgcagaggccgtggggagcgagcgagtgggtgagctccagtcagagcccagggagggaagctcctggcctggtgccattccaggcctcccagccaagccactgccggctgcaccaggtgctgccagccgcctcagctgctgctctcctcgtggtgggcacatggggtccctcagtccccagaaaggggctcgggctcagaagtggaacaggaggcagatccgcaagagactcaaaacctggacagcagcccaggggcttggctgactctcccaacctgactcccagcctctgggggaattccttccccatcccccaacagcccagggtaccagtcatgccccccgcctccagaagcctatttatcttcatcagaataaacaaaatttcaaacactcatatcgcagactaccaaagccacattttgcagatggggaaactgaggcccacagagggagggggtgaggcttgtctcaggtcatccaccaggctggggcagagcagtgctagcacctgggtccctgcccccaagcactagtccttctaccacagactcctagcagagtggactccagccccgggtcgggttacagtcctcggtggggacagttactccgttatttttaaagctactgggcagaagcgtgaccaccagccaaggctgcttagaggcctgtcaccgctctccaactgcctgactcagaggatgcgctgggctcggccaggtggagctggagggcaaattgtgagcacatgggtgacctgcttggcctgagggacaaggacaaggtggtggccagaataggccccacccagaaccggacaaggcccaggaagacaggggtggctcgccctgactccgtgcactaaagaatggcacaggataagcaagtggccttgtccccaccaggggtcttgtcaaaggcttttcttcccagggtaggagacattggttggggtatctctaggcatcagctgcagagaaggccagaagacgatagatagcagttattatgacgctgcaacagagaccctttgcagagaaggccaggagacaatagataaaagttattatgacactgcaacagagacccttcaccgggccctactatgtgcctggcacctcccaaagcagccaggcctccccacttccctgggaggaccctgtggtcatcagcttcgttttacagctggggagacagaagaggttaagtgacacgcagaaaaaggacgaaggcaggatggagacccgcatccagggtctccaggatggagactcgggggtcccctgtccaggctattcagggattgcaagaaaaggggccaaagaacttgggtggcccagtggcctcggttcacccctgacatggtgagctttttaccccggtgtgggcccagacccagataagcccattccattcgctgcgcagcaaagcactgactgacagaggcctgctgggtgggagggcctgactgtgggggtccctggctctggggcaggagcgggctgggtctgcgtgggtccatcctgatttcatccctgctgagcctctggcagcccacgtggggcccagcctcactctgggacttgagaagctgtctcaggtgctctcagctctaggagaggcagagaggcgcgaggtgccctccctccaagcctcctcttgtcacccggccctgcactatccggaaaaggggaatgggcagaggcggggatcctgtcagcccagcttaaagctgtctcagttaatgtcaggccgggggaggaggctttttttttttttccagaggcccagaaataaaagaggctcccctgggaacctacaggcctcactgccagcgtggatggcggggagcagcggcagcccactggcctgctgaggagactgagaaaagggctttgcccaggtcagcaggaacaggccagatcccccaggcttctgccaaagccctggtgctcaggatccctgggaagccctgacatggacagtgggagccctcagaaggcgcgccagccccgtcctgggggaacgacagccatcccaggatcctccaacacctcccacattttccaagaggcagcggcgccttgggggttaaaaaaaatggcaacattcgccctacgggcgcggaaaggatgctgcagggatgggggctgggagctgcggctgcgggctccgggagggctccagggaggctcccaccttcaaccgagatgcctattcccaccgaggcaggggtgcccagacgccccccaacgcgtgcctggcctggcaccctggcctggaaaggtcccaaaaccaggggtctagggtgccttgcccttacctgttacctggcaccaggtgagctctgggagggggcgcgcagcaggctcgggtctggggtgcagtttccgcgctgctcattgaagactgcgccggacgcggtcctcgctccgctcttcccgctgctcctccccgcctcccacccgcgctgcgccgctgcaaggtcggagctgagactggcgtgcgttgagacaggctgatggacggggcggggcctcagtgac

SEQ ID NO: 762 - DNA, 37518 bp, Homo sapiens
ttaggggtaagaggtagtacactttattgaccgggttctctcaacatgttgcaacctctggcaaagccagatcctgggctttgccaccatcccatccaccaaagacagaagagaatgcatctcatgaacatccacgtggcctccagacagcagagcacaggggcgggtgtggggagggaggctgccagccaggggtgggtggacgaggggcgaaagcgctgggtgccgggctgggggcacccctgaggcccctccagacctggccagcccctcactcccccagttgaggtttcgtgtggttcacagtgagactggcttagattggcagcgggcgatggcagacagatgccctccacgctccctacccgccctggccagactcacagagctggcaagagggagagacggaaaatcccgttccccgtgtctccctccgggacagggaagccccttctctggaggggtaaaggggagaggcctagtctctggacatcccccaggctactaaggaagggccattcactcctggctcagaagtttctagaacatcttggtgaaagtgcccgccattactcccaattagaaaaaggtttttgaaatctaggagttgactggggtgcctcaaaccaaacagtaaaaaccctggtaagacctaggtttaaaaaggcagctctacctttgcttaggaggctagggaggtccgtgaaggcgttggctcagggcagcaggggtaaggagtgccctgggaatggggcagggaccaggggcaagatgcaggaagcggtgatccatgggacatggcaggtcgtctttcagtgctgcaggcctgggctcggagggcagctgggggcctccgtgggcacatctgccaggcaggcaccgggtcctctgccccaccgggagaagcaggggccccccatcaggccttgtgactgccgttggctacaggctcgttgtggccagctgtgaagtctgcggcgggctgaagccccagcatctgccgctgcaccagcttggcgtagaggccgccctgggccagcagctgctggtgggtgccctgctgcactacgcggcccttgtccagcaccacaatgaggtgcgcgtgctccacggtgctcagccggtgcgcgatgatgagtaccgtgtgcttctgcaggttgccatggatggcctgctggatctgcggggacagtgggggcctggcttgcatggcacggacgccccacccgcaaccgtgcttcatgccacggcctatgggctgatgcttaacctctctgaggctcagttcacaaacgatggccagcttcctgggtttttcttaaagggagacagctcagggccagacacaatgaggcacctggtgaatgggggatcagctctaccctggccctccagtcttctggtccttcccttccccctcctttttttttttttttttttttaagtcttgctgtcacccaggctggagtgcggtggtgcgatctcagctcactgcaacctctgcctcgtgggttcaatcgagtctcacgcctcagcttcccaagtagctaggggattacaggtgcccgccaccatacccagctaatttttgtatttttagtagagacagggtttcaccatgttggccagactggtctcgaacacctgactttgtgatccgcctggcctcggcctcccaaagtgctgggattacaggtgtgagccaccgcgcctggccttccttgtttcttatctgccttccccactggaatggaaacaccatggggacaagggtctttgtctagttagcccacgataaccccagaatggtgcctggtgcctggtgcctgagaagagctcagtaactctctgtgtaacaaatgaatcaatccgcgcatagactgaggttgctagccatctgcaaatacatgactgggcccacctgaccagtgagaatgcgactcagaggggaagcactagcttgaggtcacacagttataaactgtaggacggagctgctaatccaggtatccccattctgttttttgtttttgtttgtttgtttgttttttcagatggagtctcactctgttgccaaggctggagtgcagtggtgcaatctcggctcattgcaacctctgcttcccaggttcatgctattctcctgcctcagcctcccaagtagctaggattacaggcacctgccaccatacctggcggacttttgtatttttagtagagatggaatttcaccatgttggcccggctggtcttgaactcctgacctcaggtgatccacccgcctcggcctcccaaagtgctgggattataggcataaaccactgcgcccagcctttttttttttttttttgtagatggagtctcactctgtcgcccaggctagagtgcagtggcacaatctcagctcactgcaacctccatctcccgggttcaagtgagtctcctgcctcagcctcccgagtagctggggttacaggcatgcaccaccatgcccagctaatttttgtatttttagtagagacagggtttcactgtattgaccaggcttgtctcgaactccggacctcaagtgatccacctgccttggcctcccaaagtgctgggattataggcatgagccatcatactgggcctattttattttgttttgttttgtctgtttgtttgagccagatggagtctggctctgtcgcccaggctggagtgcagtggcacaatctcggctgactgcaacctccacttcccaggttcaagcaattctcctgcctcagcctcccaagtagctgggattataggcatgtgctaccacacctggctagtttttgtatttctagtagagatggggtttcaccatgttggccaggctggtctgcaactcctgacctcaggtgatccacctgcttcggcctcccaaagtgctgggattacaggtgtaagccaccactcatgacccaggtctccccattctgatgccttctcttgccccacaccatacagctctgcctggagcctggaggctgggtccagagtggctcctggctccccactctcaacaccaggaattcaccagcccaggaggctgatagtctgggagagctcctggggcccgtctcttctcagcatccatctgctgggcgatgggggctctggccacctggagccgctcctgcccccgcattgcccaccaccctgtgactcaccagatactcgctctcggcatccaaagcgctggtggcttcatccaggatgaggactggggggttccgcaccagagcccgggccatggccacccgctgcttctggccacctgacagctgggcgcccttctcccctgtctctgtatggtggaggcacagagacaatttagcaatgggtgaggccgggcagcaccggggaagagtgagaggccctgccctgcagctgtggaaagggcgggctggaacccacaacttgaaagctcatgaaatgatgttccccccacccaactcataaggggcatgcagattaagcctacatgcaaattgatagcaagttaccaattttcactcattcatttggcagaaacccaaacatctgatagcacacagtgcaggtgaggctgcagggagacaggccctcacccgtcctcctggagaaggggagttggagcgagccccatggcttgaagagctgcagcaataaccctgggtctatgagtctgtgcagtgcaaaggttgtgtgtattcaccacagatgtgtggcctgtggccccgcaagcccacctggaccaattttccccatggaccgacttcctcccatgcacaacaatatagacacaggtcacctgtgacccacagcgctgttattgcaaaaaataaaacaaatagactcaaatgtccatcaataggaaattgagtcaatcaattattattattttagagacagggtctcactctctcacccacgctagagtgcagtagtacaatcactgcttactgtagcctcaaacttctgggttcaagcaatcctccagcctcagccttctgagtaactgagactacaggtgcatgccaccacacctggctaacttaaaatatttttctgtagaggtggggtctcactacattgcccaagctgttctcaaacccctggcctcaagcgatcctcttgccttggcctccaaagtgctgggattacagacgtgagccactgcacctggccacgccaccagttctttattatttcatttttctttcattgagatgaaactgacataacataaacataaccattgtaaagtgaataatccgggctgagcacggtggctcccagcactttgggaggccaaccaaggtgggcgggtcacaaggtcaggagattgagaccatcctggctaatatggtgaaaccctgtctctactaaaaatacacaaaattagccgggtatggtggcacatgcctgtaatcccagctactcgggaggccgaggcaagagaatcacttgaacccgggaggaagaggttgccgtgagccgagatcgcgccactgcactccagcctgggcgacagagcgagactccatctcaagaaaaaaaaaaaaagtgaataatccagtggcatttagtgcattcacaatgttgcacaaccaccacctctactgaatttcaaaacactattctaaaataatatatatttattatatcaattaattactagaactacttaagttcatatcgaggtaatttttttaaaaattagtgtatttagtatattttaatttaaaaattcttttaaattgacaagtaaaaatagtttgtatttaatggtgtacaacgtgatgctctgaaatacatatacactgtggaatagctaaatcaagccagttaacatatacattatctcacatatttatcacttttttaaagagagaacacttaaaatctactctcttagctattttcaagtacacagtacactgttactaaatatagctggccagacacagtggctcacacctgaaatcccaccactttgggaagccaaggcaggcagatcacctgaggtcaggagttcaagaccagcctggccaaaatagtgaaaccccgtctctactaacaatacaaaaaaaaattagcaaggtgtggtggtgggcacttgtaatcccagctactcaggaggctgaggcaggagaatcgcttgaacctgggagacggaggttgcagtgaggcaagattactccactctactccagcctgggcgacagagtgagactgtctcaattaaaacacaaacaaacaaaaaactatagtcaacaggtctcttgaccttattcctaagggaaaatttttatcttttgatcaacatctccccaacccccctatacattgtatatatttaattattgaaaaggggctattcgtgtggttcaaaaatctaaaaatacaggctggatacaatggctcatgcctgtaatcccagcactttgggaggcaggaggattgcatgagcccaggaatttgagaccagcctgggaaacatagcaagaccccgtctctacaacaaaaataaaaagtggggtggaaggatggcttgagcccaagaggttgaggctgcagtgagccgtgatcacgccactgcactcccacctgggtgacagagcaagcccctgcctcaaaaaaaaaaaaaaaactaaaaaaactaaaaatatataaaactctaaataatgaaaagtttaagttctttcttcagttccctcctgctcccaccaaaacgtctttcattagttgcttacatgtccttgtctagtttctttatgcaaatatgaacatgttatttttatctccccagtcctttaataggaaaaaaaaaacccagctccttatgctctgcacctggctcttctcactcagcatcctatctcagtgacctttccatactgctatatggagagctgcctcctcctctgcctccacctcctcctccgcctccacctcctcccccttcttctacttcctctttttcccagcagcataatattccagtgtatgggcttctataataatttacttaataaatattttgctgagtcacagcacagtggctcatgcctgtaatcccagcactttggggattgcaggaagattgcttgagcgcaggaggttcgagtctggccagggtaacgtagcgggaccccatctctacaaaaaaaagagcaggtggcagggggcagtgcttaactcagagggttatgtccctgagggtgaccctgtgggcccaggagaggggccacccccagctccacacctgtgctgtagccgtcctggagttccatgatgaagccgtgggcattggccttctgtgcggcctccaccaccatctcgaaaggcacagtgggcaggccgtaggagatgttatccgtgatggagcgggcgaacagcacgggctcctggctcaccagggagatctggggaggagggagcatggagcatgagaggccaggaatgtgttcatccagctgtccccagcagccttgctgcctggggcctggagacaccagcagtctcaggcctgaaacctgatcagggcccagtgactgcactgagctgcctctcttcttccccaacagtgactcccgcctgtacccacaagccctcagcctcccctaatcagcaaactggggcctgctacatttgctgctctgggataagccaagttccctgacctctaagagaaagctcactggccatccctgtcctgaaaaaaagaaagagggatagaatatagaatgttgctgtgaatgagtctgctcatctcaggaagcaagaggccacagcagggctccaggtcacacagactgccctggcggtggtcccctcccttctaagagaacaatttaaaggagctatcatctctagattccagtttcaggaatctgggcctacaaaaataatagtatggccaggcctggtggctcatgcctgtaatcccagcacttagggaggcagaggcaggagaatggctttagtctaggagttcaagaccagcctgggcaacacagaaagaccccatatctacaaaatgaaaaaaatatatagtatggaagatatcattgcaacaccataagtagcaaaagttaattagttaattaattaaattaaaatggaaacaatctaggtgtccataaatggggattggttaaatagtgacagtgcatccttaaaactgaattgtaatagatacatatacacagcatgattctatttttgtttaaaaaaattataaacgtgtaccttcatatattgatatatttctataaagataggaaacacattgaaaaggatatttactaaactgttaacactggctacctccatgtggtggaattcaaaaggtaaggtggaggggaacattcatgtcttagttacaagattcattacaactatgagaatatgattagcttgtagcattttattgttttatgtttatagaaattaacattttaaatttaaaaatagaggccagccatggtggttcacacctgtaacaccaacagtttgggaggctaaggtgggaggatggcttgagcccaggagtttgagatcagcctgagcaacacagtgagaacccgtctctacaaaataattaaaaattggccaggtgtacacggtggctcatgcctgtaatcctagcactttgggaggccgaggtgggcggatcacctgaggtcaagagtttgagaccagcctgaccaacatggagaaactctgtctctactaaaaataaaaaattagctgggtgtggtggtgcatgcctgtaatcccagctactcaagaggatgaggcaggagaatcacttgacccctcgaggcggaggatgtggtgagctgagatcgtgccattgtactccagcctgggcaacaagagcaaaactccatctcaaaaaaaaaaaaaaaattgaccagatgtggtggtgtgcacctatagtccctcaggaggctgatgtgggaggattgcttgagcccaggaggtcgtggctgcagtgaaccatgatcacaccaccacattccagcctgggtgacagagtgagatcctatctcaaacaaaaagtacataaatagtccaggcgccatggctcactcccagcattttgggaggccaaggcgggtggatcacttgaggtcaggagttcgagaccagcctggccaacatggtgaaaccttgtctctactaaaactacaaaaaattagccgggtgtggtggtatgtgcctgtagtcccagctacttgggaagctgaggcaggagaatcgcttgaacccaggaggaagaagttgcagtgagccgagatcatgccacagcactctagcctgtgcgacagagcgagactccatcttaaaaaaaaaaaaagaaaagaaaaagtacataaataaataattaagagaggctattcatgaaggaaaaccaaatggccaatatatgaaaaggtgtttaatatcttcagtcatcaggaaaacacaaaagaccacaataagctaccactacattctcaccagttagcaaaaattcaggactgacaatgttaggtgtctgagaatcgaagcgtggtacctactgcaaagtgtgaacggctctgcccagggggctcttctaaaactttggtgagcagcagcctggtggcctcccacttggcaccatttcacaacaatctacctctggttacatgcacatggtgtgggcagatttcacaacccatggccctcaccaccatctcgaacttggctaggagttctggaatctctgtgccaacactcaggctttcacataatttatgttgatgatgtaaacggtgctcccttaatagtttatatttcttggacagtgcacaacctgagcaaccatccagggcatccctgctcttaggccagcacagggacaggtgttatggttcctttcctgaaaggattactaaaaactgtccagtcatgaatagcctattttgagtactggagatgacctaaatgtggaacagctgaaactctccttcactgctagtagaatgtaaattgtaaaatgtaaattggtataaccacctggggatagctgttgtgacagaaactacggcagttggggatgtacatccactatcaccaagctttctactcttaggattataccttgggagaacgtactcatgtacaacagaaaacatagacaaaattgtccacatcccacactggtatttttggtaatggtaaaacaaaacaaaacaaaacaaaactgaaaaacaggccgggggcagaggctcacacctgtcatcccagcactttgggaggctgaggcaggaggatcacttgaggccaggtgtttgagatcagcctgggcaacatggtgagaccacatttctacaaaaaaataaaattagctgggcataatggcatgtgcctgcagtcccagctacttgggaggctgaggtgggaggatgacttgagcacaggactctgaggctgcagtaagttgtgactgtgccactgcactccagcctgggcaacagagggagaccctttctcaaaaaaataaaaataggccaggtgcagtggctcatgcctgtaatcccagcactttgggaggccgaggcgggtggatcacgaggtcaggagatcgagaccatcctggctaacatggtgaaatgccgtctctactaaaaatacaaaaaattagccaggcgttgtggtgtgcacctgtagtcccagctactcaggagactgaggcaggagaatggcgtgaacccgggaggtggagcttgcaatgagccgagatcgtgccactgcactccagcctgggcgacagagcgagactctgtctccaaaaaaaaataaaaataaaaataaacaaataaataaaataaaatataaagggaaacaacccagcgaggcacggtggctcacgcctataaacccaacactttgggaggccaaggcaggctgatcacctgaggtcaagggttcgagaccagcctgggcaacacggtgaaaccctgtctgtactaaaaatacaaaaattagtcaggcatggtgacgcactcctgtaatcccagctactaggggggctgagataggagaatagcttgaacccgggaggcggaggctgcagtgagctgagatctcaccactgcactccagcttgggcaacagagcaagactcatctcaaaaaacaaaaataaagggaaacaacccaaatacccagaatgcataaataattgtgataaacatatgtatagtgggttaccacccagcaatgaaaatgaatgaactctgtccccagcctcaacctggatgactcacaatgtcgagtgggagacacaagacacaaactaatccacacaccaatcacgattctacccagatgaagttccgagcaggcagcacagagctcaggggtgcacacagagatggcagaaccaatgaaaagcaagagcatgaagactctaaaagtcaacacattacttcttggggaaagagaagggacacatggcggggggtaggaggcttctggagtgccagaatgttctatttcttttttttcatgagacagagtcttattctgttgcccaggctgcagtgcagtggcccagtctcggctcactgcaacctctacctcccgggttcaagtgattctcgtgcctcagcctcctgaggagctgagattacaggcatgtgccaccacacccggctaatttttgtatttttagtagagatggggtttcgccatgttggccatgctggtcttgaactcctgagctcaagcagtccacctgccttggcctcccaaagtgctgggattacaggtgtgggccatcacatctgccctttttttcttttttaatagagacggagtctcactatgttgtccaggctggcctcaagggatcctccagcctcagcttcccaaaatgctgggattacaggtgtgagccaccacgtctggacaagaatgttctgtttctctaggagggcattgtaattggtgataattctttgaactgtccatttatctctagtgccctcttccgcacctgttacagctcacaagaaagacggttagatgcagaaagggcggagaagtgtggcccaggcccgtgcacataccacacggtgcaagtacttgtggtcgtaggcgctgatgggcttgccgtccagcagcacccggcccccctccagggggtagaagttctccaggatgttgacacaggagctcttcccactgcccgagggccccaccagggccgtcaccttgccgggggacaggctgaaggagacattctgcaaagaacacacaggcacagtgcggggttatcggctcaggtcccaggactggatgccctgaccttggacacaggtgggtgcccttcccagcccaccccatgtgcctctccctcgcttgggcactgctggcccctaaacgttctttctaagacactaggacttggaagcaccttgagatttgctgtttcctctgtctggaatgttctctctgcagggaggcccctggtgaggtctcacctcaaatgtcacctcctccaagaaccccttcttgactgttaccaccattcccatggaccatccctaccacagcaccctgatctattttctttctagcacttattatcgggaatcattctgttaagtatctgtcttccccaactggagcccaaaactcctggagggcaatgatcttgcctgacatattcccagctgccctgccacagcctggtgtataggaggtgcaccagaaatggggtgacggaaaggctgattctggcaggcctcaagccgcgccctcacctgcaggacctgggtgtggggccgagtgcggtaggtgaaggtcacattctcaaagtccacccggccctccaggtggtcgggggccaagctgccatcgtgcaccatggtcggctgccggtcgatgaactcgaacaccttctcagcagcccccactccctgcatcaggccactgtagacggagcccacggactggggagaggagacacgcgttcctgtcccaccgatacccgactcctgggacccacccctgctactagagaggaggcaggtatagggaaagcaaggagttctggcggggagatgcaggaggccacctgaccacccactggtgcattagataacgacagtaaggggagctgaggacagcagcatcactagcactctaccggccatccagctgagtgggtgccatcatccccacaggagcagatggaagcgaaggaaccggcaggggtgtggcacagtgggaatccagccttgatctttcaattgcgatagcatagctttttttttttttttttaagatggagtctccctctgtcgcccaggctggagtgcattggtgcaatcttggctcactgcaccctccgcctcccaagtcaagtgattctcctgcctcagcctccagagtagctgggattacaggtactcgccaccacgcccagataatatttgtatttttagtagagacagggtttcaccacactggccaggctggtctcaaactcctgaccttaagtgatccgcccacctcaccctcccaaagtgctgggattacaggcatgagtcaccagacatggcttgatttcaattttcaaaatgggtcttaatgtgtactataaataaatatattctccttgggtaaaaatacatagaatatgaatgtaaatcataataacggcccattttcttaagtattctctatttattttttttgagaggagggtctcactctgttacccaggctggagtgcagtggtgtgatcttgctcactgcaacttctgcctcccgggttcaagcaattctccaacctcagactcctgagtagctgggaccacaggcatgagccactactaagcccagttaattttttgtattttcagtagaaatggggttgcaccatgttgcccaggctggtctcgaacttctgagctcaaggaatccgcctgcctcagcctcccaaagtgctgggattacaggtgtgggccactgcgtccggccaagcatgctctgtatgttaggaggtaggttctaacattatctccttttttactgatgaggaatctcaggcacagagggctcaagtaacttggcccaggtcacagagcctagaagtggcagagccaggatttgaatccaggcccatctgtctcctgagttcaggctcttaggtgctgaatgtcctcattggtgataagggggtgatatcggcatctgtgtcctgttactgtgaagacaacagcaacagccggtagtaaacacctaaaaccccagagctggccgggcacagtggctcacacctgtaatcccagcactttgggaggcggaggcaggcggatcatttgaggtcagaagttcgagatcagcctggccaacatggtgcaaccccatttctactgaaaatacaattttgtactaaattttgtactaaaagtacaaaaattagctgggcatggtggtgcatgcctgtagtcccagctactggggaggatgaggcaggagaatagcttgaacccgggaggcaggggttgcggtgagccaagattgcaccactgtactccagcctgggcgacagagcaagactccatctcaaaaaaaaaaaaaaaaaaaacctaaaaagaaaaacattagctgggtgtggtggcatgtgactgtaaccccagctactcaagtggctaaggtgggaagatcacttgagtccaggaggtcaaggctgcagtgagtcatgaaagcaccactgcaccccagcctgggtgacaatgtgagactgtctcaaatagtaatgataataaataaacaacactgcactgaacatctctggacatacatcttcgcccactgctgtgagtactcttgaagcatggattcctaggggcagatttactgctgagtcaaataatatggcaggtgtgattctccagcagatgcaatggcctgagtagcagatgctaggaacaccccaccaacatccttgagcctttgtcagcgcagcacacaaaggcccaatctcttactgcctgcgggctgcgggcttttttgtgggagcgaggcagacaagagaattaacaccctcactccaggctgaccttgagcaatggctgatggcagcttgggtgtaaacaccccagctccctggccctcagatgggatgactctggtgctggtgtcctaccctgtccgctagaaggatcccacctcagttgcccacactggtaactggctccacaactcactctgctgacttccttccttccacgtctcactttccactcccacccccgtttcctgagatcacctcccaaacaaatccgttgcacgccaattctgtctcaggatctgcttgtgcggaaaccaaaatcaagacaatctaaaacacccttgcatttccgaggcactacgctggaagtaggctgggaggaagtcaggcccggctggccctgagccccgttcccgagcaaatgtgatggacgagtcactccaccgctcaggttcagttttcttttcatcacttcaatttctcacagagctgttaagaccattttctgaaatcacctctgtccctaaagggtgttgctgtcacttgttggtagtattatcattctttctttcttttttttttgagatggagtttcgctttggttgcccaggctggagtgcagtggcgcgatcttggctcactgtaacctctgcctcccgggttcaagcgattctcctgcctcggcctcctgaggtgtgagccaccgcacctggccctttctttctttttgagacacggtctctctctgtcgtccagcctggagtgcagtggcgtgatcacggctcactgcggccttgacctcccaggctcaagcgattctctagcctcagcctcctgaggacctgggattacaggcacatgccaccatactcggcttgcctatttatttatcaagacggagtctcgctctgtcacccaggctggagtacagtggtgcgatctcagctcactgcaacctctgcctccagggttcaagcaattctcctctcaagtagctgggattacaggtacccaccaacacgcttggctaatttttgtgttttcagtagagatggggtttcaccatgttggccaggctggtctcgaactcctgacctcaagtgatccacccgcctccgcctcccaaagttctgggattataggcgtgagccaccacgccctgcctagtattatcattcttgatatgatcatgctgtctcccctacttaccttagagagaaataccacattgtcagagtccctggagccccgcccccaccctgttaagatccctcttccccaaactcctcccttctctctggatccccggacacactggcctctcacctccatacaatctcccaggacaaactcgtagatgatgaaggcgatgaggttgccgctggtcatctggcctgagatgacaaggtggcccccgtagtagaggatgctgacctggaccaccagcagtgtgagctggggcagagggagaggggatgtgggtcgaggggaccttagatcccccaccatccccattccctgacccatcccaggctgcagggggaggtgagggcagacccagccacaaactgaaatgccggccgttggcaggggtgtcttccaaggcttgtcactcatgccttcccctgccccgagcatttccctacagaggcctccagctggagcaggctgtgggcttggccacagaacaaggctttctttgtgaggtcctggcacacacatgccacccccaggctcctcagcttggccacctgggaactattcgtcctcctcatggggaagagcatgactcagagagggcaagtgccctggctaaggtcacacagtgagctctctgtctcctcccccagtggggttccgtgaagaaggggctgtgatgggagcgcccatgccttcctcctgtgcctggggggcatctgggaagggagtggagtctgagtacccatggcagcccacaccctagtcagggactccatctgtcctcctcatgcccagccagaactaggctgctgtctggaccaccgtgccttggtggaagctgcaaaggcaccccctgccagcagacggattgctaagaggctcagctagctgagctggaccttagcccctcctctcctccttggctgatacttttgggaggtggcagcaccaggaagtcccagatatcctctttcccctggctcccctgtagaccaccagctccctcctccctctcactccaaaccctcctcattcctccgcagctatgccctgacctgcccacctcccatgtgtgtccagtgtagcagtgacatgatccaagtgctccccatcctccaaggagaggctgtgacgcactcccgggagtgtgccagacactgtcgggagtgtgtgtggctgtgacatgagacctgcccgaaagtggcctagggacctgctgactccccacctcagcaaggatgtttccccagctgggaaaagaaagctcccaccctgccaccccacgtcaggtgactgggagaggggcagccttgcttctgggaaagattctcagcagggcgcggtggctcacgcctgtaatcccagcactttgggaggctgatgcgggtggatcacctgagctcaggagttcgagaccagcctggccaagatagtgaaaccccgtctctaccaaaaatacaaaaattagccaggcatggtggcgggcgcctgtggtcccagctatgcaggaggctgaggcaggagaatcgcttgaacccaggaggcggaggttgcagtgagctgagatggtgccactgcactccagcctgggtgacagagtgaggctctgtctcaaaaaaaaaaaaaaaaaaaaagaaagacagacagattctccaccagcttgacaccaacatgcaggactgatgtcctagatcgagggcttcccccatctttgcatcccatccctccacagccagagctgcctggccaggggcacgtaccccgctgccccagacgtagtacatgtaggcagctgcctccttcctgttcagcttgtacacctgctgcagcttccgcaggtacacctctgcctcctcctcctcattggcgaagctccggacagtcttcatggcactgatggtctcctccgccgtgttgctcgctctggccagggcattctggacctctttggagagcctctatggacaggagggggacaagaaggagaagaccccaaaacagcctcactatgtactggagcccccaggcctctctgggtttttccacccttcgctggcaccagctatatgcaagaggttcctaggacaaaaagacaagatctagccctttctcccccatccccttctggctcaatttgacacactcaggtagtcaactccagagaggctcttggggcaatggtttcagctcctgaaggatagggcacggtgctgatcgttaagtcatccccagtattcaaaagaggctattcatgactggacagtttttggtaatcctttcagaaaaggggcctcaacacctgaccctgtgctggaagagcaggggatgccttggacggttgttcaggttgtacactatttaagaaacaccaactattaaaggggcaccatttacatcatcaacataaattatgttagagcctgagggttgataaagagattccagaactcccagccaagttctacatggtggcaggggccatgggttgtgaaatctgcccacaccatgtgcatgtcaccacaggcagagctgaaaagtggtcccaagtgtgcggccatcaggctgctgttcaccagagtcctggaagaggcccctgggtggagctgttcacactttgcaggagtcactatgctgattctcaagccagccaggaaggctgcctgagagtccaggacaggagcatgcactggcatgtcccatgaccatgtgtcacgccccagccgcaggaagcatgcagggtgcctgagtcatgtttggccatgggcggtgtgtgtggtttgtggagatgactcgctggctacacacaacacattcaggcatggggtggaaaacccaaacagagccttcctgaggcctcccttagctgaactaaaaggcagggcctgcagtgcacacagaggtgggggctgagggggagctccagggtttcttgctccatcccaggggctggtgggaaggccggaagcaaggggtggggagcagcgtgccagaaatggctcagactctaaagaatagatttactttctcatctcagtgaggacggtggggaggctcgtgaccaggaacttcgggaagaggtcctacctgtgtggctggagaagactgtggggagtggcctcaccgggggctgggtgggagatggcttcctttgctaccctggtctcaggtcaccaacaccaaaggctccaatggagctgcgacaatgacttacccggcaccacctggaggccgtcatgcatccaagcccctgctctagaagtaccccacgtgggcctgggtgactgtgagggggttgcctgtacctgtcacagggtcacagccctgcctgtctgaacccagcctgtctgtcccttagggctcgggggcacccgcccattcaggaagcaggaggagggtgaggtcaaacctggctcacggccctagctcggaagcagaagcagtgccgtggggtggccagaggggacagcagcctgcccatgatggcatcacagcgggcccgcgatggcatcacagcgggcccgcaccacccccacatacacaccaggcacgttccaacccagggccttttcactggctgtgccctctgctcagcacatacctcccaagatgcccgcctccttcagacccttattcagatgtccccttctcagcaagacctatttaacttgtatttattcattcattttagagacagggtcttgctgtgtcacccaggctagagtatagtggcacgatcattgctcactacagcctcgacctcctgggctcaggcgatcctccacctcagcatcccaggtagctgggaccacaggcatgcgccaccaagcccagctaactaaaaaaaatttttttttgtagagatggggtcttgctatattgtccaatcttgtctcgaactcctaggctcaagtggtcctcctgcctgtgcctcccaaagttctgggattacaggcatgagccaccgggcccagccagtaaatccaatttaaaattgcagctacacccaatgctcccaatccctctgctcacttcatgtttctccttagcactgaccatcttttactgtattgtggattctcattctttatgctgttggtacctagtatctgtctctgacactagatacaagttccaggaaggcaggggccttgtctttttcactgatgtatcccagtgcctgggacatagcaggtggtcaataattatttattgaatgagcgaagaaatgaatgaatgaatgcaaacacagcctcaagacctgtccttcactagcccttagtggccccctgagcccctcctaaggggatgtttgggggctgccagggtgcacagtccccagcagagacagggcaggcctaccttgtagtacttgccgtagatgttggacaccatcatgatgatggggaagcccatgaaggtgaccaaggagagctgccatgagaggctgaacatgaagaccaccacgcccgtgaccttgactgtgttccgcaggaagacattgatgttctgggagaccaggtcgctgaccatggtggtgtccgaggtcaggcgggagatgaggtcccctggaacacacgcggctcagctctcaccacagcaacccgggccttgggggtggcggtgggggatgctaaggggcctctgagacagacactgggaagccgggcctccctacctgtgggcggggttggggggtgggggagaagagcagatacccctcgagggctactctgagccaatcccagtcatcagcatcttgcttaagcttcatgacatcccgctgtacagcggaggaggctggggctcagaacaggaaggcccccgtagagtcacacagcctgtccgtgactgagccagacttcaaacccatgtctcctccctgtcactggcagagggggtaactcctcttcccttctagggaaataacaacctggctggtggcgggcaggaaagcgcagacacttcttacctaagttggacattgtgctaagagctgtgtaaggaccccatggggtggctactatccgtgttcccattttacagacaagaaaacagaggatcagagaggtgaagttcgtgagtggaggaaccagggcttcgacccaggccggtgtctctcagagcttggatcttggtggatattctatcgtcttccccgttgtggcccctggccctcacctgctgacccccatgggagcagggtctctgtcggccacaggcgtgggtagtcctggacctggtggtttccatggggcaatggaaagcaaggccttggctcctgcagggacctcgggtggcctggcctgggccccacagaggccgcagcccacaccaaaacctcagtgagcaagccagctcccaggacacaggccaagcccagggtgttcccagcctgaactaacagcaggaggagaagacagagggctgagaccacccacacgcccatttcattcctcagtgccaggcaagcccacaggggtggggcccagcccccaggacacctagggcactggaaggaccaacctgtgcggttctcatcaaagaagcttgtctcctgggacaccagtgagcggaagagacagtttcgaaggcgaatgttcagtctggcaaatatgagggtaaaaatgccgccccgaatacctgcggcaaatgagctaattgcagataagagatattatagcacgatgtccttccagaccagtgaccacacccggctgccccctcccgctgccggcaggcctgggagccccaccgcagccccactccagggctggcatccctgcggggtccccctcattcccagtgggagcccccctcaaggtgagggcaaaggggacagttgtgggacaagagacccaaatgtgccagccagaccctcttccttccagaacagctcagacaaagccggttctgtttgggaccagattcctacttggaaaacagccagggagggtgagcagggaaccctgaggactgaagcccttttcagggaccagagggtgtggttctagggtgctctaagacagtgtggaagccggttcccagggtgaccagctgagggacaggcccaccaggggcatttccagggcctccctggcccctgtcttccttaggaacaggccctcccttccctccctggtgcaggtcggggtgtgcggggcagggcgtgggggttgagccagctacctgccaatggccagcaggcacacgatgacgacagccgtgctgaactgatccatgcttttctggatgacgatgccatcaatggcgcggcccgtgtagtagggcaggaaggtctctcctgggggaggcagggcagcctcagggacgtctgcagccaggggaacccgcacccttcctcctgaggctccagaagtccacacaccaacccctctgcccactccaccggtgggctttcctccctcggcaaactcttgctgcccatcgtggggccccagggtgcttaatgcccccctcctcagagaacaggggagcactgggccttgcatccacacagcctgctggttcttctttatttatagtggctaccaggcatcgagccagggctcctgcaggatgcttcattctcttgttttttgagacagggtctcgctgtgtcccccgggctggagtgcagtggtgtaatcatagctcactgcagcatcaaactcctgggctcaggtgatcctcctgtctcagcctcctgagtagggaatacaggcatgtgccaccatgccaggctaatttttttttttttttttttgtagagacaggggtctcactatgtggcccaagctggtctcaacctcctgggttgaagcaatcctcctaccttggcctcccaaagtactgggattataggtatgagccaccgctcctgaactttgtttcattccctttggagcaggccctggaatcacccccattttacaaatgagaaaaattaatttgtttttctttttctaaaatattttcctttttttttttttttttaactttttgagacagggtttcactcctgtcgcccaggctggagtgcagcctcaacctcctgggctcagtggatcttcccacctcagactcctgagtagccgggactacaggcacacgccaccaggcctagctaattttttgtatttttttgtagagacgaggtttcgctaggttgcccaggctggtctctaactcctgggctcaagcgatccacccacctcagcttcccaaagtgctggggttacaggcctgagtcacagcgtccggctgaaagtgaagttgaatgagatgactcgtccaggccacatggcaatcagtggctgattgacgccaaagttgatttcattcttctcaatgggttcagagtccaaattctggaacctcagaagacgttgctattctggttccaagcaatgctggaaattgccaccccacccctcctggtggggcacttgacaccttgctgggtgctttcttacccgcttgccttactgtgttttcacaacaatcctggggtggaatgggagactcacagaggctgaggaatttactccaggtcacacagcaaggggaaaggctgggactcaaacctaaactggctttcaacctgggggctctttcttttcccttcctcctgtggtctgaatgcatctcccaaaatttacatattgaaacataatcgccaatgtgatagggcagagctctccaggatgggatgagggcccttttcaaagggcttgtaagcctggtttgccatctctcgcccttccaccttctgcagcgtgaggacacagcagtcttcccctccagaggacacagcaaggagggaccatcttggaagcagagagtggccctcacgacaccaaacctgctggcaccttgatctgggacttcccagcctctagaacagtacgaaatcagtttctatggtttctaaatgacccagtctgtggtattttgttacagcagcagaaatgagactcccccgacaataatccggaatgtccactctcctcttaaggaaatagtggcatcaccaggccaggccaggcccttgttcatcccaggacctgtttccactgaagttctttccatgagcagagccaggtttggggctgggcatacagtaggtgctcaataaaggtcagtgaatgaaccccgggcaggtctggctagcacagtctggcctggctcagacacttgggtagtgagactttctgtgcagttctggtgccctctgctgggaccatgaggtggcagcctagagggcctgtgtccccacagtccttggccagacgaggtctccagctgaggctgcagagttccacccagcctgagtttctgcctcagtttacccacagaaaagaagagggcaacgatgagctgtgacagaatattctggaatatctgattccagcaagcaccaatgctaataatcgccttactgggtaccaggggctgtgcaaagcatgccggcaaactctcttgctgaatctgcacaagaattacgtgaaactctccaatgcaccagcaaatactcagaccatttccagaacctgaccactttcactgcctctactgccccaaccctggtccaagtcattaacctcactgggactatctcagtagcctgctctcaactttgctcacatcagcctgtccacacagtagaaggcaggatcctgttggaactaacttcagatcttgttgctccttggctcaaaacagtccaaatcccccttctcatccagtgagatggtaaaagccaaagtctttacaatagcccacaaggacctgcatgattgagccgctagcagagacctttgtcttctccccgccccatctcactccctctgctccagctaactggtgtctgctcttgaacaactgggcaccttcctgcctcaggacctttgcatgggctagtccttctgcctggagtgctcttaccacatacatttttttttttttttgagatggagtctcagtctgttacccaggctggagtgcagtggcatgatctcagctcactgcaacctccacttcctgggttcaagtgattctcatgcctcagcctcccaagtagctgagattacaggtgaccgccatcacacccggctaaattttatatatgtatatatatattttgagatggagtcgcactccgtcgcccaggctggagtgtattggcacgatttcagctcgctgtaacctctgccacctgggttcaagtgattgtcctgcctcagcctcccgagtagctgggattacagacacctgccattgcacctggctaatttttgtatttttagtagagatggggtttcaccatgttggcctggctgatcttgaactcctgacctcgtgatccacctgccttggcctcccaaagtgctgggattacaggcatgagccatcgcacctggcctaaattttatatttttattagagacagggtttcaccatgttgcccaggctggtcttgaactcttgacctcaagtgatctgcccgcctcggccttccaaaatgctgggattacaggtgtgagccaccacacccagccacttaccccagatatctgctcccctaccttcttaagtctcaaaggccacccagtaatcctataggtttggtacaattattccttccatttgtggaaatgtattctttacacaaaagaggaaactgaggctcagagagattaagtcacttgcccaagtttatacatttggtttgccatgaaatccatattaaagaatcttaggctacagaaggtagctcacacctgcaatcccagcactttgggaggccgaggtgggaggatcacttgagctggagaggtcaaggctgaagtcgctgtgatcactccactgtactccatccagcctgggtgacagagggaggccctgcctcaaaaaaaaaaaaaaggactccatttgttttttatgtattttttttattttttttgagacggagtttcactcttgttgcccaggctgcgatgcaatggtgcgatctccactcacagcaacctctgcctcctgggttcaagcgattctcctgcctcagcctcccgagtagctgggattacaggcatgcgccaccacacctagctaattttgtatttttagtagagacggggtttctccatgttggtcaggctggtctcgaactcctgacctcaggtgatctgcccccccttgctgagattacaggtgtgagccaccgtgcccggcctattttttattttttgagacagagtctcattccgtcacccaggctggagtgcagtggcacgatatcagctcactgcaacctccacctcccaggttcaagcaattctcctgcctcagccttctgagcagctgggattacaggcgtgtgccaccacgcccggctgatttttgtatttttagtagagacggagtttcaccatgttggccaagctagtcttgaactcctgacctcaagtgatctgcccacctcagccttccaaagtgctgggattataggtgtgagctgctgcacttggcctctaaagaaccttaatttaataagagatactcaaccctaaaactaacatttcccaatgggtggttttttgttttttgtttttgtttgtttgttttaagattctgagggtacagaaaagctgggcactgctgaatgcttgttgattgaaaaataattattaataatcacagtacctaattgtcttttttgagatggggtctcgctatgttgcccaggttggtctcaaactcctaagccaaagcaaccctccctccttggccacccaagtagctgcggtcacaggtacatggcattgcacctggccctaacactgattaagtatttacttgtgctaggcaccaagcttcctctcacttctttctcacagtaccccaagaaagccctcacttcagaatggtcaagtgagcgttggccaggttaataacttgcctaaagttatcagtgaagtcgggagcctgagcctcgagtctgcgccctgactcttgatgcaatcctgcaagccgggaaaatctgctcagcagtatttaaggatgtctgcattccccgaccacacagcagctgacggcagggccccagcaggtcgggtaaacaaggtcatggcatggggcaccatctgtctgcacaggcatgacagtcattcatacttttgttcatttattcattcagtgagcccatctctgtgccagctactgggatccagggtgagtcagacctggcccctgcccctgaggggctcaggacctgggaggggaggcaggagggtgaatgcatacataacagggtcttgctatgttggccagactggtcttgaactcctggcctcaagtgatcctcctgcctcagactcccaaagtactggcattgtaggcatgagccactgtgcccagcataaatgcatagttttttgggtttttgtttttttgttttttttttttttgagacggagtctcactttgttgcctaggctggagtgctgtggcacaatcccagctaactgcagcctccacctcctgggttcaagatatcctcctgcatcagccttctgagtagctgggattacaggcggctgccaccatgcccagctaatttttgtagttttagtagagacggggttttgccatattgtccaggctagtctcgaactcctaacctcaggtgatctgcaggcctcagctccccagagttctgggattataggtgtgagccaccgtacccagcctgaacatatgatttttatgtcataaaagctataactgaggtgcagacaaagttaccacagttggcagaatctaaggtggcttcctaaggaggggacttttgggccgcccagcatgagccaggagaaactgcctggtttaatgggaaggggtcatcccagtcctcacacctgctagtattactgggaggtgtctatgtgccaggagctgtccaaggtgtctcacccatgtggattcactgacctttccaaccccattggaggggtactactatgcccatgtcacagaagaggaggctaagacttagaggggttaaataacttgcctaacctcacacagatgttgaggagatgggactgagagggcagaggtagatcgtaggagtacagggctgcagagtcagggccagctctgggtttgcctgtcctctctcagaacattctggcattgttattgcattgtcacctctctaggctctgtctctgtcagttaacatttttattttactattttattatttatgttttttgagatggagtctcactttgtcactcaggctggagtgcagttgtgtgagcttggctcactgcaacctctgcctcccaggttcaagcaattctcctgcctcagcctcccaaatagctggaattacaggcgtatgccagcacatctggctaagttttatatttttagtagacatggggtttcaccatgttgccaggctggtctcgaactcctgacctcaggtgatccacttgcctcggcctcccaaagtgctgggattataggcatgagccactgtgcccggctaatatttatatatcttttagcagagacggggtttcaccatgttggccaggctcgtctcaaactcctgacctcaagtgatctgcccacctcggcctcccaaagtgttgggattacaggcatgagccaccgcgcccagcttaaaatttttaaaactcataatagctaacaaccctgagcacttaccatgacaagccaagctctgtacttagtccttctcctatttttttttttttctttggtagagacaggtcttgctctgttgcccgggctggagggcagtggcgtcatcatggctcactataactcaagctcctgagctcaagggatcctcccaccttagcctcctgagtagctgggactataggcaagtaccaccatgcccagctaattaaaaaaacatttcttttagagacagggtcctgctgtgttgcccagagtggtctcaaactcctgggctcaagtgatcctgtagccttggtctcccaaagtgctgggattagacatgagccactgcacccagctctcccgttcttttcagcatctaaaatgtcaggaaataaggactccaacaatccttgttgcacagaggagggaagtgaggctcagaaaggctggagaacttacgcagggccactcggctgggtagggagcaggacagggatttgtgcccaggcctcgttgcccccagaacctgtgagctccaaccatgcagtgccaccttcccacccatgttgctgagtggtgccttcaaactgtttggaccagactcacaggcacaaatacatttcatgtcacaaaccaggccacacctgcacgtaggcacacacaactaaaatattaatatcttttttttttttttttggtctcaaactgctgagagttttttttttttttcgttatctgcctgcctcggcctcccaaagcgctgggattacaggcatgagccaccatgcctgcccactctgatgttttctagtctattctctgatgatcccagctccaggaatttattctacagatccatccacattcatatgaaatgtgtatgaacagaattattgacgtgcaggtcgggcgcagtggctcatgcctgtaatcccagcaccttgggaggccaaggcaggcagatcgcttgaactcaggagtttgagactagcctggccaacatggtgaaaccctgtctctactaaaaatacaaaaattagccagacgtggtggcaggcgcctgtaatcccagctgcttgggtggctgaggcaggagaatcgcttgaacccaggagatggaggttgcggtgagccaagatcgcaccactgcattccagcctgggtgacagagcaagactccatctcaaaaaaaaaaaaaaaaaaaaaattcatgttaagaggaaaaggctcaaaataacccaagagtcaaatgatgggagaccaactaaataatctatggtatagccgcacaatggaatattatgaagccaaataaaacaatgaggtactggttggaaaaattccagaacatattgttaagtgaaaagagcaaaacataaaacaatgtgggtgagaggtgggggagtgatgcatgttcttttgatgtgcttgtagctgcataaggaaaagctgggaacatgcacaagaattgagtaagaaagaatgctttcctggccacctgggagtttctgggtccttttcctgcagttagccctgggcagaatgatcagggtagaattagaagtgaaacacagccaggcattgtggcttgcgcctgtaatcccagtgctttgagaggccaaggtgggaggatcacttgagcccaggagttcgagatcagcctggacaacatagtgagatcctatctttacaaatttttctttttttaattagctgggtgtggtgcacgcccctgtagtcccagctatttggaagactgaggtggggggattacttgagcctgggaggttgaagctgccgtaagctgtgatcatgccactgcactacagcctgggcaacagagtgagaccctgtctaaaaaaagaaaaaaacaggagtggaactcatagtttcctttttcttctcttgtcttttactttttccttttttaaattgagatggggtcttgtcatattgcccaggctggtcttgaactcctgggctcaggcaatcttcccaccttggcctcccaaagtgctgggattacaggcgtgagccaccgcgcctggcctattttttcgttttaaattacataaaatagaaatggggcaggcaccgtggctcacgcctgtaatcccagcactttgggaggccgaggccagtggatcacctgaggtcaggagttcaagaccagcctggccaacatggcgaaaacctgtttctactaaaaatacaaaaattagttgggtgtggtggcatatgcctgtagtcccagctacttgagaggctgaggcaggagaatcacttgaagctgggaggcagaggttgcagtgacctgagattgtgccactgcactctagcctaggtgacagagcaatactatgtttcgaaaaaataaataaatacaataaataaataaataaataaaatagaaatgggttctcgctatgttgcccaggctggttttcaactcctgggctcaagtgatcttcctacctcagcctcccaaagtgctgggattatagatatgagccactatgcctggcctcttttccttttcatatcaatttgatgtctgaaccacgtaagtaaaatcttttaaaatctaaggcagtcatatccacctaatttgatgttctggtggccacatgtccccgaggtccttacttacccagagctgccacgatgaggaagaaggaggcggccacgaggaaggccacgtcgggcttggtgtaggagagcagcttctgcagcgtggccccagacgcctgctcgggcggtggccggccgctcccagggaagccctcagcctcggtggccgcccctggctccagggcctgggtgcctggccgcacggtggacagcagccaccagagcaggaaggatgcgccgagtgaaatgtacgtccacacgaacagggcccaaaaccaggggtcccggatgggcctgcgcacctctgagaagagcagcagcttcaccatggcatagatgcccacgaagaggcacacgagggtgatgaccagccacgaggcccgcagccgccggggccccagcgcactgttcttggccacaccaatggtggctcccagcagcaggcagctgcggtacaggcaggctgcccagagatccagcaccgagtcaaagatgttgaagtggcggatgtcctccaggaggctgcggtccaggtggctgaagacatagatggccgtggtcacgcagatgtccacactcatgaaggccaaagtcaccaccaccgccttccacagccgcatcctgctggttggaggtgggcgggtgctgaaggccaggttgtagctcacgggggcaaggccatcatcatccacagggcgaggccaggcctgtagggacaacagcaaacatcagcacaaggggttcaggtttgccactcgctggctgtgtgaccttgagaaagtcacttgacatctctgagccttagttttctcatctgtaaaatggcaatatcaacttcccgggtactaagattccactcattcaagggatacttactgagtgcccactgcggccaggtgctgttctttgttctttgtcatgaacaaaaagaacaaagatccctgctctcctggagatgacatactcatgcaggagacagataataaggaaatgggctcacgcctgtaatcccagcactttgggaggccgaggtaggtggatcacctgaggtcaggagttgaagaccagcctggccaacatggtgaaacccccatctctactaaaaatacaaaatttagctgggtgacagagcgagactccatctcaaaaaaaaaaaaaaaagataataaggaaataatgtgtgtcttgtgaggccaaggttggaggatcccttgaggccaggagttggagagcagcctgggcaacagggtgagaccctgtctttaaaaagcaaacaaacaaacaaacaaacaaacattaactgagtgtggtagcatgctcctgtagtccaagctacttgggaggccaagatgggaggatcgcttcttcagcctgggagttcgaggccacagtgagctatgatcatgccactacactccagccctggtgacagcaagatcctatctctaaaaaaaaaaattttttttaattaaaaaaagagataagggttgtggtggaaaaaagaggggggtaaataggatggggtgagggtgaataggataggggtgggggaagacagagatcaattttattttatttatttatttatttgagacagagtcttgctctgtcgcccaggctggagtacagtggtgcgatcccggctcaccgcaacctccgtctccctggttcaagcgattctcctgcctcagccccccaagtagctgggactacaggtaccccaccaccatgaccagctaactttttgtattttttttagtagagacggggtttcaccatgttggccaggctgttctcaaactcctgacctcaagtgatccacatgcctcagtaacccaaagtctgggatcaaaagcgtgagccactgtgcggggccagagatcaattttaaatagggggccagagaagacctcgctgggtaggtaacacttgagcaagacttgaaagagttatggaagtctgccaagtggctatctggggaaaagcacttggcacaggtgaaacagtgccagagccccaaggcaggagtgccccttgggaaggcagcaaggccccatgagatcagagagggtggggagtatctggaggattttgcatccatagtgaggacgaagctgagataagcagagtttaataaacagccgctgtctttactaccactactcatttctctgaacctgtttcctcatttgcaaaatgtgagtgtgaggttcaatgtgtcagttctgggcagagtgcctggtgcataattgctgctgattgtaatcaaccatatacagtgtgtgcttaataaatgtttgtccacttttctcctcccacgtcaggccttctatctctgcaaccccaaataaactattttggtctaagagggaacttgacagctgtgggggtggcttgcaggccacacagcaatccagaaaccttggcatctgcttggaagtttccagaatcttttcctcctgcccaggttggccctcgtgcccagccctaggcccctttggttttctgaatcttgatgtctgctttatccaaggcatctcccggcactgggtccctcaggactcccccagagccgcagggacacccgggaagtgggcctggaggcctgagtttgtgagtggggcttgtccacggtagggttaggaccgggctggggtgtgtccctgggtgctacctcctgtctcagctccagtccttcctcccgtgggccttttgttgtcatatctgcaaaatgggctgggctctagatcccccaagaggaggggtgaggcgctgggtgacagcggggatgactgtcgtggctgggaaggggccatcctgagagagatcctctccccgaagctctggcgcccaggtgcccaaaccgctcacactgtggcatgactggaacctcacacagtcccacgaggccagggtttccatattcccgtttacagttagggaaactgaggcacagagagacaaaaccacctgatccagacattcagccaacaagggcccaagccaggatgacttgaggcagtcagtgagtgtaggaccccagcatctgcctctccacctgtctactgcatgcctggcacaaagcagttgtctaataactacaagcagacagggatgtaacactgcacttcctgtgagccctgccctgcaccatgtgcttcaaatccaggtggccccacctatttaatcctcacagcaactttgtgagatgtgcactgtcatcccttccacttaacagatggagaaactgaggcccagagaagtgaagaatttgcccaagattacacagcttctgaatagcagagctgggatgtggattcataggtgtctgagcccagaatctgtgttcttcacccctaaactaagataacattcaatatagaaaatgctaccaggggccaggcatggtggctcacacctgtaatcccatctgggcctcttgggaggccaagatgggcaacagcttgagctcacgagttcgattccagcctgggcaacatggcgaaatcccgtctctactaaaaatacaaaaattagccgagcatggtggtgcacgcctgtaaccccagcaactcaggaggctgaggcagaagaatcacttgaaactgggaggtggaggttgcggtgagccgagattgcgccactgcactccagcctgggtgacagagtgaaggaaaatgctaccgggaagtgttcatctaaggaaaagggtccccagcagagggctgggccgtgtggcagaggtgataagactgctgaggctaattgctggcaatgacagcagctggtgccagctgacattggctccaggcacttacatgcgtcagcactcaccagagccctatgaagtaggtcctatcattatccccattttacagttaggaaaactgaggaacagagagattaagtgacctgccctgggtcacagagctaggtgacccacagagttgggtcacaagctgggatgtgaaccctggccgtccagttccaaaatctgtactctcaactccatagctccaacccttcaaaacagcctctccaggaggtaggcacaacccctactaatgctgagaaggggtctgagatgcagagggggaatggagtggggggatataacaacctccaagcctgggccctgctttcacccccacacctccaggcacaccgaagcccatcgcagagatgacagttgcttagtcagcagctgcccctccaaagacggtcagggccaagcagggtcaagggcaaggggaagtgggtaggatggtcggacaccctcagcccaggtcctggctccctccccagccctgcctgtgctgcccacgcaggctcctgtctgctgcaatgcagaggccgtggggagcgagcgagtgggtgagctccagtcagagcccagggagggaagctcctggcctggtgccattccaggcctcccagccaagccactgccggctgcaccaggtgctgccagccgcctcagctgctgctctcctcgtggtgggcacatggggtccctcagtccccagaaaggggctcgggctcagaagtggaacaggaggcagatccgcaagagactcaaaacctggacagcagcccaggggcttggctgactctcccaacctgactcccagcctctgggggaattccttccccatcccccaacagcccagggtaccagtcatgccccccgcctccagaagcctatttatcttcatcagaataaacaaaatttcaaacactcatatcgcagactaccaaagccacattttgcagatggggaaactgaggcccacagagggagggggtgaggcttgtctcaggtcatccaccaggctggggcagagcagtgctagcacctgggtccctgcccccaagcactagtccttctaccacagactcctagcagagtggactccagccccgggtcgggttacagtcctcggtggggacagttactccgttatttttaaagctactgggcagaagcgtgaccaccagccaaggctgcttagaggcctgtcaccgctctccaactgcctgactcagaggatgcgctgggctcggccaggtggagctggagggcaaattgtgagcacatgggtgacctgcttggcctgagggacaaggacaaggtggtggccagaataggccccacccagaaccggacaaggcccaggaagacaggggtggctcgccctgactccgtgcactaaagaatggcacaggataagcaagtggccttgtccccaccaggggtcttgtcaaaggcttttcttcccagggtaggagacattggttggggtatctctaggcatcagctgcagagaaggccagaagacgatagatagcagttattatgacgctgcaacagagaccctttgcagagaaggccaggagacaatagataaaagttattatgacactgcaacagagacccttcaccgggccctactatgtgcctggcacctcccaaagcagccaggcctccccacttccctgggaggaccctgtggtcatcagcttcgttttacagctggggagacagaagaggttaagtgacacgcagaaaaaggacgaaggcaggatggagacccgcatccagggtctccaggatggagactcgggggtcccctgtccaggctattcagggattgcaagaaaaggggccaaagaacttgggtggcccagtggcctcggttcacccctgacatggtgagctttttaccccggtgtgggcccagacccagataagcccattccattcgctgcgcagcaaagcactgactgacagaggcctgctgggtgggagggcctgactgtgggggtccctggctctggggcaggagcgggctgggtctgcgtgggtccatcctgatttcatccctgctgagcctctggcagcccacgtggggcccagcctcactctgggacttgagaagctgtctcaggtgctctcagctctaggagaggcagagaggcgcgaggtgccctccctccaagcctcctcttgtcacccggccctgcactatccggaaaaggggaatgggcagaggcggggatcctgtcagcccagcttaaagctgtctcagttaatgtcaggccgggggaggaggctttttttttttttccagaggcccagaaataaaagaggctcccctgggaacctacaggcctcactgccagcgtggatggcggggagcagcggcagcccactggcctgctgaggagactgagaaaagggctttgcccaggtcagcaggaacaggccagatcccccaggcttctgccaaagccctggtgctcaggatccctgggaagccctgacatggacagtgggagccctcagaaggcgcgccagccccgtcctgggggaacgacagccatcccaggatcctccaacacctcccacattttccaagaggcagcggcgccttgggggttaaaaaaaatggcaacattcgccctacgggcgcggaaaggatgctgcagggatgggggctgggagctgcggctgcgggctccgggagggctccagggaggctcccaccttcaaccgagatgcctattcccaccgaggcaggggtgcccagacgccccccaacgcgtgcctggcctggcaccctggcctggaaaggtcccaaaaccaggggtctagggtgccttgcccttacctgttacctggcaccaggtgagctctgggagggggcgcgcagcaggctcgggtctggggtgcagtttccgcgctgctcattgaagactgcgccggacgcggtcctcgctccgctcttcccgctgctcctccccgcctcccacccgcgctgcgccgctgcaaggtcggagctgagactggcgtgcgttgagacaggctgatggacggggcggggcctcagtgac

SEQ ID NO: 763 - DNA, 37518 bp, Homo sapiens; identical to SEQ ID NO: 762

SEQ ID NO: 764 - DNA, 37518 bp, Homo sapiens; identical to SEQ ID NO: 762
